US009920330B2

(12) United States Patent
Matarasso et al.

(10) Patent No.: US 9,920,330 B2
(45) Date of Patent: Mar. 20, 2018

(54) ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY

(71) Applicant: Evogene Ltd., Rechovot (IL)

(72) Inventors: Noa Matarasso, Tel-Aviv (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 689 days.

(21) Appl. No.: 14/381,596

(22) PCT Filed: Feb. 27, 2013

(86) PCT No.: PCT/IL2013/050172
§ 371 (c)(1),
(2) Date: Aug. 28, 2014

(87) PCT Pub. No.: WO2013/128448
PCT Pub. Date: Sep. 6, 2013

(65) Prior Publication Data
US 2015/0106973 A1    Apr. 16, 2015

Related U.S. Application Data

(60) Provisional application No. 61/681,252, filed on Aug. 9, 2012, provisional application No. 61/604,588, filed on Feb. 29, 2012.

(51) Int. Cl.
*C12N 15/82*    (2006.01)
*C07K 14/415*    (2006.01)

(52) U.S. Cl.
CPC ........ *C12N 15/8271* (2013.01); *C07K 14/415* (2013.01); *C12N 15/8209* (2013.01); *C12N 15/8247* (2013.01); *C12N 15/8255* (2013.01); *C12N 15/8261* (2013.01)

(58) Field of Classification Search
None
See application file for complete search history.

(56) References Cited

U.S. PATENT DOCUMENTS

| 6,084,153 A | 7/2000 | Good et al. | |
|---|---|---|---|
| 2002/0046419 A1 | 4/2002 | Choo et al. | |
| 2005/0108791 A1 | 5/2005 | Edgerton | |
| 2006/0179511 A1 | 8/2006 | Chomet et al. | |
| 2007/0214517 A1* | 9/2007 | Alexandrov | C07K 14/415 800/278 |
| 2010/0037352 A1 | 2/2010 | Alexandrov et al. | |
| 2011/0098183 A1* | 4/2011 | Blasing | C07K 14/415 504/196 |
| 2014/0380523 A1 | 12/2014 | Emmanuel et al. | |

FOREIGN PATENT DOCUMENTS

| WO | WO 2004/081173 | 9/2004 |
|---|---|---|
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |
| WO | WO 2009077611 | * 6/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |

(Continued)

OTHER PUBLICATIONS

Examination Report dated May 6, 2016 From the Instituto Mexicano de la Propiedad Industrial, IMPI Re. Application No. MX/a/2014/010438 and Its Translation Into English.
Examination Report dated Nov. 16, 2016 From the Instituto Mexicano de la Propiedad Industrial, IMPI Re. Application No. MX/a/2014/010438 and Its Translation Into English. (10 Pages).
Patent Examination Report dated Feb. 25, 2015 From the Australian Government, IP Australia Re. Application No. 2014202590.
Restriction Official Action dated Mar. 19, 2015 From the US Patent and Trademark Office Re. U.S. Appl. No. 14/580,020.

(Continued)

*Primary Examiner* — Medina A Ibrahim
*Assistant Examiner* — Wayne Zhong

(57) ABSTRACT

Provided are isolated polynucleotides comprising a nucleic acid sequence encoding a polypeptide at least 80% identical to SEQ ID NO: 422, 362-421, 423-601, 2429-4085 and 4086, such as a polynucleotide which is at least 80% identical to SEQ ID NO: 260, 1-259, 261-361, 602-2427 and 2428, nucleic acid constructs comprising same, plant cells comprising same, transgenic plants expressing same, and methods of generating thereof for increasing the yield, biomass, growth rate, vigor, oil content, fiber yield, fiber quality, nitrogen use efficiency and/or abiotic stress tolerance of a plant.

11 Claims, 8 Drawing Sheets

(56) References Cited

FOREIGN PATENT DOCUMENTS

| WO | WO 2013/080203 | 6/2013 |
|---|---|---|
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

Completion Requirement Letter dated Dec. 9, 2014 From the Canadian Intellectual Property Office Re. Application No. 2,865,483.

International Preliminary Report on Patentability dated Sep. 12, 2014 From the International Bureau of WIPO Re. Application No. PCT/IL2013/050172.

International Search Report and the Written Opinion dated May 12, 2013 From the International Searching Authority Re. Application No. PCT/IL2013/050172.

Invitation to Pay Additional Fees dated Apr. 8, 2013 From the International Searching Authority Re. Application No. PCT/IL2013/050172.

Desveaux et al. "Whirly Transcription Factors: Defense Gene Regulation and Beyond", Trends in Plant Science, TiPS, 10(2): 95-102, Feb. 2005.

Good et al. "Can Less Yield More? Is Reducing Nutrient Input Into the Environment Compatible With Maintaining Crop Production?", Trends in Plant Science, 9(12): 597-605, Dec. 2004.

Good et al. "Engineering Nitrogen Use Efficiency With Alanine Aminotransferase", Canadian Journal of Botany, 85: 252-262, 2007.

Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.

Young et al. "Hypothetical Protein MTR_7g116270 [Medicago Truncatula]", Database NCBI [Online], GenBank: AES82688.1, Database Accession No. AES82688, Nov. 21, 2011.

Examination Report dated Sep. 29, 2017 From the Australian Government, IP Australia Re. Application No. 2013227247. (4 Pages).

Examination Report dated May 11, 2017 From the Instituto Mexicano de la Propiedad Industrial, Direccion Divisional de Patentes, IMPI Re. Application No. MX/a/2014/010438 and Its Translation Into English. (9 Pages).

* cited by examiner pQFN, pQFNc

Normal conditions

Osmotic stress (15 % PEG)

Nitrogen limiting conditions pQNa_RP pQXNc

ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY

RELATED APPLICATIONS

This application is a National Phase of PCT Patent Application No. PCT/IL2013/050172 having International filing date of Feb. 27, 2013, which claims the benefit of priority under 35 USC § 119(e) of U.S. Provisional Patent Application Nos. 61/604,588 filed on Feb. 29, 2012 and 61/681,252 filed on Aug. 9, 2012. The contents of the above applications are all incorporated by reference as if fully set forth herein in their entirety.

SEQUENCE LISTING STATEMENT

The ASCII file, entitled 60216SequenceListing.txt, created on Aug. 17, 2014, comprising 11,819,157 bytes, submitted concurrently with the filing of this application is incorporated herein by reference.

FIELD AND BACKGROUND OF THE INVENTION

The present invention, in some embodiments thereof, relates to isolated polypeptides and polynucleotides, nucleic acid constructs comprising same, transgenic cells comprising same, transgenic plants exogenously expressing same and more particularly, but not exclusively, to methods of using same for increasing yield (e.g., seed yield, oil yield), biomass, growth rate, vigor, oil content, fiber yield, fiber quality, fertilizer use efficiency (e.g., nitrogen use efficiency) and/or abiotic stress tolerance of a plant.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes.

The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; Arabidopsis Information. Resource (TAIR; Hypertext Transfer Protocol://World Wide Web (dot) arabidopsis (dot) org/), TAIR No. AT2G43710)], OleosinA (TAIR No. AT3G01570) or FAD3 (TAIR No. AT2G29980), and various transcription factors and activators such as Lec1 [TAR No. AT1G21970, Lotan et al. 1998. Cell. 26; 93(7):1195-205], Lec2 [TAIR No. AT1G28300, Santos Mendoza et al. 2005, FEBS Lett. 579(21):4666-70], Fus3 (TAIR No. AT3G26790), ABI3 [TAIR No. AT3G24650, Lara et al. 2003. J Biol Chem. 278(23): 21003-11] and Wri1 [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using Arabidopsis FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops such as corn and wheat. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. No. 20020046419 to Choo, et al.; U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions. U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield); WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modem spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. No. 5,981,834, U.S. Pat. No. 5,597,718, U.S. Pat. No. 5,620,882, U.S. Pat. No. 5,521,708 and U.S. Pat. No. 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

SUMMARY OF THE INVENTION

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising a nucleic acid sequence encoding a polypeptide at least 80% homologous (e.g., identical) to SEQ ID NO: 362-601, 2429-4085 or 4086, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising a nucleic acid sequence encoding a polypeptide selected from the group consisting of SEQ ID NOs: 362-601, 2429-4085 and 4086, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of producing a crop comprising growing a crop of a plant expressing an exogenous polynucleotide comprising a nucleic acid sequence encoding a polypeptide at least 80% homologous (e.g., identical) to the amino acid sequence selected from the group consisting of SEQ ID NOs: 362-601, 2429-4085 and 4086, wherein the plant is derived from a plant selected for increased yield, increased growth rate, increased biomass, increased vigor, increased oil content, increased seed yield, increased fiber yield, increased fiber quality, increased nitrogen use efficiency, and/or increased abiotic stress tolerance as compared to a control plant, thereby producing the crop.

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising a nucleic acid sequence at least 80% identical to SEQ ID NO: 1-361, 602-2427 or 2428, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising the nucleic acid sequence selected from the group consisting of SEQ ID NOs:1-361, 602-2427 and 2428, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of producing a crop comprising growing a crop of a plant expressing an exogenous polynucleotide which comprises a nucleic acid sequence which is at least 80% identical to the nucleic acid sequence selected from the group consisting of SEQ ID NOs:1-361, 602-2427 and 2428, wherein the plant is derived from a plant selected for increased yield, increased growth rate, increased biomass, increased vigor, increased oil content, increased seed yield, increased fiber yield, increased fiber quality, increased nitrogen use efficiency, and/or increased abiotic stress tolerance as compared to a control plant, thereby producing the crop.

According to an aspect of some embodiments of the present invention there is provided an isolated polynucleotide comprising a nucleic acid sequence encoding a polypeptide which comprises an amino acid sequence at least 80% homologous (e.g., identical) to the amino acid sequence set forth in SEQ ID NO: 362-601, 2429-4085 or 4086, wherein the amino acid sequence is capable of increasing yield, growth rate, biomass, vigor, oil content, seed yield, fiber yield, fiber quality, nitrogen use efficiency, and/or abiotic stress of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 362-601, 2429-4085 and 4086.

According to an aspect of some embodiments of the present invention there is provided an isolated polynucleotide comprising a nucleic acid sequence at least 80% identical to SEQ ID NO: 1-361, 602-2427 or 2428, wherein the nucleic acid sequence is capable of increasing yield, growth rate, biomass, vigor, oil content, seed yield, fiber yield, fiber quality, nitrogen use efficiency, and/or abiotic stress of a plant.

According to an aspect of some embodiments of the present invention there is provided an isolated polynucleotide comprising the nucleic acid sequence selected from the group consisting of SEQ ID NOs: 1-361, 602-2427 and 2428.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous (e.g., identical) to SEQ ID NO: 362-601, 2429-4085 or 4086, wherein the amino acid sequence is capable of increasing yield, growth rate, biomass, vigor, oil content, seed yield, fiber yield, fiber quality, nitrogen use efficiency, and/or abiotic stress of a plant.

According to an aspect of some embodiments of the present invention there is provided an isolated polypeptide comprising the amino acid sequence selected from the group consisting of SEQ ID NOs: 362-601, 2429-4085 and 4086.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to some embodiments of the invention, the nucleic acid sequence encodes an amino acid sequence selected from the group consisting of SEQ ID NOs: 362-601, 2429-4085 and 4086.

According to some embodiments of the invention, the nucleic acid sequence is selected from the group consisting of SEQ ID NOs: 1-361, 602-2427 and 2428.

According to some embodiments of the invention, the polynucleotide consists of the nucleic acid sequence selected from the group consisting of SEQ ID NOs: 1-361, 602-2427 and 2428.

According to some embodiments of the invention, the nucleic acid sequence encodes the amino acid sequence selected from the group consisting of SEQ ID NOs: 362-601, 2429-4085 and 4086.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, osmotic stress, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to an aspect of some embodiments of the present invention there is provided a transgenic plant comprising the nucleic acid construct of some embodiments of the invention or the plant cell of some embodiments of the invention.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

According to an aspect of some embodiments of the present invention there is provided a method of growing a crop, the method comprising seeding seeds and/or planting plantlets of a plant transformed with the isolated polynucleotide of some embodiments of the invention, or the nucleic acid construct of some embodiments of the invention, wherein the plant is derived from plants selected for at least one trait selected from the group consisting of: increased nitrogen use efficiency, increased abiotic stress tolerance, increased biomass, increased growth rate, increased vigor, increased yield, increased fiber yield or quality, and increased oil content as compared to a non-transformed plant, thereby growing the crop.

According to some embodiments of the invention, the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
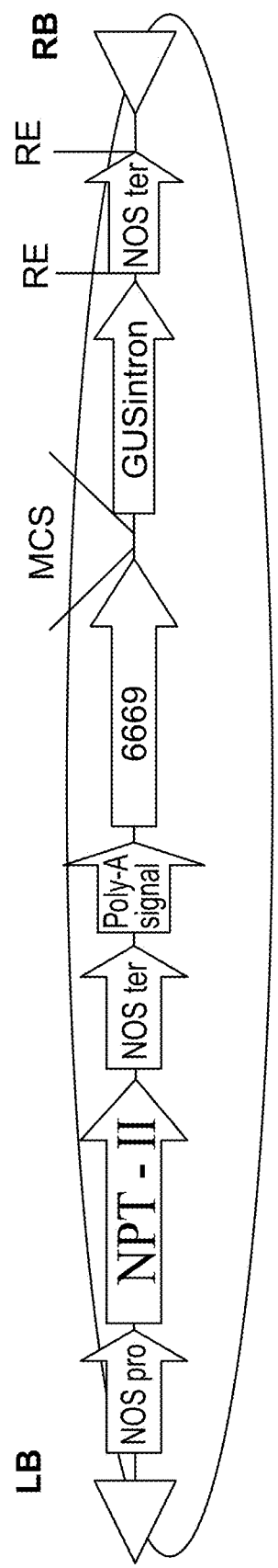
FIG. 1 is a schematic illustration of the modified pGI binary plasmid containing the new At6669 promoter (SEQ ID NO: 4111) and the GUSintron (pQYN 6669) used for expressing the isolated polynucleotide sequences of the invention. RB—T-DNA right border; LB—T-DNA left border; MCS—Multiple cloning sites; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.

The present invention, in some embodiments thereof, relates to isolated polynucleotides and polypeptides, nucleic acid constructs encoding same, cells expressing same, transgenic plants expressing same and methods of using same for increasing yield, biomass, growth rate, vigor, oil content, fiber yield, fiber quality, nitrogen use efficiency and/or abiotic stress tolerance of a plant.

Before explaining at least one embodiment of the invention in detail, it is to be understood that the invention is not necessarily limited in its application to the details set forth in the following description or exemplified by the Examples.

The invention is capable of other embodiments or of being practiced or carried out in various ways.

The present inventors have identified novel polypeptides and polynucleotides which can be used to generate nucleic acid constructs, transgenic plants and to increase yield, growth rate, vigor, biomass, oil content, fiber yield, fiber quality, fiber length, nitrogen use efficiency, fertilizer use efficiency, abiotic stress tolerance and/or water use efficiency of a plant.

Thus, as shown in the Examples section which follows, the present inventors have utilized bioinformatics tools to identify polynucleotides which enhance yield (e.g., seed yield, oil yield, oil content), growth rate, biomass, vigor and/or abiotic stress tolerance of a plant. Genes which affect the trait-of-interest were identified based on expression profiles of genes of several Arabidopsis, tomato, B. Juncea, Soghum, Soybean, Brachypodium and cotton ecotypes, varieties and accessions in various tissues and under various growth conditions, homology with genes known to affect the trait-of-interest and using digital expression profile in specific tissues and conditions (Tables 1-53, Examples 1-12). Homologous (e.g., orthologous) polypeptides and polynucleotides having the same function were also identified (Table 54, Example 13). Transgenic plants over-expressing the identified polynucleotides were found to exhibit increased seed yield, oil yield, biomass, vigor, photosynthetic area, dry matter, harvest index, growth rate, rosette area, oil percentage in seed and weight of 1000 seeds (Tables 56-69; Examples 15-17). Altogether, these results suggest the use of the novel polynucleotides and polypeptides of the invention for increasing yield (including oil yield, seed yield and oil content), growth rate, biomass, vigor, fiber yield and/or quality, nitrogen use efficiency and/or abiotic stress tolerance of a plant.

Thus, according to an aspect of some embodiments of the invention, there is provided method of increasing yield, oil content, growth rate, biomass, vigor, fiber yield, fiber quality, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 362-601, 2429-4085 and 4086, thereby increasing the yield, oil content, growth rate, biomass, vigor, fiber yield, fiber quality, fertilizer use efficiency (e.g., nitrogen use efficiency) and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow.

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, oil content, growth rate, biomass, vigor, fiber yield, fiber quality, fertilizer use efficiency (e.g., nitrogen use efficiency) and/or abiotic stress tolerance of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 362-601, 2429-4085 and 4086.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from *Oryza sativa Nipponbare* available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

Homology (e.g., percent homology, identity+similarity) can be determined using any homology comparison software computing a pairwise sequence alignment.

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from http://emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from http://www(dot)biocceleration(dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from http://emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "−F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter): EMBOSS-6.0.1 Needleman-Wunsch algorithm with the following modified parameters:

gapopen=8 gapextend=2. The rest of the parameters are unchanged from the default options listed here:

Standard (Mandatory) qualifiers:

[-asequence] sequence Sequence filename and optional format, or reference (input USA)

[-bsequence] seqall Sequence(s) filename and optional format, or reference (input USA)

-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)

-gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)

[-outfile] align [*.needle] Output alignment file name Additional (Optional) qualifiers:

-datafile matrixf [EBLOSUM62 for protein, EDNAFULL for DNA]. This is the scoring matrix file used when comparing sequences. By default it is the file 'EBLOSUM62'

(for proteins) or the file 'EDNAFULL' (for nucleic sequences). These files are found in the 'data' directory of the EMBOSS installation.

| Advanced (Unprompted) qualifiers: | | |
|---|---|---|
| [no]brief | boolean | [Y] Brief identity and similarity |
| Associated qualifiers: | | |
| "asequence" associated qualifiers | | |
| sbegin1 | integer | Start of the sequence to be used |
| send1 | integer | End of the sequence to be used |
| sreverse1 | boolean | Reverse (if DNA) |
| sask1 | boolean | Ask for begin/end/reverse |
| snucleotide1 | boolean | Sequence is nucleotide |
| sprotein1 | boolean | Sequence is protein |
| slower1 | boolean | Make lower case |
| supper1 | boolean | Make upper case |
| sformat1 | string | Input sequence format |
| sdbname1 | string | Database name |
| sid1 | string | Entryname |
| ufo1 | string | UFO features |
| fformat1 | string | Features format |
| fopenfile1 | string | Features file name |
| "bsequence" associated qualifiers | | |
| sbegin2 | integer | Start of each sequence to be used |
| send2 | integer | End of each sequence to be used |
| sreverse2 | boolean | Reverse (if DNA) |
| sask2 | boolean | Ask for begin/end/reverse |
| snucleotide2 | boolean | Sequence is nucleotide |
| sprotein2 | boolean | Sequence is protein |
| slower2 | boolean | Make lower case |
| supper2 | boolean | Make upper case |
| sformat2 | string | Input sequence format |
| sdbname2 | string | Database name |
| sid2 | string | Entryname |
| ufo2 | string | UFO features |
| fformat2 | string | Features format |
| fopenfile2 | string | Features file name |
| "outfile" associated qualifiers | | |
| aformat3 | string | Alignment format |
| aextension3 | string | File name extension |
| adirectory3 | string | Output directory |
| aname3 | string | Base file name |
| awidth3 | integer | Alignment width |
| aaccshow3 | boolean | Show accession number in the header |
| adesshow3 | boolean | Show description in the header |
| ausashow3 | boolean | Show the full USA in the alignment |
| aglobal3 | boolean | Show the full sequence in alignment |
| General qualifiers: | | |
| auto | boolean | Turn off prompts |
| stdout | boolean | Write first file to standard output |
| filter | boolean | Read first file from standard input, write first file to standard output |
| options | boolean | Prompt for standard and additional values |
| debug | boolean | Write debug output to program.dbg |
| verbose | boolean | Report some/full command line options |
| help | boolean | Report command line options. More information on associated and general qualifiers can be found with -help -verbose |
| warning | boolean | Report warnings |
| error | boolean | Report errors |
| fatal | boolean | Report fatal errors |
| die | boolean | Report dying program messages |

2. Between a Protein Sequence and a Nucleotide Sequence (Following the Tblastn Filter):

GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options:
Usage:
om -model=<model_fname>[-q=]query [-db=]database [options]

-model=<model_fname> Specifies the model that you want to run. All models supplied by Compugen are located in the directory $CGNROOT/models/.
Valid Command Line Parameters:
-dev=<dev_name> Selects the device to be used by the application.
   Valid devices are:
      bic—Bioccelerator (valid for SW, XSW, FRAME_N2P, and FRAME_P2N models).
      xlg—BioXL/G (valid for all models except XSW).
      xlp—BioXL/P (valid for SW, FRAME+_N2P, and FRAME_P2N models).
      xlh—BioXL/H (valid for SW, FRAME+_N2P, and FRAME_P2N models).
      soft—Software device (for all models).
-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.
-db=<database name> Chooses the database set. The database set can be a sequence file or a database reference. The database format is detected automatically. However, you may specify a format using -dfmt parameter.
-qacc Add this parameter to the command line if you specify query using accession numbers.
-dacc Add this parameter to the command line if you specify a database using accession numbers.
-dfmt/-qfmt=<format_type> Chooses the database/query format type. Possible formats are:
   fasta—fasta with seq type auto-detected.
   fastap—fasta protein seq.
   fastan—fasta nucleic seq.
   gcg—gcg format, type is auto-detected.
   gcg9seq—gcg9 format, type is auto-detected.
   gcg9seqp—gcg9 format protein seq.
   gcg9seqn—gcg9 format nucleic seq.
   nbrf—nbrf seq, type is auto-detected.
   nbrfp—nbrf protein seq.
   nbrfn—nbrf nucleic seq.
   embl—embl and swissprot format.
   genbank—genbank format (nucleic).
   blast—blast format.
   nbrf gcg—nbrf-gcg seq, type is auto-detected.
   nbrf gcgp—nbrf-gcg protein seq.
   nbrf gcgn—nbrf-gcg nucleic seq.
   raw—raw ascii sequence, type is auto-detected.
   rawp—raw ascii protein sequence.
   rawn—raw ascii nucleic sequence.
   pir—pir codata format, type is auto-detected.
   profile—gcg profile (valid only for -qfmt in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.

-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
 Valid for SW and XSW.
-dtrans Performs a translated search, relevant for a protein query against a DNA database. Each database entry is translated to six reading frames and a result is given for each frame.
 Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
 zscore.
 escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS.
Possible values are:
 PFS—PFS text format
 FASTA—FASTA text format
 BLAST—BLAST text format
-nonorm Do not perform score normalization.
-norm=<norm_name> Specifies the normalization method. Valid options are:
 log—logarithm normalization.
 std—standard normalization.
 stat—Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.
-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note:"-batch" and "-wait" parameters are mutually exclusive.
-version Prints the software version number.
-help Displays this help message. To get more specific help type:
 "om -model=<model_fname>-help".
 According to some embodiments the homology is a local homology or a local identity.
 Local alignments tools include, but are not limited to the BlastP, BlastN, BlastX or TBLASTN software of the National Center of Biotechnology Information (NCBI), FASTA, and the Smith-Waterman algorithm.
 A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.
 Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.
 Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.
 According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:362-601, 2429-4085 and 4086.

According to some embodiments of the invention, the method of increasing yield, oil content, growth rate, biomass, vigor, fiber yield, fiber quality, fertilizer use efficiency (e.g., nitrogen use efficiency) and/or abiotic stress tolerance of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:362-601, 2429-4085 and 4086, thereby increasing the yield, oil content, growth rate, biomass, vigor, fiber yield, fiber quality, fertilizer use efficiency (e.g., nitrogen use efficiency) and/or abiotic stress tolerance of the plant.

According to some embodiments of the invention, the exogenous polynucleotide encodes a polypeptide consisting of the amino acid sequence set forth by SEQ ID NO:362-601, 2429-4085 or 4086.

According to an aspect of some embodiments of the invention, the method of increasing yield, oil content, growth rate, biomass, vigor, fiber yield, fiber quality, fertilizer use efficiency (e.g., nitrogen use efficiency) and/or abiotic stress tolerance of a plant, is effected by expressing within the plant an exogenous polynucleotide comprising a nucleic acid sequence encoding a polypeptide comprising an amino acid sequence selected from the group consisting of SEQ ID NOs:362-601, 2429-4085 and 4086, thereby increasing the yield, oil content, growth rate, biomass, vigor, fiber yield, fiber quality, fertilizer use efficiency (e.g., nitrogen use efficiency) and/or abiotic stress tolerance of the plant.

According to an aspect of some embodiments of the invention, there is provided a method of increasing yield, oil content, growth rate, biomass, vigor, fiber yield, fiber quality, fertilizer use efficiency (e.g., nitrogen use efficiency) and/or abiotic stress tolerance of a plant, comprising expressing within the plant an exogenous polynucleotide comprising a nucleic acid sequence encoding a polypeptide selected from the group consisting of SEQ ID NOs: 362-601, 2429-4085 and 4086, thereby increasing the yield, oil content, growth rate, biomass, vigor, fiber yield, fiber quality, fertilizer use efficiency (e.g., nitrogen use efficiency) and/or abiotic stress tolerance of the plant.

According to some embodiments of the invention, the exogenous polynucleotide encodes a polypeptide consisting of the amino acid sequence set forth by SEQ ID NO: 362-601, 2429-4085 or 4086.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-361, 602-2427 and 2428.

According to an aspect of some embodiments of the invention, there is provided a method of increasing yield, oil content, growth rate, biomass, vigor, fiber yield, fiber quality, fertilizer use efficiency (e.g., nitrogen use efficiency) and/or abiotic stress tolerance of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-361, 602-2427 and 2428, thereby increasing the yield, oil content, growth rate, biomass, vigor, fiber yield, fiber quality, fertilizer use efficiency (e.g., nitrogen use efficiency) and/or abiotic stress tolerance of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-361, 602-2427 and 2428.

According to some embodiments of the invention the exogenous polynucleotide is set forth by SEQ ID NO:1-361, 602-2427 or 2428.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

A non-limiting example of a non-coding RNA polynucleotide is provided in SEQ ID NO: 731.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-361, 602-2427 and 2428.

According to some embodiments of the invention the nucleic acid sequence is capable of increasing yield, oil content, growth rate, biomass, vigor, fiber yield, fiber quality, fertilizer use efficiency (e.g., nitrogen use efficiency) and/or abiotic stress tolerance of a plant.

According to some embodiments of the invention the isolated polynucleotide comprising the nucleic acid sequence selected from the group consisting of SEQ ID NOs:1-361, 602-2427 and 2428.

According to some embodiments of the invention the isolated polynucleotide is set forth by SEQ ID NO:1-361, 602-2427 or 2428.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NO: 362-601, 2429-4085 or 4086.

According to some embodiments of the invention the amino acid sequence is capable of increasing yield, oil content, growth rate, biomass, vigor, fiber yield, fiber quality, fertilizer use efficiency (e.g., nitrogen use efficiency) and/or abiotic stress tolerance of a plant.

The invention provides an isolated polynucleotide comprising a nucleic acid sequence encoding a polypeptide which comprises the amino acid sequence selected from the group consisting of SEQ ID NOs:362-601, 2429-4085 and 4086.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO: 362-601, 2429-4085 or 4086.

According to some embodiments of the invention, the polypeptide comprising an amino acid sequence selected from the group consisting of SEQ ID NOs:362-601, 2429-4085 and 4086.

According to some embodiments of the invention, the polypeptide is set forth by SEQ ID NO: 362-601, 2429-4085 or 4086.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratis sima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, *eucalyptus*, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, *lupinus*, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 4087; Albanietal, Plant Cell, 9: 171-184, 1997, which is fully incorporated herein by reference), wheat LMW (SEQ ID NO: 4088 (longer LMW promoter), and SEQ ID NO: 4089 (LMW promoter) and HMW glutenin-1 (SEQ ID NO: 4090 (Wheat HMW glutenin-1 longer promoter); and SEQ ID NO: 4091 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 4092 (wheat alpha gliadin, B genome, promoter); SEQ ID NO: 4093 (wheat gamma gliadin promoter); EMBO 3:1409-15, 1984, which is fully incorporated herein by reference], wheat TdPR60 [SEQ ID NO: 4094 (wheat TdPR60 longer promoter) or SEQ ID NO: 4095 (wheat TdPR60 promoter); Kovalchuk et al., Plant Mol Biol 71:81-98, 2009, which is fully incorporated herein by reference], maize Ub1 Promoter [cultivar Nongda 105 (SEQ ID NO: 4096); GenBank: DQ141598.1; Taylor et al., Plant Cell Rep 1993 12: 491-495, which is fully incorporated herein by reference; and cultivar B73 (SEQ ID NO: 4097); Christensen, A H, et al. Plant Mol. Biol. 18 (4), 675-689 (1992), which is fully incorporated herein by reference]; rice actin 1 (SEQ ID NO: 4098; Mc Elroy et al. 1990, The Plant Cell, Vol. 2, 163-171, which is fully incorporated herein by reference), rice GOS2 [SEQ ID NO: 4099 (rice GOS2 longer promoter) and SEQ ID NO: 4100 (rice GOS2 Promoter); De Pater et al. Plant J. 1992; 2: 837-44, which is fully incorporated herein by reference], arabidopsis Pho1 [SEQ ID NO: 4101 (arabidopsis Pho1 Promoter); Hamburger et al., Plant Cell. 2002; 14: 889-902, which is fully incorporated herein by reference], ExpansinB promoters, e.g., rice ExpB5 [SEQ ID NO: 4102 (rice ExpB5 longer promoter) and SEQ ID NO: 4103 (rice ExpB5 promoter)] and Barley ExpB1 [SEQ ID NO: 4104 (barley ExpB1 Promoter), Won et al. Mol Cells. 2010; 30:369-76, which is fully incorporated herein by reference], barley SS2 (sucrose synthase 2) [(SEQ ID NO: 4105), Guerin and Carbonero, Plant Physiology May 1997 vol. 114 no. 1 55-62, which is fully incorporated herein by reference], and rice PG5a [SEQ ID NO:4106, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 4107 (CaMV 35S (QFNC) Promoter); SEQ ID NO: 4108 (PJJ 35S from *Brachypodium*); SEQ ID NO: 4109 (CaMV 35S (OLD) Promoter) (Odell et al., Nature 313:810-812, 1985)], *Arabidopsis* At6669 promoter (SEQ ID NO: 4110 (*Arabidopsis* At6669 (OLD) Promoter); see PCT Publication No. WO04081173A2 or the new At6669 promoter (SEQ ID NO: 4111 (*Arabidopsis* At6669 (NEW) Promoter)); maize Ub1 Promoter [cultivar Nongda 105 (SEQ ID NO:4096); GenBank: DQ141598.1; Taylor et al., Plant Cell Rep 1993 12: 491-495, which is fully incorporated herein by reference; and cultivar B73 (SEQ ID NO:4097); Christensen, A H, et al. Plant Mol. Biol. 18 (4), 675-689 (1992), which is fully incorporated herein by reference]; rice actin 1 (SEQ ID NO: 4098, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 4099 (rice GOS2 longer Promoter) and SEQ ID NO: 4100 (rice GOS2 Promoter), de Pater et al, Plant J November; 2(6):837-44, 1992]; RBCS promoter (SEQ ID NO:4112); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [e.g., AT5G06690 (Thioredoxin) (high expression, SEQ ID NO: 4113), AT5G61520 (AtSTP3) (low expression, SEQ ID NO: 4114) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 4115 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 4106; U.S. Pat. No. 7,700, 835), early seed development *Arabidopsis* BAN (AT1G61720) (SEQ ID NO: 4116, US 2009/0031450 A1), late seed development *Arabidopsis* ABI3 (AT3G24650) (SEQ ID NO: 4117 (*Arabidopsis* ABI3 (AT3G24650) longer Promoter) or 4118 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (SEQ ID NO: 4087; Albanietal, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 4088 (Wheat LMW Longer Promoter), and SEQ ID NO: 4089 (Wheat LMW Promoter) and HMW glutenin-1 [(SEQ ID NO: 4090 (Wheat HMW glutenin-1 longer Promoter)); and SEQ ID NO: 4091 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 4092 (wheat alpha gliadin (B genome) promoter); SEQ ID NO: 4093 (wheat gamma gliadin promoter); EMBO 3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 4105 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice -globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma of al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217: 240-245; 1989), *Arabidopsis* apetala-3 (Tilly et al., Development. 125:1647-57, 1998), *Arabidopsis* APETALA 1 (AT1G69120, AP1) (SEQ ID NO: 4119 (*Arabidopsis* (AT1G69120) APETALA 1)) (Hempel et al., Development 124:3845-3853, 1997)], and root promoters [e.g., the ROOTP promoter [SEQ ID NO: 4120]; rice ExpB5 (SEQ ID NO:4103 (rice ExpB5 Promoter); or SEQ ID NO: 4102 (rice ExpB5 longer Promoter)) and barley ExpB1 promoters (SEQ ID NO:4104) (Won et al. Mol. Cells 30: 369-376, 2010); *arabidopsis* ATTPS-CIN (AT3G25820) promoter (SEQ ID NO: 4121; Chen et al., Plant Phys 135:1956-66, 2004); *arabidopsis* Pho1 promoter (SEQ ID NO: 4101, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase yield, growth rate, biomass, vigor, oil content, seed yield, fiber yield, fiber quality, nitrogen use efficiency, and/or abiotic stress of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 362-601, 2429-4085 and 4086, wherein the plant is derived from a plant selected for increased yield, increased growth rate, increased biomass, increased vigor, increased fiber yield, increased fiber quality, increased fertilizer use efficiency (e.g., nitrogen use efficiency), increased oil content, and/or increased abiotic stress tolerance as compared to a control plant, thereby producing the crop.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-361, 602-2427 and 2428 wherein the plant is derived from a plant selected for increased yield, increased growth rate, increased biomass, increased vigor, increased fiber yield, increased fiber quality, increased fertilizer use efficiency (e.g., nitrogen use efficiency), increased oil content, and/or increased abiotic stress tolerance as compared to a control plant, thereby producing the crop.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants selected for at least one trait selected from the group consisting of: increased yield, increased fiber yield or quality, increased oil content, increased biomass, increased growth rate, increased vigor, abiotic stress tolerance, and/or increased nitrogen use efficiency, as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, e.g., 100% identical to SEQ ID NO: 362-601, 2429-4085 or 4086, wherein the plant is derived from plants selected for at least one trait selected from the group consisting of increased yield, increased fiber yield or quality, increased biomass, increased oil content, increased growth rate, increased vigor, abiotic stress tolerance, and/or increased nitrogen use efficiency as compared to a non-transformed plant, thereby growing the crop.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1-361, 602-2427 or 2428, wherein the plant is derived from plants selected for at least one trait selected from the group consisting of increased yield, increased fiber yield or quality, increased biomass, increased growth rate, increased vigor, increased oil content, increased abiotic stress tolerance, and/or increased nitrogen use efficiency as compared to a non-transformed plant, thereby growing the crop.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \quad \text{Formula I}$$

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula II.

$$\text{Growth rate area=Regression coefficient of area along time course.} \quad \text{Formula II}$$

Thus, the growth rate area is in units of 1/day and length growth rate is in units of 1/day.

Seed yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000     Formula III

The Harvest Index can be calculated using Formula IV

Harvest Index=Average seed yield per plant/Average dry weight     Formula IV

Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol:// World Wide Web (dot) cottoninc (dot) com/Classification-ofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation analysis—was performed for selected genes according to some embodiments of the invention, in which the characterized parameters (measured parameters according to the correlation IDs) were used as "x axis" for correlation with the tissue transcriptome which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Identification of Genes and Predicted Role Using Bioinformatics Tools

The present inventors have identified polynucleotides which can increase plant yield, seed yield, oil yield, oil content, biomass, growth rate, fiber yield and/or quality, abiotic stress tolerance, nitrogen use efficiency and/or vigor of a plant, as follows.

The nucleotide sequence datasets used here were from publicly available databases or from sequences obtained using the Solexa technology (e.g. Barley and *Sorghum*). Sequence data from 100 different plant species was introduced into a single, comprehensive database. Other information on gene expression, protein annotation, enzymes and pathways were also incorporated. Major databases used include:

Genomes

*Arabidopsis* genome [TAIR genome version 8 (Hypertext Transfer Protocol://World Wide Web (dot) arabidopsis (dot) org/)];

Rice genome [build 6.0 (Hypertext Transfer Protocol://http://rice (dot) plantbiology(dot)msu(dot)edu/index(dot)shtml];

Poplar [*Populus trichocarpa* release 1.1 from JGI (assembly release v1.0) (Hypertext Transfer Protocol://World Wide Web (dot) genome (dot) jgi-psf (dot) org/)];

*Brachypodium* [JGI 4× assembly, Hypertext Transfer Protocol://World Wide Web (dot) brachypodium (dot) org)];

Soybean [DOE-JGI SCP, version Glyma1 (Hypertext Transfer Protocol://World Wide Web (dot) phytozome (dot) net/)];

Grape [French-Italian Public Consortium for Grapevine Genome Characterization grapevine genome (Hypertext Transfer Protocol://World Wide Web (dot) genoscope (dot) cns (dot) fr/)];

Castobean [TIGR/J Craig Venter Institute 4× assembly [(Hypertext Transfer Protocol://msc (dot) jcvi (dot) org/r communis];

*Sorghum* [DOE-JGI SCP, version Sbi1 [Hypertext Transfer Protocol://World Wide Web (dot) phytozome (dot) net/)];

Partially assembled genome of Maize [Hypertext Transfer Protocol://maizesequence (dot) org/];

Expressed EST and mRNA Sequences were Extracted from the Following Databases:

EST and RNA sequences from NCBI (Hypertext Transfer Protocol://World Wide Web (dot) ncbi (dot) nlm (dot) nih (dot) gov/dbEST/);

RefSeq (Hypertext Transfer Protocol://World Wide Web (dot) ncbi (dot) nlm (dot) nih (dot) gov/RefSeq/);

TAIR (Hypertext Transfer Protocol://World Wide Web (dot) arabidopsis (dot) org/);

Protein and Pathway Databases

Uniprot [Hypertext Transfer Protocol://World Wide Web (dot) uniprot (dot) org/].

AraCyc [Hypertext Transfer Protocol://World Wide Web (dot) arabidopsis (dot) org/biocyc/index (dot) jsp].

ENZYME [Hypertext Transfer Protocol://expasy (dot) org/enzyme/].

Microarray Datasets were Downloaded from:

GEO (Hypertext Transfer Protocol://World Wide Web.ncbi.nlm.nih.gov/geo/) TAIR (Hypertext Transfer Protocol://World Wide Web.arabidopsis.org/).

Proprietary microarray data (See WO2008/122980) and Examples 2-9 below.

QTL and SNPs Information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (*arabidopsis*, rice, castorbean, grape, *brachypodium*, poplar, soybean, *sorghum*) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling which combined microarray data and digital expression profile (see below). According to gene expression profile, a correlation analysis was performed to identify genes which are co-regulated under different developmental stages and environmental conditions and which are associated with different phenotypes.

Publicly available microarray datasets were downloaded from TAIR and NCBI GEO sites, renormalized, and integrated into the database. Expression profiling is one of the most important resource data for identifying genes important for yield, biomass, growth rate, vigor, oil content, abiotic stress tolerance of plants and nitrogen use efficiency.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (e.g., the developmental stages at which a gene can be found/expressed) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Example 2

Production of *Arabidopsis* Transcriptome and High Throughput Correlation Analysis of Yield, Biomass and/or Vigor Related Parameters Using 44K *Arabidopsis* Full Genome Oligonucleotide Micro-Array To produce a high throughput correlation analysis, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* tissues—Five tissues at different developmental stages including root, leaf, flower at anthesis, seed at 5 days after flowering (DAF) and seed at 12 DAF, representing different plant characteristics, were sampled and RNA was extracted as described hereinabove under "GENERAL EXPERIMENTAL AND BIOINFORMATICS METHODS". For convenience, each micro-array expression information tissue type has received a Set ID as summarized in Table 1 below.

TABLE 1

Tissues used for *Arabidopsis* transcriptome expression sets

| Expression Set | Set ID |
|---|---|
| Leaf | 1 |
| Root | 2 |
| Seed 5DAF | 3 |
| Flower at anthesis | 4 |
| Seed 12DAF | 5 |

Table 1: Provided are the identification (ID) digits of each of the *Arabidopsis* expression sets (1-5). DAF = days after flowering.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula V.

Growth rate of root coverage=Regression coefficient of root coverage along time course.   Formula V Vegetative growth rate analysis—was calculated according to Formula VI. The analysis was ended with the appearance of overlapping plants.

Vegetative growth rate area=Regression coefficient of vegetative area along time course.   Formula VI For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra-Oxford Instrument) and its MultiQuant sowftware package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula VII.

Seed Oil yield=Seed yield per plant (gr.)*Oil % in seed.   Formula VII

Harvest Index (seed)—The harvest index was calculated using Formula IV (described above): Harvest Index=Average seed yield per plant/Average dry weight.

Experimental Results

Nine different *Arabidopsis* ecotypes were grown and characterized for 18 parameters (named as vectors).

TABLE 2

*Arabidopsis* correlated parameters (vectors)

| Correlated parameter with | Correlation ID |
|---|---|
| Seeds per silique (number) | 1 |
| Harvest Index (value) | 2 |
| seed yield per plant (gr) | 3 |
| Dry matter per plant (gr) | 4 |
| Total Leaf Area per plant (cm$^2$) | 5 |
| Oil % per seed (percent) | 6 |
| Oil yield per plant (mg) | 7 |
| relative root growth (cm/day) | 8 |
| root length day 7 (cm) | 9 |
| root length day 13 (cm) | 10 |
| fresh weight (gr) | 11 |
| seed weight (gr) | 12 |
| Vegetative growth rate (cm$^2$/day) | 13 |
| Lamina length (cm) | 14 |
| Lamina width (cm) | 15 |
| Leaf width/length (ratio) | 16 |
| Blade circularity | 17 |
| Silique length (cm) | 18 |

Table 2: Provided are the *Arabidopsis* correlated parameters (correlation ID Nos. 1-18). Abbreviations: Cm = centimeter(s); gr = gram(s); mg = milligram(s).

The characterized values are summarized in Table 3 below.

TABLE 3

Measured parameters in *Arabidopsis* ecotypes

| Trait | Line-1 | Line-2 | Line-3 | Line-4 | Line-5 | Line-6 | Line-7 | Line-8 | Line-9 |
|---|---|---|---|---|---|---|---|---|---|
| 1 | 45.44 | 53.47 | 58.47 | 35.27 | 48.56 | 37.00 | 39.38 | 40.53 | 25.53 |
| 2 | 0.53 | 0.35 | 0.56 | 0.33 | 0.37 | 0.32 | 0.45 | 0.51 | 0.41 |
| 3 | 0.34 | 0.44 | 0.59 | 0.42 | 0.61 | 0.43 | 0.36 | 0.62 | 0.55 |
| 4 | 0.64 | 1.27 | 1.05 | 1.28 | 1.69 | 1.34 | 0.81 | 1.21 | 1.35 |
| 5 | 46.86 | 109.89 | 58.36 | 56.80 | 114.66 | 110.82 | 88.49 | 121.79 | 93.04 |
| 6 | 34.42 | 31.19 | 38.05 | 27.76 | 35.49 | 32.91 | 31.56 | 30.79 | 34.02 |
| 7 | 118.63 | 138.73 | 224.06 | 116.26 | 218.27 | 142.11 | 114.15 | 190.06 | 187.62 |
| 8 | 0.63 | 0.66 | 1.18 | 1.09 | 0.91 | 0.77 | 0.61 | 0.70 | 0.78 |
| 9 | 0.94 | 1.76 | 0.70 | 0.73 | 0.99 | 1.16 | 1.28 | 1.41 | 1.25 |
| 10 | 4.42 | 8.53 | 5.62 | 4.83 | 5.96 | 6.37 | 5.65 | 7.06 | 7.04 |
| 11 | 1.51 | 3.61 | 1.94 | 2.08 | 3.56 | 4.34 | 3.47 | 3.48 | 3.71 |
| 12 | 0.02 | 0.02 | 0.03 | 0.03 | 0.02 | 0.03 | 0.02 | 0.02 | 0.02 |
| 13 | 0.31 | 0.38 | 0.48 | 0.47 | 0.43 | 0.64 | 0.43 | 0.38 | 0.47 |
| 14 | 2.77 | 3.54 | 3.27 | 3.78 | 3.69 | 4.60 | 3.88 | 3.72 | 4.15 |
| 15 | 1.38 | 1.70 | 1.46 | 1.37 | 1.83 | 1.65 | 1.51 | 1.82 | 1.67 |
| 16 | 0.35 | 0.29 | 0.32 | 0.26 | 0.36 | 0.27 | 0.30 | 0.34 | 0.31 |
| 17 | 0.51 | 0.48 | 0.45 | 0.37 | 0.50 | 0.38 | 0.39 | 0.49 | 0.41 |
| 18 | 1.06 | 1.26 | 1.31 | 1.47 | 1.24 | 1.09 | 1.18 | 1.18 | 1.00 |

Table 3. Provided are the values of each of the parameters measured in *Arabidopsis* ecotypes:
3 = Seed yield per plant (gram); 7 = oil yield per plant (mg); 6 = oil % per seed; 12 = 1000 seed weight (gr); 4 = dry matter per plant (gr); 2 = harvest index; 5 = total leaf area per plant (cm); 1 = seeds per silique; 18 = Silique length (cm); 13 = Vegetative growth rate (cm$^2$/day) until 8 true leaves; 8 = relative root growth (cm/day) (day 13); 9 = Root length day 7 (cm); 10 = Root length day 13 (cm); 11 = fresh weight per plant (gr.) at bolting stage; 14 = Lamina length (cm); 15 = Lamina width (cm); 16 = Leaf width/length; 17 = Blade circularity.

TABLE 4

Correlation between the expression level of selected genes of some embodiments of the invention in various tissues and the phenotypic performance under normal conditions across *Arabidopsis* accessions

| Gene Name | R | P value | Set ID | Corr. Set ID | Gene Name | R | P value | Set ID | Corr. Set ID |
|---|---|---|---|---|---|---|---|---|---|
| LYD521 | 0.85 | 1.65E−02 | 2 | 3 | LYD521 | 0.81 | 2.73E−02 | 2 | 6 |
| LYD521 | 0.89 | 6.63E−03 | 2 | 7 | LYD521 | 0.84 | 1.88E−02 | 2 | 8 |
| LYD522 | 0.76 | 2.72E−02 | 5 | 5 | LYD522 | 0.75 | 3.22E−02 | 5 | 14 |
| LYD522 | 0.83 | 1.02E−02 | 5 | 11 | LYD522 | 0.71 | 5.02E−02 | 5 | 13 |
| LYD524 | 0.70 | 5.28E−02 | 3 | 3 | LYD525 | 0.84 | 8.98E−03 | 1 | 18 |
| LYD525 | 0.86 | 6.06E−03 | 5 | 2 | LYD526 | 0.72 | 4.42E−02 | 3 | 3 |
| LYD526 | 0.76 | 2.90E−02 | 3 | 8 | LYD526 | 0.71 | 5.06E−02 | 5 | 3 |
| LYD526 | 0.74 | 3.61E−02 | 5 | 7 | LYD526 | 0.75 | 3.09E−02 | 5 | 8 |
| LYD527 | 0.75 | 5.37E−02 | 2 | 16 | LYD527 | 0.73 | 3.81E−02 | 5 | 1 |
| LYD527 | 0.72 | 4.43E−02 | 5 | 8 | LYD528 | 0.70 | 7.84E−02 | 2 | 15 |
| LYD528 | 0.76 | 4.65E−02 | 2 | 5 | LYD529 | 0.80 | 1.69E−02 | 1 | 16 |
| LYD529 | 0.76 | 4.77E−02 | 2 | 2 | LYD529 | 0.77 | 2.48E−02 | 3 | 15 |
| LYD529 | 0.71 | 4.92E−02 | 3 | 5 | LYD529 | 0.78 | 2.21E−02 | 3 | 3 |
| LYD529 | 0.71 | 5.06E−02 | 5 | 2 | LYD529 | 0.74 | 3.74E−02 | 4 | 2 |
| LYD530 | 0.71 | 4.99E−02 | 1 | 10 | LYD530 | 0.72 | 6.54E−02 | 2 | 1 |
| LYD530 | 0.78 | 3.97E−02 | 2 | 18 | LYD530 | 0.84 | 1.92E−02 | 2 | 8 |
| LYD530 | 0.75 | 3.35E−02 | 3 | 1 | LYD530 | 0.73 | 3.78E−02 | 5 | 1 |
| LYD530 | 0.88 | 3.71E−03 | 4 | 1 | LYD531 | 0.70 | 7.71E−02 | 2 | 9 |
| LYD531 | 0.72 | 4.55E−02 | 5 | 6 | LYD531 | 0.70 | 5.19E−02 | 5 | 7 |
| LYD533 | 0.77 | 4.43E−02 | 2 | 17 | LYD533 | 0.73 | 4.13E−02 | 5 | 15 |
| LYD533 | 0.74 | 3.63E−02 | 4 | 1 | LYD533 | 0.80 | 1.66E−02 | 4 | 17 |
| LYD534 | 0.78 | 2.38E−02 | 1 | 10 | LYD534 | 0.87 | 1.01E−02 | 2 | 3 |
| LYD534 | 0.85 | 1.47E−02 | 2 | 7 | LYD534 | 0.70 | 7.86E−02 | 2 | 8 |
| LYD534 | 0.74 | 3.65E−02 | 3 | 15 | LYD534 | 0.77 | 2.53E−02 | 3 | 3 |
| LYD534 | 0.74 | 3.49E−02 | 3 | 7 | LYD534 | 0.74 | 3.65E−02 | 5 | 18 |
| LYD534 | 0.71 | 4.97E−02 | 5 | 8 | LYD535 | 0.82 | 1.33E−02 | 1 | 1 |
| LYD535 | 0.85 | 7.25E−03 | 3 | 8 | LYD535 | 0.89 | 3.39E−03 | 5 | 14 |
| LYD535 | 0.72 | 4.50E−02 | 5 | 13 | LYD536 | 0.74 | 3.58E−02 | 3 | 6 |
| LYD536 | 0.74 | 3.70E−02 | 5 | 8 | LYD536 | 0.85 | 7.90E−03 | 4 | 8 |

Table 4. Provided are the correlations (R) between the expression levels of yield improving genes and their homologues in tissues [leaf, flower, seed and root; Expression sets (Exp)] and the phenotypic performance in various yield, biomass, growth rate and/or vigor components [Correlation vector (corr.)] under stress conditions or normal conditions across *Arabidopsis* accessions.
P = p value.

Example 3

Production of *Arabidopsis* Transcriptome and High Throughput Correlation Analysis of Normal and Nitrogen Limiting Conditions Using 44K *Arabidopsis* Oligonucleotide Micro-Array In order to produce a high throughput correlation analysis, the present inventors utilized an *Arabidopsis* oligonucleotide micro-array, produced by Agilent Technologies [Hypertext Transfer Protocol://World Wide Web (dot) chem (dot) agilent (dot) com/Scripts/PDS (dot) asp?1Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Two tissues of plants [leaves and stems] growing at two different nitrogen fertilization levels (1.5 mM Nitrogen or 6 mM Nitrogen) were sampled and RNA was extracted as described hereinabove under "GENERAL EXPERIMENTAL AND BIOINFORMATICS METHODS". For convenience, each micro-array expression information tissue type has received a Set ID as summarized in Table 5 below.

TABLE 5

| Tissues used for *Arabidopsis* transcriptome expression sets | |
| --- | --- |
| Expression Set | Set ID |
| Leaves at 1.5 mM Nitrogen fertilization | 1 |
| Stems at 6 mM Nitrogen fertilization | 2 |
| Leaves at 6 mM Nitrogen fertilization | 3 |
| Stems at 1.5 mM Nitrogen fertilization | 4 |

Table 5: Provided are the identification (ID) digits of each of the *Arabidopsis* expression sets.

Assessment of *Arabidopsis* yield components and vigor related parameters under different nitrogen fertilization levels—10 *Arabidopsis* accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions (Normal Nitrogen conditions) was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/i/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Data parameters collected are summarized in Table 6, herein below.

TABLE 6

| *Arabidopsis* correlated parameters (vectors) | |
| --- | --- |
| Correlated parameter with | Correlation ID |
| N 6 mM; Seed Yield [gr./plant] | 1 |
| N 6 mM; Harvest Index | 2 |
| N 6 mM; 1000 Seeds weight [gr.] | 3 |
| N 6 mM; seed yield/rosette area day at day 10 [gr./cm$^2$] | 4 |
| N 6 mM; seed yield/leaf blade area [gr./cm$^2$] | 5 |
| N 1.5 mM; Rosette Area at day 8 [cm$^2$] | 6 |
| N 1.5 mM; Rosette Area at day 10 [cm$^2$] | 7 |
| N 1.5 mM; Leaf Number at day 10 | 8 |
| N 1.5 mM; Leaf Blade Area at day 10 [cm$^2$] | 9 |
| N 1.5 mM; RGR of Rosette Area at day 3 [cm$^2$/day] | 10 |
| N 1.5 mM; t50 Flowering [day] | 11 |
| N 1.5 mM; Dry Weight [gr./plant] | 12 |
| N 1.5 mM; Seed Yield [gr./plant] | 13 |
| N 1.5 mM; Harvest Index | 14 |
| N 1.5 mM; 1000 Seeds weight [gr.] | 15 |
| N 1.5 mM; seed yield/rosette area at day 10 [gr./cm$^2$] | 16 |
| N 1.5 mM; seed yield/leaf blade area [gr./cm$^2$] | 17 |
| N 1.5 mM; % Seed yield reduction compared to N 6 mM | 18 |
| N 1.5 mM; % Biomass reduction compared to N 6 mM | 19 |
| N 6 mM; Rosette Area at day 8 [cm$^2$] | 20 |
| N 6 mM; Rosette Area at day 10 [cm$^2$] | 21 |
| N 6 mM; Leaf Number at day 10 | 22 |
| N 6 mM; Leaf Blade Area at day 10 | 23 |
| N 6 mM; RGR of Rosette Area at day 3 [cm$^2$/gr.] | 24 |
| N 6 mM; t50 Flowering [day] | 25 |
| N 6 mM; Dry Weight [gr./plant] | 26 |
| N 6 mM; N level/DW (SPAD unit/gr. plant) | 27 |
| N 6 mM; DW/N level [gr./SPAD unit] | 28 |
| N 6 mM; N level/FW | 29 |
| N 6 mM; Seed yield/N unit [gr./SPAD unit] | 30 |
| N 1.5 mM; N level/FW [SPAD unit/gr.] | 31 |
| N 1.5 mM; N level/DW [SPAD unit/gr.] | 32 |
| N 1.5 mM; DW/N level [gr/SPAD unit] | 33 |
| N 1.5 mM; seed yield/N level [gr/SPAD unit] | 34 |

Table 6. Provided are the *Arabidopsis* correlated parameters (vectors).
"N" = Nitrogen at the noted concentrations;
"gr." = grams;
"SPAD" = chlorophyll levels;
"t50" = time where 50% of plants flowered;
"gr./SPAD unit" = plant biomass expressed in grams per unit of nitrogen in plant measured by SPAD.
"DW" = Plant Dry Weight;
"FW" = Plant Fresh weight;
"N level/DW" = plant Nitrogen level measured in SPAD unit per plant biomass [gr.];
"DW/N level" = plant biomass per plant [gr.]/SPAD unit; Rosette Area (measured using digital analysis);
Plot Coverage at the indicated day [%] (calculated by the dividing the total plant area with the total plot area);
Leaf Blade Area at the indicated day [cm$^2$] (measured using digital analysis);
RGR (relative growth rate) of Rosette Area at the indicated day [cm$^2$/day];
t50 Flowering [day [(the day in which 50% of plant flower);
seed yield/rosette area at day 10 [gr/cm$^2$] (calculated);
seed yield/leaf blade [gr/cm$^2$] (calculated);
seed yield/N level [gr/SPAD unit] (calculated).

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

The image processing system which was used is described in Example 4 above. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, plot coverage, Rosette diameter and Rosette area.

Relative growth rate area: The relative growth rate area of the rosette and the leaves was calculated according to Formulas VIII and IX, respectively.

Growth rate of rosette area=Regression coefficient of rosette area along time course.    Formula VIII Growth rate of plant leaf number=Regression coefficient of plant leaf number along time course.    Formula IX Seed yield and 1000 seeds weight—At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index (seed)—The harvest index was calculated using Formula IV as described above [Harvest Index=Average seed yield per plant/Average dry weight].

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of seed yield reduction—measures the amount of seeds obtained in plants when grown under nitrogen-limiting conditions compared to seed yield produced at normal nitrogen levels expressed in percentages (%).

Experimental Results 10 different *Arabidopsis* accessions (ecotypes) were grown and characterized for 37 parameters as described above. The average for each of the measured parameters was calculated using the JMP software (Table 7 below). Subsequent correlation analysis between the various transcriptome sets (Table 5) and the average parameters were conducted.

TABLE 7

Measured parameters in *Arabidopsis* accessions

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 0.12 | 0.17 | 0.11 | 0.08 | 0.12 | 0.14 | 0.11 | 0.14 | 0.09 | 0.07 |
| 2 | 0.28 | 0.31 | 0.28 | 0.16 | 0.21 | 0.28 | 0.17 | 0.21 | 0.17 | 0.14 |
| 3 | 0.01 | 0.02 | 0.02 | 0.01 | 0.02 | 0.02 | 0.01 | 0.02 | 0.02 | 0.02 |
| 4 | 0.08 | 0.11 | 0.04 | 0.03 | 0.06 | 0.06 | 0.06 | 0.05 | 0.06 | 0.03 |
| 5 | 0.34 | 0.53 | 0.21 | 0.18 | 0.28 | 0.28 | 0.25 | 0.27 | 0.24 | 0.16 |
| 6 | 0.76 | 0.71 | 1.06 | 1.16 | 1.00 | 0.91 | 0.94 | 1.12 | 0.64 | 1.00 |
| 7 | 1.43 | 1.33 | 1.77 | 1.97 | 1.83 | 1.82 | 1.64 | 2.00 | 1.15 | 1.75 |
| 8 | 6.88 | 7.31 | 7.31 | 7.88 | 7.75 | 7.63 | 7.19 | 8.63 | 5.93 | 7.94 |
| 9 | 0.33 | 0.27 | 0.37 | 0.39 | 0.37 | 0.39 | 0.35 | 0.38 | 0.31 | 0.37 |
| 10 | 0.63 | 0.79 | 0.50 | 0.49 | 0.72 | 0.83 | 0.65 | 0.67 | 0.64 | 0.61 |
| 11 | 15.97 | 20.97 | 14.84 | 24.71 | 23.70 | 18.06 | 19.49 | 23.57 | 21.89 | 23.57 |
| 12 | 0.16 | 0.12 | 0.08 | 0.11 | 0.12 | 0.13 | 0.11 | 0.15 | 0.17 | 0.18 |
| 13 | 0.03 | 0.03 | 0.02 | 0.01 | 0.01 | 0.03 | 0.02 | 0.01 | 0.01 | 0.01 |
| 14 | 0.19 | 0.20 | 0.29 | 0.08 | 0.07 | 0.24 | 0.18 | 0.08 | 0.08 | 0.03 |
| 15 | 0.02 | 0.02 | 0.02 | 0.01 | 0.02 | 0.01 | 0.01 | 0.02 | 0.02 | 0.02 |
| 16 | 0.02 | 0.02 | 0.01 | 0.01 | 0.00 | 0.02 | 0.01 | 0.01 | 0.01 | 0.00 |
| 17 | 0.09 | 0.09 | 0.06 | 0.03 | 0.02 | 0.08 | 0.06 | 0.03 | 0.04 | 0.01 |
| 18 | 72.56 | 84.70 | 78.78 | 88.00 | 92.62 | 76.71 | 81.94 | 91.30 | 85.76 | 91.82 |
| 19 | 60.75 | 76.71 | 78.56 | 78.14 | 78.64 | 73.19 | 83.07 | 77.19 | 70.12 | 62.97 |
| 20 | 0.76 | 0.86 | 1.48 | 1.28 | 1.10 | 1.24 | 1.09 | 1.41 | 1.09 | 1.22 |
| 21 | 1.41 | 1.57 | 2.67 | 2.42 | 2.14 | 2.47 | 1.97 | 2.72 | 1.64 | 2.21 |
| 22 | 6.25 | 7.31 | 8.06 | 8.75 | 8.75 | 8.38 | 7.13 | 9.44 | 6.31 | 8.06 |
| 23 | 0.34 | 0.31 | 0.52 | 0.45 | 0.43 | 0.50 | 0.43 | 0.51 | 0.41 | 0.43 |
| 24 | 0.69 | 1.02 | 0.61 | 0.60 | 0.65 | 0.68 | 0.58 | 0.61 | 0.52 | 0.48 |
| 25 | 16.37 | 20.50 | 14.63 | 24.00 | 23.60 | 15.03 | 19.75 | 22.89 | 18.80 | 23.38 |

TABLE 7-continued

Measured parameters in *Arabidopsis* accessions

| Ecotype/ Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 26 | 0.42 | 0.53 | 0.38 | 0.52 | 0.58 | 0.50 | 0.63 | 0.65 | 0.57 | 0.50 |
| 27 | 22.49 | | | 28.27 | | 33.32 | | | 39.00 | 17.64 |
| 28 | 0.02 | | | 0.02 | | 0.02 | | | 0.01 | 0.03 |
| 29 | 53.71 | | | 54.62 | | 66.48 | | | 68.05 | 35.55 |
| 30 | 0.00 | | | 0.00 | | 0.01 | | | 0.00 | 0.00 |
| 31 | 45.59 | | | 42.11 | | 53.11 | | | 67.00 | 28.15 |
| 32 | 167.30 | | | 241.06 | | 194.98 | | | 169.34 | 157.82 |
| 33 | 0.01 | | | 0.00 | | 0.01 | | | 0.01 | 0.01 |
| 34 | 0.00 | | | 0.00 | | 0.00 | | | 0.00 | 0.00 |

Table 7. Provided are the measured parameters under various treatments in various ecotypes (*Arabidopsis* accessions).

TABLE 8

Correlation between the expression level of selected genes of some embodiments of the invention in various tissues and the phenotypic performance under normal or abiotic stress conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|
| LYD522 | 0.72 | 2.88E−02 | 2 | 22 | LYD522 | 0.77 | 1.50E−02 | 2 | 21 |
| LYD522 | 0.74 | 2.24E−02 | 2 | 7 | LYD522 | 0.70 | 3.46E−02 | 2 | 23 |
| LYD522 | 0.77 | 8.54E−03 | 3 | 1 | LYD524 | 0.77 | 9.08E−03 | 1 | 2 |
| LYD524 | 0.74 | 2.21E−02 | 2 | 2 | LYD524 | 0.87 | 1.19E−03 | 4 | 2 |
| LYD524 | 0.85 | 2.01E−03 | 4 | 1 | LYD525 | 0.80 | 5.42E−03 | 1 | 22 |
| LYD525 | 0.73 | 1.60E−02 | 1 | 20 | LYD525 | 0.85 | 1.68E−03 | 1 | 6 |
| LYD525 | 0.75 | 1.28E−02 | 1 | 21 | LYD525 | 0.83 | 3.18E−03 | 1 | 7 |
| LYD525 | 0.70 | 3.49E−02 | 2 | 3 | LYD526 | 0.75 | 1.28E−02 | 1 | 20 |
| LYD526 | 0.73 | 1.70E−02 | 1 | 9 | LYD526 | 0.73 | 1.58E−02 | 1 | 23 |
| LYD527 | 0.71 | 2.24E−02 | 1 | 2 | LYD527 | 0.78 | 8.40E−03 | 1 | 14 |
| LYD527 | 0.72 | 1.87E−02 | 4 | 14 | LYD529 | 0.72 | 2.00E−02 | 3 | 19 |
| LYD531 | 0.72 | 1.84E−02 | 1 | 11 | LYD531 | 0.76 | 1.16E−02 | 1 | 25 |
| LYD531 | 0.86 | 1.51E−03 | 1 | 18 | LYD533 | 0.77 | 8.61E−03 | 1 | 11 |
| LYD533 | 0.88 | 8.25E−04 | 1 | 25 | LYD533 | 0.80 | 5.35E−03 | 1 | 18 |
| LYD535 | 0.72 | 1.93E−02 | 3 | 8 | LYD536 | 0.74 | 1.46E−02 | 1 | 2 |
| LYD536 | 0.73 | 1.75E−02 | 1 | 16 | LYD536 | 0.88 | 7.61E−04 | 1 | 4 |
| LYD536 | 0.76 | 1.04E−02 | 1 | 17 | LYD536 | 0.86 | 1.36E−03 | 1 | 5 |
| LYD536 | 0.82 | 4.02E−03 | 1 | 24 | | | | | |

Table 8. Provided are the correlations (R) between the expression levels of yield improving genes and their homologues in tissues [Leaves or stems; Expression sets (Exp)] and the phenotypic performance in various yield, biomass, growth rate and/or vigor components [Correlation vector (corr.)] under stress conditions or normal conditions across *Arabidopsis* accessions.
P = p value.

Example 4

Production of Tomato Transcriptome and High Throughput Correlation Analysis Using 44K Tomato Oligonucleotide Micro-Array In order to produce a high throughput correlation analysis between NUE related phenotypes and gene expression, the present inventors utilized a Tomato oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Tomato genes and transcripts. In order to define correlations between the levels of RNA expression with NUE, ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Tomato Varieties Across Ecotypes Grown Under Low Nitrogen, Drought and Regular Growth Conditions Experimental Procedures:

10 Tomato varieties were grown in 3 repetitive blocks, each containing 6 plants per plot were grown at net house. Briefly, the growing protocol was as follows:

1. Regular growth conditions: Tomato varieties were grown under normal conditions (4-6 Liters/m$^2$ of water per day and fertilized with NPK as recommended in protocols for commercial tomato production).

2. Low Nitrogen fertilization conditions: Tomato varieties were grown under normal conditions (4-6 Liters/m$^2$ per day and fertilized with NPK as recommended in protocols for commercial tomato production) until flower stage. At this time, Nitrogen fertilization was stopped.

3. Drought stress: Tomato variety was grown under normal conditions (4-6 Liters/m$^2$ per day) until flower stage. At this time, irrigation was reduced to 50% compared to normal conditions. Plants were phenotyped on a daily basis following the standard descriptor of tomato (Table 10). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Tables 11-13, herein below.

Analyzed Tomato tissues—Two tissues at different developmental stages [flower and leaf], representing different plant characteristics, were sampled and RNA was extracted as described above. For convenience, each micro-array expression information tissue type has received a Set ID as summarized in Table 9 below.

TABLE 9

Tomato transcriptome expression sets

| Expression Set | Set ID |
| --- | --- |
| Leaf at reproductive stage under Low N conditions | 1 + 10 |
| Flower under normal conditions | 5 + 2 |
| Leaf at reproductive stage under normal conditions | 8 + 3 |
| Flower under drought conditions | 9 + 7 |
| Leaf at reproductive stage under drought conditions | 11 + 4 |
| Flower under Low N conditions | 12 + 6 |

Table 9: Provided are the identification (ID) digits of each of the tomato expression sets.

Table 10 provides the tomato correlated parameters (Vectors). The average for each of the measured parameter was calculated using the JMP software and values are summarized in Tables 11-13 below. Subsequent correlation analysis was conducted. Results were integrated to the database.

TABLE 10

Tomato correlated parameters (vectors)

| Correlated parameter with | Correlation ID |
| --- | --- |
| NUE [yield (gr)/SPAD] (Normal) | 1 |
| NUpE [biomass (gr)/SPAD] (Normal) | 2 |
| HI [yield/yield + biomass] (Normal) (ratio) | 3 |
| NUE2 biomass (gr)/SPAD] (Normal) | 4 |
| Total Leaf Area [cm$^2$] (Normal) | 5 |
| Leaflet Length [cm] (Normal) | 6 |
| Leaflet Width (Normal) (cm) | 7 |
| 100 weight green fruit (Normal) (gr) | 8 |
| 100 weight red fruit (Normal) (gr) | 9 |
| SLA [leaf area/plant biomass] (Normal) (cm$^2$/gr) | 10 |
| Yield/total leaf area (Normal) (gr/cm$^2$) | 11 |
| Yield/SLA (Normal) gr$^2$/cm$^2$ | 12 |
| Fruit Yield/Plant (Low N) (gr) | 13 |
| FW/Plant (Low N) (gr) | 14 |
| Average red fruit weight (Low N) (gr) | 15 |
| Fruit yield (Low N)/Fruit yield (Normal) (ratio) | 16 |
| FW (Low N)/FW (Normal) (ratio) | 17 |
| SPAD (Low N) (number) | 18 |
| RWC (Low N) (percentage) | 19 |
| SPAD 100% RWC (NUE) (number) | 20 |
| SPAD (Low N)/SPAD (Normal) (ratio) | 21 |
| SPAD 100% RWC (Low N)/SPAD 100% RWC (Normal) (ratio) | 22 |
| RWC (Low N)/RWC (Normal) (ratio) | 23 |
| Number of flowers ((Low N) (number) | 24 |
| Weight clusters (flowers) (Low N) (gr) | 25 |
| Number of Flowers (Low N)/Number of Flowers (Normal) (ratio) | 26 |
| Cluster Weight (Low N)/Cluster Weight (Normal) (ratio) | 27 |

TABLE 10-continued

Tomato correlated parameters (vectors)

| Correlated parameter with | Correlation ID |
| --- | --- |
| RWC Drought (percentage) | 28 |
| RWC Drought/RWC Normal (ratio) | 29 |
| Number of flowers (Drought) (number) | 30 |
| Weight flower clusters (Drought) (gr) | 31 |
| Number of Flower Drought/Normal (number) | 32 |
| Number of Flower Drought/Number of Flower Drought (Low N)(ratio) | 33 |
| flower cluster weight (Drought)/flower cluster weight (Normal)(ratio) | 34 |
| flower cluster weight Drought/flower cluster weight (Low N)(ratio) | 35 |
| Fruit Yield/Plant (Drought) (gr) | 36 |
| FW/Plant (Drought) (gr) | 37 |
| Average red fruit weight Drought (gr) | 38 |
| Fruit Yield (Drought)/Fruit Yield (Normal) (ratio) | 39 |
| Fruit (Drought)/Fruit (Low N) (ratio) | 40 |
| FW (drought)/FW Normal (ratio) | 41 |
| red fruit weight (Drought)/red fruit weight (Normal) (ratio) | 42 |
| Fruit yield/Plant (Normal) (gr) | 43 |
| FW/Plant (Normal) (gr) | 44 |
| average red fruit weight (Normal) (gr) | 45 |
| SPAD (Normal) (number) | 46 |
| RWC (Normal) (percentage) | 47 |
| SPAD 100% RWC (Normal) (number) | 48 |
| Number of flowers (Normal) (number) | 49 |
| Weight Flower clusters (Normal) (gr) | 50 |
| Total Leaf Area [cm$^2$]) (Drought) | 51 |
| Leaflet Length [cm]) (Drought) | 52 |
| Leaflet Width [cm] (Drought) | 53 |
| 100 weight green fruit (Drought) (gr) | 54 |
| 100 weight red fruit (Drought) (gr) | 55 |
| NUE [yield (gr)/SPAD] (Low N) | 56 |
| NUpE [biomass (gr)/SPAD] (Low N) | 57 |
| HI [yield/yield + biomass] (Low N) (ratio) | 58 |
| NUE2 [total biomass (gr)/SPAD] (Low N) | 59 |
| Total Leaf Area [cm$^2$] (Low N) | 60 |
| Leaflet Length [cm] (Low N) | 61 |
| Leaflet Width (Low N) (cm) | 62 |
| 100 weight green fruit (Low N) (gr) | 63 |
| SLA [leaf area/plant biomass] (Low N) (cm$^2$/gr) | 64 |
| Yield/total leaf area (Low N) (gr/cm$^2$) | 65 |
| Yield/SLA (Low N) (gr$^2$/cm$^2$) | 66 |
| 100 weight red fruit (Low N) (gr) | 67 |

Table 10. Provided are the tomato correlated parameters.
"gr." = grams;
"FW" = fresh weight;
"NUE" = nitrogen use efficiency;
"RWC" = relative water content;
"NUpE" = nitrogen uptake efficiency;
"SPAD" = chlorophyll levels (number);
"HI" = harvest index (vegetative weight divided on yield);
"SLA" = specific leaf area (leaf area divided by leaf dry weight), Treatment in the parenthesis.

Fruit Weight (grams)—At the end of the experiment [when 50% of the fruits were ripe (red)] all fruits from plots within blocks A-C were collected. The total fruits were counted and weighted. The average fruits weight was calculated by dividing the total fruit weight by the number of fruits.

Plant vegetative Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two Inflorescence from plots within blocks A-C were collected. The Inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content.

Experimental Results

TABLE 11

Measured parameters in Tomato accessions (lines 1-6)

| Ecotype/Treatment | Line-1 | Line-2 | Line-3 | Line-4 | Line-5 | Line-6 |
|---|---|---|---|---|---|---|
| 1 | 0.02 | 0.01 | 0.01 | 0.00 | 0.01 | 0.01 |
| 2 | 0.03 | 0.09 | 0.05 | 0.02 | 0.05 | 0.05 |
| 3 | 0.35 | 0.10 | 0.14 | 0.12 | 0.18 | 0.19 |
| 4 | 0.05 | 0.09 | 0.06 | 0.02 | 0.06 | 0.06 |
| 5 |  |  | 426.10 | 582.38 | 291.40 | 593.58 |
| 6 |  |  | 6.34 | 7.99 | 5.59 | 7.70 |
| 7 |  |  | 3.69 | 4.77 | 3.43 | 4.56 |
| 8 |  |  | 0.56 | 3.05 | 0.24 | 2.58 |
| 9 |  |  | 0.82 | 2.46 | 0.83 | 2.76 |
| 10 |  |  | 140.99 | 689.67 | 130.22 | 299.12 |
| 11 |  |  | 0.00 | 0.00 | 0.00 | 0.00 |
| 12 |  |  | 0.00 | 0.00 | 0.00 | 0.00 |
| 13 | 0.41 | 0.66 | 0.48 | 0.46 | 1.35 | 0.35 |
| 14 | 4.04 | 1.21 | 2.25 | 2.54 | 1.85 | 3.06 |
| 15 | 0.02 | 0.19 | 0.01 | 0.01 | 0.10 | 0.00 |
| 16 | 0.49 | 1.93 | 0.97 | 3.80 | 2.78 | 0.78 |
| 17 | 2.65 | 0.38 | 3.01 | 0.83 | 1.54 |  |
| 18 | 38.40 | 39.40 | 47.50 | 37.00 | 44.60 | 41.70 |
| 19 | 74.07 | 99.08 | 69.49 | 63.24 | 77.36 | 77.91 |
| 20 | 28.47 | 39.04 | 33.01 | 23.42 | 34.53 | 32.51 |
| 21 | 0.77 | 1.06 | 0.85 | 0.80 | 0.93 | 0.96 |
| 22 | 0.79 | 1.37 | 0.92 | 0.75 | 1.31 | 0.97 |
| 23 | 1.02 | 1.30 | 1.08 | 0.94 | 1.41 | 1.00 |
| 24 | 19.00 | 5.33 | 9.00 | 13.00 | 10.67 | 16.67 |
| 25 | 0.53 | 0.37 | 0.31 | 0.35 | 0.47 | 0.25 |
| 26 | 3.35 | 0.28 | 1.42 | 1.70 | 1.10 | 2.00 |
| 27 | 0.46 | 1.07 | 0.44 | 0.01 | 1.08 | 0.02 |
| 28 | 72.12 | 74.51 | 65.33 | 72.22 | 66.13 | 68.33 |
| 29 | 0.99 | 0.97 | 1.02 | 1.08 | 1.21 | 0.88 |
| 30 | 16.67 | 6.50 | 15.67 | 20.33 | 11.67 | 25.33 |
| 31 | 0.37 | 0.41 | 0.33 | 0.29 | 0.55 | 0.31 |
| 32 | 2.94 | 0.34 | 2.47 | 2.65 | 1.21 | 3.04 |
| 33 | 0.88 | 1.22 | 1.74 | 1.56 | 1.09 | 1.52 |
| 34 | 0.32 | 1.19 | 0.47 | 0.01 | 1.25 | 0.03 |
| 35 | 0.69 | 1.11 | 1.06 | 0.82 | 1.16 | 1.25 |
| 36 | 0.47 | 0.48 | 0.63 | 0.35 | 2.04 | 0.25 |
| 37 | 2.62 | 1.09 | 1.85 | 2.22 | 2.63 | 2.71 |
| 38 | 0.01 | 0.19 | 0.21 | 0.00 | 0.10 | 0.00 |
| 39 | 0.57 | 1.41 | 1.27 | 2.88 | 4.20 | 0.55 |
| 40 | 1.15 | 0.73 | 1.32 | 0.76 | 1.51 | 0.71 |
| 41 | 1.72 | 0.34 | 0.61 | 2.63 | 1.18 | 1.36 |
| 42 | 0.19 | 24.37 | 25.38 | 0.02 | 20.26 | 0.04 |
| 43 | 0.83 | 0.34 | 0.49 | 0.12 | 0.49 | 0.45 |
| 44 | 1.53 | 3.17 | 3.02 | 0.84 | 2.24 | 1.98 |
| 45 | 0.05 | 0.01 | 0.01 | 0.29 | 0.01 | 0.05 |
| 46 | 49.70 | 37.20 | 55.80 | 46.40 | 48.20 | 43.40 |
| 47 | 72.83 | 76.47 | 64.29 | 67.07 | 54.79 | 77.61 |
| 48 | 36.17 | 28.45 | 35.89 | 31.09 | 26.38 | 33.68 |
| 49 | 5.67 | 19.33 | 6.33 | 7.67 | 9.67 | 8.33 |
| 50 | 1.17 | 0.34 | 0.69 | 56.35 | 0.44 | 11.31 |
| 51 | ND | ND | ND | ND | ND | ND |
| 52 | ND | ND | ND | ND | ND | ND |
| 53 | ND | ND | ND | ND | ND | ND |
| 54 | ND | ND | ND | ND | ND | ND |
| 55 | ND | ND | ND | ND | ND | ND |
| 56 | 0.01 | 0.02 | 0.01 | 0.02 | 0.04 | 0.01 |
| 57 | 0.14 | 0.03 | 0.07 | 0.11 | 0.05 | 0.09 |
| 58 | 0.09 | 0.35 | 0.18 | 0.15 | 0.42 | 0.10 |
| 59 | 0.16 | 0.05 | 0.08 | 0.13 | 0.09 | 0.11 |
| 60 | 565.93 | 384.77 | 294.83 | 378.00 | 476.39 | 197.08 |
| 61 | 6.40 | 5.92 | 3.69 | 5.43 | 6.95 | 3.73 |
| 62 | 3.47 | 1.97 | 1.79 | 2.55 | 3.52 | 1.73 |
| 63 | 0.87 | 3.66 | 0.57 | 0.37 | 3.40 | 0.68 |
| 64 | 140.04 | 317.12 | 131.29 | 148.82 | 257.51 | 64.34 |
| 65 | 0.00 | 0.00 | 0.00 | 0.00 | 0.00 | 0.00 |
| 66 | 0.00 | 0.00 | 0.00 | 0.00 | 0.01 | 0.01 |
| 67 | 1.06 | 6.87 | 0.65 | 0.53 | 7.17 | 0.44 |

Table 11. Provided are the values of each of the parameters (as described above) measured in tomato accessions (Seed ID) under all growth conditions. Growth conditions are specified in the experimental procedure section.

TABLE 12

Measured parameters in Tomato accessions (lines 7-12)

| Ecotype/Treatment | Line-7 | Line-8 | Line-9 | Line-10 | Line-11 | Line-12 |
|---|---|---|---|---|---|---|
| 1 | 0.01 | 0.01 | 0.00 | 0.01 | 0.02 | 0.00 |
| 2 | 0.02 | 0.04 | 0.05 | 0.05 | 0.05 | 0.08 |
| 3 | 0.38 | 0.17 | 0.06 | 0.10 | 0.27 | 0.05 |
| 4 | 0.03 | 0.05 | 0.06 | 0.06 | 0.06 | 0.08 |
| 5 | 947.59 | 233.35 | 340.73 | 339.11 | 190.14 | 421.79 |
| 6 | 7.85 | 6.22 | 6.16 | 5.65 | 4.39 | 4.44 |
| 7 | 4.44 | 3.15 | 3.37 | 3.13 | 2.40 | 2.02 |
| 8 | 6.32 | 5.75 | 0.38 | 0.30 | 1.95 | 2.53 |
| 9 | 5.32 | 5.24 | 0.61 | 0.66 | 2.70 | 0.70 |
| 10 | 1117.74 | 111.77 | 106.29 | 123.14 | 104.99 | 111.88 |
| 11 | 0.00 | 0.00 | 0.00 | 0.00 | 0.00 | 0.00 |
| 12 | 0.00 | 0.00 | 0.00 | 0.00 | 0.01 | 0.00 |
| 13 | 0.01 | 0.51 | 0.44 | 0.47 | 1.59 | 0.39 |
| 14 | 3.13 | 2.54 | 1.84 | 1.52 | 1.91 | 1.86 |
| 15 | 0.01 | 0.01 | 0.01 | 0.01 | 0.02 | 0.01 |
| 16 | 0.02 | 1.16 | 2.07 | 1.51 | 2.41 | 2.06 |
| 17 | 3.70 | 1.22 | 0.58 | 0.55 | 1.06 | 0.49 |
| 18 | 34.40 | 50.00 | 44.70 | 53.70 | 35.70 | 58.80 |
| 19 | 80.49 | 67.40 | 67.16 | 66.07 | 69.57 | 69.30 |
| 20 | 27.66 | 33.68 | 30.04 | 35.50 | 24.81 | 40.77 |
| 21 | 0.80 | 0.94 | 0.76 | 1.05 | 0.89 | 1.24 |
| 22 | 1.11 | 0.95 | 0.79 | 0.92 | 0.94 | 1.36 |
| 23 | 1.38 | 1.01 | 1.04 | 0.88 | 1.05 | 1.10 |
| 24 | 6.00 | 16.00 | 15.00 | 6.00 | 17.00 | 13.00 |
| 25 | 0.29 | 0.47 | 0.40 | 0.30 | 0.82 | 0.40 |
| 26 | 1.20 | 1.92 | 1.50 | 0.86 | 1.89 | 1.63 |
| 27 | 0.37 | 0.81 | 0.55 | 0.36 | 0.95 | 0.80 |
| 28 | 78.13 | 18.46 | 73.21 | 62.50 | 67.21 | 75.76 |
| 29 | 1.34 | 0.28 | 1.13 | 0.83 | 1.01 | 1.20 |
| 30 | 29.73 | 17.33 | 14.67 | 29.67 | 15.00 | 10.33 |
| 31 | 0.45 | 0.56 | 0.30 | 0.31 | 0.31 | 0.31 |
| 32 | 5.95 | 2.08 | 1.47 | 4.24 | 1.67 | 1.29 |
| 33 | 4.96 | 1.08 | 0.98 | 4.94 | 0.88 | 0.79 |
| 34 | 0.56 | 0.96 | 0.42 | 0.38 | 0.36 | 0.62 |
| 35 | 1.52 | 1.19 | 0.76 | 1.04 | 0.38 | 0.78 |
| 36 | 0.05 | 0.45 | 0.29 | 1.02 | 0.60 | 0.49 |
| 37 | 3.41 | 2.11 | 1.95 | 1.76 | 1.72 | 1.92 |
| 38 | 0.03 | 0.01 | 0.01 | 0.00 | 0.01 | 0.01 |
| 39 | 0.09 | 1.03 | 1.39 | 3.28 | 0.91 | 2.62 |
| 40 | 5.06 | 0.89 | 0.67 | 2.17 | 0.38 | 1.27 |
| 41 | 4.02 | 1.01 | 0.61 | 0.64 | 0.95 | 0.51 |
| 42 | 0.15 | 0.02 | 0.86 | 0.74 | 0.09 | 1.72 |
| 43 | 0.53 | 0.44 | 0.21 | 0.31 | 0.66 | 0.19 |
| 44 | 0.85 | 2.09 | 3.21 | 2.75 | 1.81 | 3.77 |
| 45 | 0.23 | 0.29 | 0.01 | 0.01 | 0.06 | 0.01 |
| 46 | 42.90 | 53.30 | 58.50 | 51.10 | 40.00 | 47.60 |

TABLE 12-continued

Measured parameters in Tomato accessions (lines 7-12)

| Ecotype/Treatment | Line-7 | Line-8 | Line-9 | Line-10 | Line-11 | Line-12 |
|---|---|---|---|---|---|---|
| 47 | 58.18 | 66.51 | 64.71 | 75.25 | 66.23 | 63.21 |
| 48 | 24.98 | 35.47 | 37.87 | 38.43 | 26.49 | 30.07 |
| 49 | 5.00 | 8.33 | 10.00 | 7.00 | 9.00 | 8.00 |
| 50 | 0.79 | 0.58 | 0.73 | 0.83 | 0.86 | 0.50 |
| 51 | ND | ND | ND | ND | ND | 337.63 |
| 52 | ND | ND | ND | ND | ND | 5.15 |
| 53 | ND | ND | ND | ND | ND | 2.55 |
| 54 | ND | ND | ND | ND | ND | 0.80 |
| 55 | ND | ND | ND | ND | ND | 0.89 |
| 56 | 0.00 | 0.02 | 0.01 | 0.01 | 0.06 | 0.01 |
| 57 | 0.11 | 0.08 | 0.06 | 0.04 | 0.08 | 0.05 |
| 58 | 0.00 | 0.17 | 0.19 | 0.24 | 0.45 | 0.17 |
| 59 | 0.11 | 0.09 | 0.08 | 0.06 | 0.14 | 0.06 |
| 60 | 453.24 | 625.51 | 748.01 | 453.96 | 164.85 | 338.30 |
| 61 | 4.39 | 6.72 | 6.66 | 4.39 | 3.90 | 5.29 |
| 62 | 1.87 | 3.54 | 3.28 | 2.52 | 2.61 | 2.61 |
| 63 | 0.45 | 0.47 | 0.54 | 0.39 | 0.97 | 0.91 |
| 64 | 144.60 | 246.05 | 405.55 | 299.32 | 86.19 | 182.32 |
| 65 | 0.00 | 0.00 | 0.00 | 0.00 | 0.01 | 0.00 |
| 66 | 0.00 | 0.00 | 0.00 | 0.00 | 0.02 | 0.00 |
| 67 |  | 0.55 | 0.75 | 0.58 | 1.27 | 1.34 |

Table 12. Provided are the values of each of the parameters (as described above) measured in tomato accessions (Seed ID) under all growth conditions. Growth conditions are specified in the experimental procedure section.

TABLE 13

Measured parameters in Tomato accessions (lines 13-18)

| Ecotype/Treatment | Line-13 | Line-14 | Line-15 | Line-16 | Line-17 | Line-18 |
|---|---|---|---|---|---|---|
| 1 | 0.01 | 0.01 | 0.01 | 0.01 | 0.01 | 0.00 |
| 2 | 0.03 | 0.04 | 0.05 | 0.03 | 0.07 | 0.04 |
| 3 | 0.31 | 0.12 | 0.14 | 0.17 | 0.09 | 0.11 |
| 4 | 0.05 | 0.05 | 0.06 | 0.04 | 0.08 | 0.04 |
| 5 | 581.33 | 807.51 | 784.06 | 351.80 | 255.78 | 1078.10 |
| 6 | 6.77 | 7.42 | 6.71 | 5.87 | 4.16 | 10.29 |
| 7 | 3.80 | 3.74 | 2.98 | 3.22 | 2.09 | 5.91 |
| 8 | 1.42 | 2.03 | 1.39 | 2.27 | 0.45 | 0.42 |
| 9 | 2.64 | 4.67 | 2.17 | 0.49 | 0.34 | 0.75 |
| 10 | 307.95 | 419.37 | 365.81 | 212.93 | 84.94 | 469.87 |
| 11 | 0.00 | 0.00 | 0.00 | 0.00 | 0.00 | 0.00 |
| 12 | 0.00 | 0.00 | 0.00 | 0.00 | 0.00 | 0.00 |
| 13 | 0.32 | 0.45 | 0.14 | 0.40 | 1.44 | 0.50 |
| 14 | 2.47 | 2.62 | 1.08 | 1.17 | 0.92 | 1.09 |
| 15 | 0.01 | 0.05 | 0.36 | 0.04 | 0.63 |  |
| 16 | 0.38 | 1.64 | 0.41 | 1.21 | 4.59 | 1.70 |
| 17 | 1.31 | 1.36 | 0.51 | 0.71 | 0.31 | 0.47 |
| 18 | 47.50 | 45.20 | 39.00 | 45.00 | 65.30 | 51.90 |
| 19 | 100.00 | 57.66 | 90.79 | 68.00 | 59.65 | 72.17 |
| 20 | 47.47 | 26.06 | 35.38 | 30.60 | 38.97 | 37.46 |
| 21 | 0.82 | 0.94 | 0.89 | 0.83 | 1.57 | 0.88 |
| 22 | 1.44 | 1.50 | 1.05 | 0.56 | 1.48 | 0.84 |
| 23 | 1.76 | 1.60 | 1.17 | 0.68 | 0.94 | 0.96 |
| 24 | 8.67 | 9.33 | 12.67 | 6.67 | 9.33 | 8.00 |
| 25 | 0.35 | 0.43 | 0.35 | 0.45 | 0.28 | 0.47 |
| 26 | 1.63 | 1.17 | 1.65 | 0.74 | 0.88 | 0.89 |
| 27 | 0.34 | 0.61 | 0.94 | 0.68 | 0.40 | 1.44 |
| 28 | 62.82 | 70.69 | 55.75 | 75.22 | 63.68 | 62.31 |
| 29 | 1.11 | 1.97 | 0.72 | 0.75 | 1.01 | 0.83 |
| 30 | 18.33 | 12.00 | 20.33 | 12.67 | 12.67 | 11.33 |
| 31 | 8.36 | 0.29 | 0.34 | 0.44 | 0.27 | 0.43 |
| 32 | 3.44 | 1.50 | 2.65 | 1.41 | 1.19 | 1.26 |
| 33 | 2.12 | 1.29 | 1.61 | 1.90 | 1.36 | 1.42 |
| 34 | 8.20 | 0.41 | 0.91 | 0.67 | 0.38 | 1.31 |
| 35 | 24.12 | 0.67 | 0.97 | 0.99 | 0.95 | 0.91 |
| 36 | 0.27 | 0.68 | 0.14 | 0.53 | 0.55 | 0.41 |
| 37 | 2.21 | 3.73 | 0.75 | 1.76 | 0.63 | 1.11 |
| 38 | 0.00 | 0.01 | 0.30 | 0.14 | 0.04 | 0.09 |
| 39 | 0.32 | 2.48 | 0.41 | 1.62 | 1.76 | 1.42 |
| 40 | 0.84 | 1.51 | 0.98 | 1.34 | 0.38 | 0.84 |
| 41 | 1.17 | 1.94 | 0.35 | 1.06 | 0.21 | 0.48 |
| 42 | 0.17 | 0.02 | 10.50 | 27.89 | 11.79 | 9.98 |
| 43 | 0.85 | 0.27 | 0.35 | 0.33 | 0.31 | 0.29 |
| 44 | 1.89 | 1.93 | 2.14 | 1.65 | 3.01 | 2.29 |
| 45 | 0.03 | 0.26 | 0.03 | 0.00 | 0.00 | 0.01 |
| 46 | 57.90 | 48.30 | 43.60 | 54.50 | 41.60 | 59.10 |
| 47 | 56.77 | 35.96 | 77.62 | 100.00 | 63.16 | 75.13 |
| 48 | 32.89 | 17.35 | 33.82 | 54.47 | 26.25 | 44.43 |
| 49 | 5.33 | 8.00 | 7.67 | 9.00 | 10.67 | 9.00 |
| 50 | 1.02 | 0.70 | 0.38 | 0.66 | 0.70 | 0.33 |
| 51 | 130.78 | 557.93 | 176.67 | 791.86 | 517.05 | 832.27 |
| 52 | 3.38 | 7.14 | 5.48 | 8.62 | 6.35 | 6.77 |
| 53 | 2.04 | 4.17 | 3.09 | 4.69 | 3.87 | 2.91 |
| 54 | 0.28 | 0.38 | 0.63 | 2.86 | 1.16 | 4.40 |
| 55 | 0.35 | 0.63 | 2.27 | 7.40 | 2.94 | 11.60 |
| 56 | 0.01 | 0.02 | 0.00 | 0.01 | 0.04 | 0.01 |
| 57 | 0.05 | 0.10 | 0.03 | 0.04 | 0.02 | 0.03 |
| 58 | 0.12 | 0.15 | 0.12 | 0.25 | 0.61 | 0.31 |
| 59 | 0.06 | 0.12 | 0.03 | 0.05 | 0.06 | 0.04 |
| 60 | 396.00 | 236.15 | 174.58 | 441.78 | 489.18 | 707.80 |
| 61 | 6.32 | 5.11 | 4.72 | 6.83 | 7.10 | 8.21 |
| 62 | 3.58 | 2.56 | 2.48 | 3.43 | 3.30 | 3.69 |
| 63 | 0.36 | 0.35 | 0.57 | 4.38 | 2.02 | 8.13 |
| 64 | 160.18 | 90.10 | 160.99 | 379.03 | 531.08 | 650.68 |
| 65 | 0.00 | 0.00 | 0.00 | 0.00 | 0.00 | 0.00 |
| 66 | 0.00 | 0.00 | 0.00 | 0.00 | 0.00 | 0.00 |
| 67 | 0.52 | 0.57 | 0.94 | 6.17 | 3.67 | 11.33 |

Table 13: Provided are the values of each of the parameters (as described above) measured in tomato accessions (Seed ID) under all growth conditions. Growth conditions are specified in the experimental procedure section.

TABLE 14

Correlation between the expression level of selected genes of some embodiments of the invention in various tissues and the phenotypic performance under normal and stress conditions across tomato ecotypes

| Gene Name | R | P value | Exp. set | Corr. Set ID | Gene Name | R | P value | Exp. set | Corr. Set ID |
|---|---|---|---|---|---|---|---|---|---|
| LYD648 | 0.71 | 2.04E−02 | 1 | 20 | LYD648 | 0.73 | 2.70E−02 | 2 | 1 |
| LYD650 | 0.72 | 1.95E−02 | 5 | 45 | LYD650 | 0.72 | 1.78E−02 | 9 | 37 |
| LYD650 | 0.88 | 8.80E−04 | 9 | 41 | LYD650 | 0.79 | 6.43E−03 | 11 | 41 |
| LYD651 | 0.72 | 4.60E−02 | 2 | 10 | LYD651 | 0.80 | 1.69E−02 | 2 | 5 |
| LYD651 | 0.83 | 2.96E−03 | 8 | 43 | LYD651 | 0.79 | 6.11E−03 | 11 | 35 |
| LYD651 | 0.79 | 6.98E−03 | 11 | 31 | LYD652 | 0.71 | 2.14E−02 | 1 | 27 |
| LYD652 | 0.80 | 5.86E−03 | 10 | 61 | LYD652 | 0.77 | 8.52E−03 | 10 | 64 |
| LYD652 | 0.83 | 3.29E−03 | 10 | 63 | LYD652 | 0.75 | 1.21E−02 | 10 | 67 |
| LYD653 | 0.71 | 3.11E−02 | 2 | 2 | LYD653 | 0.72 | 2.80E−02 | 3 | 2 |
| LYD653 | 0.74 | 2.35E−02 | 3 | 4 | LYD654 | 0.72 | 2.74E−02 | 3 | 2 |
| LYD654 | 0.75 | 1.89E−02 | 3 | 4 | LYD655 | 0.83 | 1.07E−02 | 2 | 9 |

TABLE 14-continued

Correlation between the expression level of selected genes of some embodiments of the invention in various tissues and the phenotypic performance under normal and stress conditions across tomato ecotypes

| Gene Name | R | P value | Exp. set | Corr. Set ID | Gene Name | R | P value | Exp. set | Corr. Set ID |
|---|---|---|---|---|---|---|---|---|---|
| LYD655 | 0.72 | 1.85E−02 | 12 | 19 | LYD657 | 0.78 | 2.25E−02 | 2 | 12 |
| LYD657 | 0.76 | 2.92E−02 | 2 | 11 | LYD657 | 0.77 | 8.89E−03 | 5 | 47 |
| LYD657 | 0.90 | 3.73E−04 | 5 | 48 | LYD657 | 0.76 | 1.10E−02 | 11 | 30 |
| LYD657 | 0.77 | 9.90E−03 | 11 | 32 | LYD658 | 0.79 | 1.94E−02 | 2 | 8 |
| LYD658 | 0.73 | 1.62E−02 | 6 | 58 | LYD658 | 0.75 | 1.27E−02 | 11 | 39 |
| LYD658 | 0.82 | 3.75E−03 | 11 | 36 | LYD659 | 0.85 | 1.72E−03 | 1 | 21 |
| LYD659 | 0.80 | 8.96E−03 | 1 | 15 | LYD659 | 0.88 | 4.08E−03 | 2 | 6 |
| LYD659 | 0.89 | 3.26E−03 | 2 | 10 | LYD659 | 0.95 | 2.50E−04 | 2 | 5 |
| LYD659 | 0.85 | 7.44E−03 | 2 | 7 | LYD659 | 0.75 | 1.18E−02 | 8 | 50 |
| LYD659 | 0.77 | 9.47E−03 | 10 | 65 | LYD659 | 0.73 | 1.67E−02 | 12 | 20 |
| LYD659 | 0.73 | 1.63E−02 | 12 | 19 | LYD660 | 0.81 | 8.70E−03 | 2 | 3 |
| LYD660 | 0.74 | 2.21E−02 | 2 | 1 | LYD660 | 0.80 | 5.64E−03 | 11 | 33 |
| LYD660 | 0.72 | 2.01E−02 | 11 | 40 | LYD662 | 0.93 | 9.15E−05 | 6 | 59 |
| LYD662 | 0.86 | 1.49E−03 | 6 | 57 | LYD662 | 0.74 | 1.45E−02 | 9 | 37 |
| LYD662 | 0.81 | 4.76E−03 | 9 | 41 | LYD662 | 0.86 | 1.51E−03 | 12 | 24 |
| LYD662 | 0.75 | 1.31E−02 | 12 | 14 | LYD662 | 0.75 | 1.30E−02 | 12 | 17 |
| LYD662 | 0.82 | 3.37E−03 | 12 | 26 | LYD663 | 0.72 | 1.82E−02 | 6 | 58 |
| LYD663 | 0.75 | 1.22E−02 | 12 | 16 | LYD663 | 0.82 | 3.57E−03 | 12 | 21 |
| LYD663 | 0.88 | 1.57E−03 | 12 | 15 | LYD663 | 0.86 | 1.37E−03 | 12 | 18 |
| LYD664 | 0.71 | 4.97E−02 | 2 | 5 | LYD664 | 0.88 | 7.76E−04 | 5 | 50 |
| LYD664 | 0.80 | 5.82E−03 | 5 | 45 | LYD664 | 0.89 | 4.84E−04 | 11 | 33 |
| LYD664 | 0.89 | 4.73E−04 | 11 | 30 | LYD664 | 0.83 | 2.93E−03 | 11 | 32 |
| LYD665 | 0.71 | 2.24E−02 | 1 | 21 | LYD665 | 0.91 | 2.59E−04 | 8 | 50 |
| LYD666 | 0.89 | 6.17E−04 | 6 | 56 | LYD666 | 0.87 | 1.00E−03 | 6 | 65 |
| LYD666 | 0.75 | 1.31E−02 | 10 | 60 | LYD666 | 0.83 | 2.68E−03 | 10 | 64 |
| LYD666 | 0.84 | 2.39E−03 | 12 | 13 | LYD666 | 0.73 | 2.69E−02 | 12 | 15 |
| LYD667 | 0.78 | 7.42E−03 | 12 | 20 | LYD667 | 0.71 | 2.13E−02 | 12 | 23 |
| LYD667 | 0.77 | 9.13E−03 | 12 | 19 | LYD668 | 0.79 | 1.12E−02 | 2 | 3 |
| LYD668 | 0.75 | 1.95E−02 | 2 | 1 | LYD669 | 0.89 | 5.38E−04 | 6 | 59 |
| LYD669 | 0.86 | 1.55E−03 | 6 | 57 | LYD669 | 0.93 | 7.72E−05 | 12 | 24 |
| LYD669 | 0.82 | 3.72E−03 | 12 | 14 | LYD669 | 0.81 | 4.92E−03 | 12 | 17 |
| LYD669 | 0.94 | 5.22E−05 | 12 | 26 | LYD669 | 0.77 | 9.06E−03 | 12 | 18 |
| LYD670 | 0.79 | 6.65E−03 | 1 | 20 | LYD670 | 0.77 | 8.66E−03 | 1 | 22 |
| LYD670 | 0.88 | 4.33E−03 | 2 | 12 | LYD670 | 0.76 | 1.79E−02 | 2 | 3 |
| LYD670 | 0.88 | 1.57E−03 | 2 | 1 | LYD670 | 0.78 | 2.37E−02 | 2 | 11 |
| LYD670 | 0.73 | 2.59E−02 | 3 | 3 | LYD670 | 0.88 | 1.58E−03 | 3 | 1 |
| LYD672 | 0.71 | 2.05E−02 | 8 | 43 | LYD672 | 0.83 | 3.24E−03 | 11 | 35 |
| LYD672 | 0.74 | 1.36E−02 | 11 | 34 | LYD672 | 0.82 | 3.71E−03 | 11 | 31 |
| LYD673 | 0.94 | 4.23E−04 | 2 | 6 | LYD673 | 0.90 | 2.12E−03 | 2 | 10 |
| LYD673 | 0.95 | 3.89E−04 | 2 | 5 | LYD673 | 0.95 | 3.25E−04 | 2 | 7 |
| LYD673 | 0.73 | 1.70E−02 | 10 | 63 | LYD673 | 0.70 | 2.34E−02 | 12 | 19 |
| LYD674 | 0.72 | 4.59E−02 | 2 | 5 | LYD674 | 0.73 | 1.68E−02 | 11 | 36 |
| LYD675 | 0.79 | 2.00E−02 | 2 | 6 | LYD675 | 0.84 | 9.67E−03 | 2 | 10 |
| LYD675 | 0.88 | 4.05E−03 | 2 | 5 | LYD675 | 0.72 | 4.37E−02 | 2 | 7 |
| LYD675 | 0.91 | 2.96E−04 | 11 | 35 | LYD675 | 0.84 | 2.25E−03 | 11 | 34 |
| LYD675 | 0.90 | 4.48E−04 | 11 | 31 | LYD676 | 0.73 | 1.55E−02 | 8 | 43 |
| LYD676 | 0.78 | 8.05E−03 | 11 | 35 | LYD676 | 0.77 | 9.17E−03 | 11 | 31 |
| LYD677 | 0.75 | 1.91E−02 | 2 | 3 | LYD677 | 0.77 | 2.50E−02 | 2 | 10 |
| LYD677 | 0.73 | 4.09E−02 | 2 | 5 | LYD678 | 0.78 | 8.42E−03 | 8 | 49 |
| LYD678 | 0.72 | 1.99E−02 | 11 | 42 | LYD678 | 0.87 | 1.12E−03 | 11 | 38 |
| LYD679 | 0.77 | 8.47E−03 | 1 | 19 | LYD679 | 0.78 | 2.22E−02 | 2 | 6 |
| LYD679 | 0.83 | 1.17E−02 | 2 | 10 | LYD679 | 0.85 | 7.58E−03 | 2 | 5 |
| LYD679 | 0.75 | 3.29E−02 | 2 | 7 | LYD679 | 0.84 | 4.95E−03 | 3 | 3 |
| LYD679 | 0.72 | 2.97E−02 | 3 | 1 | LYD679 | 0.72 | 1.99E−02 | 5 | 43 |
| LYD679 | 0.81 | 4.78E−03 | 9 | 35 | LYD679 | 0.81 | 4.89E−03 | 9 | 34 |
| LYD679 | 0.81 | 4.67E−03 | 9 | 31 | LYD679 | 0.71 | 3.31E−02 | 12 | 15 |
| LYD679 | 0.84 | 2.28E−03 | 12 | 22 | LYD680 | 0.73 | 1.71E−02 | 1 | 27 |
| LYD680 | 0.72 | 4.47E−02 | 2 | 7 | LYD680 | 0.71 | 2.19E−02 | 8 | 46 |
| LYD680 | 0.80 | 5.67E−03 | 10 | 63 | LYD680 | 0.74 | 1.48E−02 | 10 | 67 |
| LYD681 | 0.82 | 1.26E−02 | 2 | 9 | LYD681 | 0.83 | 5.53E−03 | 3 | 1 |
| LYD681 | 0.71 | 2.17E−02 | 8 | 48 | LYD681 | 0.73 | 1.71E−02 | 9 | 37 |
| LYD682 | 0.75 | 1.96E−02 | 2 | 4 | LYD682 | 0.73 | 2.54E−02 | 3 | 3 |
| LYD682 | 0.70 | 2.29E−02 | 6 | 58 | LYD682 | 0.72 | 2.00E−02 | 12 | 16 |
| LYD682 | 0.76 | 1.07E−02 | 12 | 21 | LYD682 | 0.80 | 8.91E−03 | 12 | 15 |
| LYD682 | 0.72 | 1.94E−02 | 11 | 42 | LYD683 | 0.71 | 2.22E−02 | 10 | 59 |
| LYD684 | 0.70 | 2.33E−02 | 9 | 32 | LYD685 | 0.71 | 2.10E−02 | 5 | 43 |
| LYD685 | 0.93 | 1.00E−04 | 5 | 45 | LYD685 | 0.75 | 1.20E−02 | 8 | 43 |
| LYD685 | 0.74 | 1.52E−02 | 9 | 41 | LYD685 | 0.89 | 6.58E−04 | 11 | 35 |
| LYD685 | 0.83 | 3.23E−03 | 11 | 34 | LYD685 | 0.88 | 6.67E−04 | 11 | 31 |
| LYD686 | 0.79 | 6.31E−03 | 9 | 35 | LYD686 | 0.72 | 1.86E−02 | 9 | 34 |
| LYD686 | 0.78 | 8.07E−03 | 9 | 31 | LYD690 | 0.85 | 7.24E−03 | 2 | 12 |

TABLE 14-continued

Correlation between the expression level of selected genes of some embodiments of the invention in various tissues and the phenotypic performance under normal and stress conditions across tomato ecotypes

| Gene Name | R | P value | Exp. set | Corr. Set ID | Gene Name | R | P value | Exp. set | Corr. Set ID |
|---|---|---|---|---|---|---|---|---|---|
| LYD690 | 0.77 | 2.66E−02 | 2 | 11 | LYD690 | 0.75 | 1.25E−02 | 11 | 35 |
| LYD690 | 0.75 | 1.20E−02 | 11 | 34 | LYD690 | 0.75 | 1.31E−02 | 11 | 31 |

Table 14. Provided are the correlations (R) between the expression levels yield improving genes and their homologs in various tissues [Expression (Exp) sets] and the phenotypic performance [yield, biomass, growth rate and/or vigor components (Correlation vector (Corr))] under normal conditions across tomato ecotypes. P = p value.

Example 5

Production of Tomato Transcriptome and High Throughput Correlation Analysis Using 44K Tomato Oligonucleotide Micro-Array In order to produce a high throughput correlation analysis, the present inventors utilized a Tomato oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Tomato genes and transcripts. In order to define correlations between the levels of RNA expression with ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test.

I. Correlation of Tomato Varieties Across Ecotype Grown Under 50% Irrigation Conditions Experimental Procedures Growth procedure—Tomato variety was grown under normal conditions (4-6 Liters/m² per day) until flower stage. At this time, irrigation was reduced to 50% compared to normal conditions.

RNA extraction—Two tissues at different developmental stages [flower and leaf], representing different plant characteristics, were sampled and RNA was extracted as described above.

Fruit Yield (grams)—At the end of the experiment [when 50% of the fruit were ripe (red)] all fruits from plots within blocks A-C were collected. The total fruits were counted and weighted. The average fruits weight was calculated by dividing the total fruit weight by the number of fruits.

Yield/SLA and Yield/total leaf area—Fruit yield divided by the specific leaf area or the total leaf area gives a measurement of the balance between reproductive and vegetative processes.

Plant Fresh Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two inflorescence from plots within blocks A-C were collected. The inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content.

TABLE 15

Tissues used for tomato transcriptome expression sets

| Expression Set | Set ID |
|---|---|
| Root grown under normal growth conditions | 1 + 7 |
| Root grown under NUE growth conditions | 2 + 4 |
| Leaf grown under normal growth conditions | 3 + 5 |
| Leaf grown under NUE growth conditions | 6 + 8 |

Table 15: Provided are the identification (ID) digits of each of the tomato expression sets.

Tomato yield components and vigor related parameters under 50% water irrigation assessment—10 Tomato varieties in 3 repetitive blocks (named A, B, and C), each containing 6 plants per plot were grown at net house. Plants were phenotyped on a daily basis following the standard descriptor of tomato (Table 16, below). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute).

Data parameters collected are summarized in Table 16, herein below.

TABLE 16

Tomato correlated parameters (vectors)

| Correlated parameter with | Correlation ID |
|---|---|
| Shoot Biomass[DW]/SPAD (gr/SPAD) | 1 |
| Root Biomass[DW]/SPAD (gr/SPAD) | 2 |
| Total Biomass [Root + Shoot DW]/SPAD (gr/SPAD) | 3 |
| N level/Leaf [SPAD unit/leaf] (SPAD/gr) | 4 |
| Shoot/Root (ratio) | 5 |

TABLE 16-continued

Tomato correlated parameters (vectors)

| Correlated parameter with | Correlation ID |
|---|---|
| Percent Shoot Biomass reduction compared to normal (%) | 6 |
| Percent Root Biomass reduction compared to normal (%) | 7 |
| Shoots NUE (gr) | 8 |
| Roots NUE (gr) | 9 |
| Total biomass NUE (gr) | 10 |
| Plant Height NUE (cm) | 11 |
| Plant Height Normal (cm) | 12 |
| SPAD NUE (number) | 13 |
| Leaf number NUE/Normal (ratio) | 14 |
| Plant Height NUE/Normal (ratio) | 15 |
| SPAD NUE/Normal (ratio) | 16 |
| leaf No. NUE (number) | 17 |
| leaf No. Normal (number) | 18 |
| Plant height Normal (cm) | 19 |
| SPAD Normal | 20 |

Table 16: Provided are the tomato correlated parameters.
"NUE" = nitrogen use efficiency;
"DW" = dry weight;
"cm" = centimeter.

Experimental Results

RNA extraction—All 10 selected Tomato varieties were sampled per each treatment. Two tissues [leaves and flowers] growing at 50% irrigation or under normal conditions were sampled and RNA was extracted using TRIzol Reagent from Invitrogen [Hypertext Transfer Protocol://World Wide Web (dot) invitrogen (dot) com/content (dot) cfm?pageid=469]. Extraction of RNA from tissues was performed as described under "General Experimental And Bioinformatics Methods" above.

10 different Tomato varieties (accessions) were grown and characterized for 20 parameters as described above. The average for each of the measured parameter was calculated using the JMP software and values are summarized in Tables 17-18 below. Subsequent correlation analysis between expression of selected genes in various transcriptome expression sets and the measured parameters in tomato accessions (Tables 17-18) was conducted, and results were integrated to the database.

TABLE 17

Measured parameters in Tomato accessions (line 1-6)

| Ecotype/Treatment | Line-1 | Line-2 | Line-3 | Line-4 | Line-5 | Line-6 |
|---|---|---|---|---|---|---|
| 1 | 0.00 | 0.00 | 0.00 | 0.01 | 0.00 | 0.01 |
| 2 | 0.00 | 0.00 | 0.00 | 0.00 | 0.00 | 0.00 |
| 3 | 0.00 | 0.01 | 0.00 | 0.01 | 0.01 | 0.01 |
| 4 | 10.85 | 11.53 | 11.41 | 10.44 | 11.17 | 8.93 |
| 5 | 5.01 | 6.41 | 11.39 | 9.49 | 11.60 | 8.20 |
| 6 | 75.38 | 62.15 | 55.11 | 49.73 | 63.19 | 82.67 |
| 7 | 62.59 | 143.71 | 54.16 | 70.55 | 59.69 | 96.13 |
| 8 | 35.35 | 38.35 | 24.09 | 65.02 | 46.71 | 46.67 |
| 9 | 6.99 | 7.73 | 2.54 | 7.04 | 5.04 | 8.01 |
| 10 | 58.47 | 69.70 | 63.75 | 69.29 | 71.10 | 60.54 |
| 11 | 36.78 |  | 39.89 | 47.00 | 46.44 | 45.44 |
| 12 | 45.33 |  | 47.78 | 55.33 | 56.22 | 48.67 |
| 13 | 34.57 |  | 24.87 | 31.58 | 29.72 | 31.83 |
| 14 | 0.85 |  | 0.90 | 1.09 | 0.88 | 1.02 |
| 15 | 0.81 |  | 0.83 | 0.85 | 0.83 | 0.93 |
| 16 | 1.01 |  | 0.98 | 1.00 | 0.98 | 0.98 |
| 17 | 5.56 |  | 6.22 | 6.78 | 5.56 | 6.56 |
| 1 | 0.01 | 0.01 | 0.01 | 0.01 | 0.01 | 0.01 |
| 2 | 0.00 | 0.00 | 0.00 | 0.00 | 0.00 | 0.00 |
| 3 | 0.01 | 0.01 | 0.01 | 0.02 | 0.01 | 0.01 |
| 4 | 9.29 | 10.18 | 8.87 | 8.43 | 9.83 | 8.57 |
| 5 | 5.40 | 12.65 | 10.02 | 15.42 | 8.83 | 7.52 |
| 8 | 4.69 | 6.17 | 4.37 | 13.08 | 7.39 | 5.65 |
| 9 | 1.12 | 0.54 | 0.47 | 1.00 | 0.84 | 0.83 |
| 10 | 7.47 | 9.10 | 8.63 | 8.85 | 7.22 | 7.87 |
| 18 | 6.56 |  | 6.89 | 6.22 | 6.33 | 6.44 |
| 19 | 45.33 |  | 47.78 | 55.33 | 56.22 | 48.67 |
| 20 | 34.30 |  | 25.31 | 31.43 | 30.24 | 32.43 |

Table 17. Provided are the measured yield components and vigor related parameters under normal or Nitrogen use efficiency parameters for the tomato accessions (Varieties) according to the Correlation ID numbers (described in Table 16 above)

TABLE 18

Measured parameters in Tomato accessions (line 7-12)

| Ecotype/Treatment | Line-7 | Line-8 | Line-9 | Line-10 | Line-11 | Line-12 |
|---|---|---|---|---|---|---|
| 1 | 0.01 | 0.01 | 0.01 | 0.01 | 0.0056 |  |
| 2 | 0.00 | 0.00 | 0.00 | 0.00 | 0.0015 |  |
| 3 | 0.01 | 0.01 | 0.01 | 0.01 | 0.007 |  |
| 4 | 7.93 | 7.99 | 10.30 | 8.59 | 14.491 |  |
| 5 | 10.38 | 10.52 | 8.24 | 7.97 | 3.9092 |  |
| 6 | 66.92 | 107.98 | 55.40 | 54.43 | 59.746 |  |
| 7 | 106.50 | 111.90 | 81.64 | 32.21 | 87.471 |  |
| 8 | 120.07 | 60.09 | 66.27 | 56.46 | 60.32 |  |
| 9 | 15.09 | 9.02 | 8.78 | 7.25 | 15.94 |  |
| 10 | 73.90 | 68.81 | 66.74 | 70.82 | 49.72 |  |
| 11 | 47.67 | 39.33 | 41.78 | 41.00 |  | 34.44 |
| 12 | 55.78 | 37.44 | 49.56 | 46.33 |  | 40.78 |
| 13 | 30.33 | 30.29 | 31.32 | 28.77 |  | 28.58 |
| 14 | 0.87 | 1.06 | 0.91 | 1.12 |  | 0.98 |
| 15 | 0.85 | 1.05 | 0.84 | 0.88 |  | 0.84 |
| 16 | 0.93 | 1.05 | 1.01 | 0.99 |  | 1.02 |
| 17 | 5.11 | 5.89 | 5.56 | 6.33 |  | 7.22 |
| 1 | 0.02 | 0.01 | 0.01 | 0.01 | 0.0094 |  |
| 2 | 0.00 | 0.00 | 0.00 | 0.00 | 0.0017 |  |
| 3 | 0.02 | 0.01 | 0.01 | 0.01 | 0.011 |  |
| 4 | 6.57 | 6.97 | 8.71 | 7.35 | 9.3699 |  |
| 5 | 12.61 | 7.99 | 14.31 | 4.80 | 6.2937 |  |
| 8 | 17.94 | 5.56 | 11.96 | 10.37 | 10.1 |  |
| 9 | 0.94 | 0.81 | 1.08 | 2.25 | 1.82 |  |
| 10 | 9.09 | 7.91 | 8.55 | 8.68 | 6.24 |  |
| 18 | 5.89 | 5.56 | 6.11 | 5.67 |  | 7.33 |
| 19 | 55.78 | 37.44 | 49.56 | 46.33 |  | 40.78 |
| 20 | 32.58 | 28.77 | 30.92 | 28.99 |  | 28.12 |

Table 18: Provided are the measured yield components and vigor related parameters under normal or Nitrogen use efficiency parameters for the tomato accessions (Varieties) according to the Correlation ID numbers (described in Table 16 above)

TABLE 19

Correlation between the expression level of selected genes of some embodiments of the invention in various tissues and the phenotypic performance under normal or low nitrogen use conditions across tomato accessions

| Gene Name | R | P value | Exp. set | Corr. Set ID | Gene Name | R | P value | Exp. set | Corr. Set ID |
|---|---|---|---|---|---|---|---|---|---|
| LYD648 | 0.73 | 2.42E−02 | 1 | 2 | LYD648 | 0.72 | 2.90E−02 | 2 | 9 |
| LYD648 | 0.71 | 3.18E−02 | 2 | 2 | LYD648 | 0.73 | 2.66E−02 | 4 | 9 |
| LYD648 | 0.71 | 3.26E−02 | 4 | 3 | LYD648 | 0.72 | 2.88E−02 | 4 | 2 |
| LYD648 | 0.73 | 2.69E−02 | 7 | 2 | LYD651 | 0.76 | 1.77E−02 | 6 | 7 |
| LYD651 | 0.76 | 1.72E−02 | 8 | 7 | LYD652 | 0.73 | 4.09E−02 | 3 | 18 |
| LYD652 | 0.72 | 2.84E−02 | 7 | 4 | LYD653 | 0.76 | 2.70E−02 | 4 | 15 |
| LYD653 | 0.79 | 1.22E−02 | 4 | 6 | LYD654 | 0.81 | 8.61E−03 | 2 | 4 |
| LYD654 | 0.78 | 1.31E−02 | 4 | 4 | LYD654 | 0.78 | 1.38E−02 | 6 | 7 |
| LYD654 | 0.81 | 1.42E−02 | 7 | 18 | LYD655 | 0.79 | 1.16E−02 | 2 | 8 |
| LYD655 | 0.83 | 5.65E−03 | 2 | 9 | LYD655 | 0.76 | 1.65E−02 | 2 | 3 |
| LYD655 | 0.75 | 1.94E−02 | 2 | 1 | LYD655 | 0.77 | 1.53E−02 | 2 | 2 |
| LYD655 | 0.79 | 1.14E−02 | 4 | 8 | LYD655 | 0.83 | 5.95E−03 | 4 | 9 |
| LYD655 | 0.76 | 1.68E−02 | 4 | 3 | LYD655 | 0.75 | 1.96E−02 | 4 | 1 |
| LYD655 | 0.76 | 1.66E−02 | 4 | 2 | LYD657 | 0.91 | 1.90E−03 | 6 | 15 |
| LYD657 | 0.88 | 1.67E−03 | 6 | 6 | LYD658 | 0.73 | 2.67E−02 | 3 | 9 |
| LYD658 | 0.73 | 2.48E−02 | 3 | 2 | LYD659 | 0.89 | 1.15E−03 | 6 | 7 |
| LYD660 | 0.81 | 1.44E−02 | 4 | 17 | LYD660 | 0.71 | 3.19E−02 | 6 | 2 |
| LYD660 | 0.78 | 1.35E−02 | 6 | 7 | LYD660 | 0.85 | 4.02E−03 | 7 | 4 |
| LYD660 | 0.76 | 2.84E−02 | 7 | 18 | LYD660 | 0.78 | 1.24E−02 | 8 | 7 |
| LYD664 | 0.74 | 2.21E−02 | 6 | 7 | LYD664 | 0.73 | 2.43E−02 | 8 | 7 |
| LYD667 | 0.94 | 5.35E−04 | 4 | 15 | LYD667 | 0.88 | 1.75E−03 | 4 | 6 |
| LYD667 | 0.73 | 2.49E−02 | 4 | 7 | LYD667 | 0.81 | 1.41E−02 | 6 | 15 |
| LYD667 | 0.89 | 1.39E−03 | 6 | 6 | LYD668 | 0.74 | 2.32E−02 | 6 | 7 |
| LYD669 | 0.92 | 1.38E−03 | 4 | 15 | LYD669 | 0.89 | 3.23E−03 | 6 | 15 |
| LYD669 | 0.94 | 1.50E−04 | 6 | 6 | LYD670 | 0.75 | 3.38E−02 | 6 | 15 |
| LYD670 | 0.74 | 2.35E−02 | 6 | 6 | LYD672 | 0.74 | 2.26E−02 | 6 | 9 |
| LYD672 | 0.71 | 3.33E−02 | 6 | 2 | LYD672 | 0.79 | 1.17E−02 | 6 | 7 |
| LYD673 | 0.74 | 3.51E−02 | 4 | 12 | LYD673 | 0.74 | 3.51E−02 | 7 | 19 |
| LYD674 | 0.72 | 4.42E−02 | 6 | 17 | LYD675 | 0.73 | 2.60E−02 | 6 | 9 |
| LYD675 | 0.81 | 7.67E−03 | 6 | 7 | LYD675 | 0.72 | 2.79E−02 | 8 | 9 |
| LYD675 | 0.81 | 8.09E−03 | 8 | 7 | LYD676 | 0.75 | 2.12E−02 | 6 | 7 |
| LYD676 | 0.81 | 1.57E−02 | 7 | 18 | LYD676 | 0.76 | 1.84E−02 | 8 | 7 |
| LYD677 | 0.77 | 2.57E−02 | 3 | 19 | LYD677 | 0.77 | 2.57E−02 | 6 | 12 |
| LYD678 | 0.72 | 4.30E−02 | 4 | 16 | LYD678 | 0.72 | 2.81E−02 | 4 | 6 |
| LYD678 | 0.79 | 1.98E−02 | 6 | 15 | LYD678 | 0.90 | 9.54E−04 | 6 | 6 |
| LYD680 | 0.71 | 5.02E−02 | 4 | 17 | LYD682 | 0.74 | 3.43E−02 | 3 | 20 |
| LYD683 | 0.70 | 3.48E−02 | 6 | 7 | LYD684 | 0.85 | 3.56E−03 | 6 | 7 |
| LYD690 | 0.70 | 3.56E−02 | 4 | 6 | LYD690 | 0.83 | 1.16E−02 | 6 | 15 |
| LYD690 | 0.93 | 3.18E−04 | 6 | 6 | | | | | |

Table 19. Provided are the correlations (R) between the expression levels of yield improving genes and their homologues in tissues [Leaves or roots; Expression sets (Exp)] and the phenotypic performance in various yield, biomass, growth rate and/or vigor components [Correlation vector (corr.)] under stress conditions or normal conditions across tomato accessions. P = p value.

Example 6

Production of B. juncea Transcriptome and High Throughput Correlation Analysis with Yield Parameters Using 60K B. juncea Oligonucleotide Micro-Arrays In order to produce a high throughput correlation analysis, the present inventors utilized a B. juncea oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60,000 B. juncea genes and transcripts. In order to define correlations between the levels of RNA expression with yield components or vigor related parameters, various plant characteristics of 11 different B. juncea varieties were analyzed and used for RNA expression analysis. The correlation between the RNA levels and the characterized parameters was analyzed using Pearson correlation test.

Correlation of B. juncea Genes' Expression Levels with Phenotypic Characteristics Across Ecotype Experimental Procedures Eleven B. juncea varieties were grown in three repetitive plots, in field. Briefly, the growing protocol was as follows: B. juncea seeds were sown in soil and grown under normal condition till harvest. In order to define correlations between the levels of RNA expression with yield components or vigor related parameters, the eleven different B. juncea varieties were analyzed and used for gene expression analyses.

TABLE 20

Tissues used for B. juncea transcriptome expression sets

| Expression Set | Set ID |
|---|---|
| Meristem at vegetative stage under normal growth conditions | 1 |
| Flower at flowering stage under normal growth conditions | 2 |
| Leaf at vegetative stage under normal growth conditions | 3 |
| Pod (R1-R3) under normal growth conditions | 4 |
| Pod (R4-R5) under normal growth conditions | 5 |

Table 20: Provided are the identification (ID) digits of each of the B. juncea expression sets.

RNA extraction—All 11 selected *B. juncea* varieties were sample per each treatment. Plant tissues [leaf, Pod, Lateral meristem and flower] growing under normal conditions were sampled and RNA was extracted as described above.

The collected data parameters were as follows:

Fresh weight (plot-harvest) [gr/plant]—total fresh weight per plot at harvest time normalized to the number of plants per plot.

Seed Weight [milligrams/plant]—total seeds from each plot was extracted, weighted and normalized for plant number in each plot.

Harvest index—The harvest index was calculated: seed weight/fresh weight.

Days till bolting/flowering—number of days till 50% bolting/flowering for each plot.

SPAD—Chlorophyll content was determined using a Minolta SPAD 502 chlorophyll meter and measurement was performed at time of flowering. SPAD meter readings were done on young fully developed leaf. Three measurements per leaf were taken for each plot.

Main branch—average node length—total length/total number of nods on main branch.

Lateral branch—average node length—total length/total number of nods on lateral branch.

Main branch—20th length—the length of the pod on the $20^{th}$ node from the apex of main branch.

Lateral branch—20th length—the length of the pod on the $20^{th}$ node from the apex of lateral branch.

Main branch—20th seed No.—number of seeds in the pod on the $20^{th}$ node from the apex of main branch.

Lateral branch—20th seed number—number of seeds in the pod on the $20^{th}$ node from the apex of lateral branch.

Number of lateral branches—total number of lateral branches, average of three plants per plot.

Main branch height [cm]—total length of main branch.

Min-lateral branch position—lowest node on the main branch that has developed lateral branch.

Max-lateral branch position [#node of main branch]—highest node on the main branch that has developed lateral branch.

Max-number of nodes in lateral branch—the highest number of node that a lateral branch had per plant.

Max length of lateral branch [cm]—the highest length of lateral branch per plant.

Max diameter of lateral branch [mm]—the highest base diameter that a lateral branch had per plant.

Oil Content—Indirect oil content analysis was carried out using Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)].

Fresh weight (single plant) (gr/plant)—average fresh weight of three plants per plot taken at the middle of the season.

Main branch base diameter [mm]—the based diameter of main branch, average of three plants per plot.

1000 Seeds [gr]—weight of 1000 seeds per plot.

Experimental Results

Eleven different *B. juncea* varieties (i.e., seed ID 646, 648, 650, 657, 661, 662, 663, 664, 669, 670, 671) were grown and characterized for 23 parameters as specified above. The average for each of the measured parameters was calculated using the JMP software and values are summarized in Tables 22-23 below. Subsequent correlation analysis between the various transcriptome expression sets and the average parameters, was conducted. Results were then integrated to the database.

TABLE 21

Correlated parameters in *B. juncea* accessions

| Correlated parameter with | Correlation ID |
|---|---|
| Days till bolting (days) | 1 |
| Fresh weight (plot-harvest) [gr/plant] | 2 |
| Seed weight per plant (gr) | 3 |
| Harvest index (ratio) | 4 |
| Days till flowering (days) | 5 |
| SPAD | 6 |
| Main branch - average node length (cm) | 7 |
| Lateral branch - average node length (cm) | 8 |
| Main branch - 20th length (cm) | 9 |
| Lateral branch - 20th length (cm) | 10 |
| Main branch - 20th seed number (number) | 11 |
| Lateral branch - 20th seed number (number) | 12 |
| Number of lateral branches (number) | 13 |
| Main branch height [cm] | 14 |
| Min-Lateral branch position ([#node of main branch) | 15 |
| Max-Lateral branch position [#node of main branch] | 16 |
| Max-Number of nodes in lateral branch (number) | 17 |
| Max-Length of lateral branch [cm] | 18 |
| Max-Diameter of lateral branch [mm] | 19 |
| Oil content (mg) | 20 |
| Fresh weight (single plant) [gr/plant] | 21 |
| Main branch base diameter [mm] | 22 |
| 1000 Seeds [gr] | 23 |

Table 21. Provided are the *B. juncea* correlated parameters.
"gr." = grams;
mm = millimeters;
"cm" = centimeters;
"mg" = milligrams;
"SPAD" = chlorophyll levels;

TABLE 22

Measured parameters in *B. juncea* accessions (lines 1-6)

| Ecotype/Treatment | Line-1 | Line-2 | Line-3 | Line-4 | Line-5 | Line-6 |
|---|---|---|---|---|---|---|
| 1 | 57.33 | 60.33 | 59.67 | 56.33 | 55.00 | 46.67 |
| 2 | 69.24 | 45.22 | 39.27 | 49.11 | 43.95 | 46.42 |
| 3 | 0.00 | 0.01 | 0.01 | 0.01 | 0.01 | 0.01 |
| 4 | 0.00 | 0.00 | 0.00 | 0.00 | 0.00 | 0.00 |
| 5 | 66.00 | 69.67 | 69.33 | 66.00 | 61.33 | 53.00 |
| 6 | 33.02 | 30.01 | 32.83 | 37.53 | 41.44 | 35.41 |
| 7 | 0.48 | 0.41 | 0.63 | 0.43 | 0.38 | 0.68 |
| 8 | 0.65 | 0.43 | 0.74 | 0.57 | 0.56 | 0.79 |
| 9 | 4.28 | 3.72 | 3.62 | 3.50 | 2.74 | 5.20 |
| 10 | 4.32 | 3.69 | 4.14 | 3.37 | 3.06 | 3.96 |
| 11 | 13.22 | 13.67 | 10.44 | 14.11 | 9.78 | 15.22 |
| 12 | 13.00 | 14.00 | 13.22 | 13.44 | 11.00 | 13.11 |
| 13 | 15.22 | 14.89 | 13.56 | 14.89 | 14.00 | 9.78 |
| 14 | 140.72 | 125.22 | 112.44 | 133.39 | 142.00 | 101.50 |
| 15 | 6.78 | 6.33 | 5.56 | 3.67 | 3.00 | 3.11 |
| 16 | 15.22 | 14.89 | 13.56 | 14.89 | 14.00 | 10.89 |
| 17 | 5.22 | 7.00 | 5.22 | 7.00 | 6.56 | 9.44 |
| 18 | 40.44 | 47.22 | 41.61 | 60.50 | 59.78 | 59.44 |
| 19 | 4.20 | 4.85 | 4.34 | 5.74 | 5.87 | 5.68 |
| 20 | 40.19 | 40.71 | 40.91 | 38.57 | 40.14 | 42.63 |
| 21 | 197.78 | 142.22 | 147.22 | 243.33 | 192.33 | 163.78 |
| 22 | 14.53 | 11.99 | 19.91 | 14.32 | 12.59 | 12.30 |
| 23 | 3.76 | 2.21 | 3.26 | 2.36 | 2.00 | 3.12 |

Table 22. Provided are the values of each of the parameters (as described above) measured in *B. juncea* accessions (Seed ID) under normal conditions.

TABLE 23

Measured parameters in B. juncea accessions (lines 7-11)

| Ecotype/Treatment | Line-7 | Line-8 | Line-9 | Line-10 | Line-11 |
|---|---|---|---|---|---|
| 1 | 59.00 | 54.33 | 59.67 | 57.33 | 53.00 |
| 2 | 36.14 | 32.58 | 33.16 | 63.23 | 60.94 |
| 3 | 0.00 | 0.00 | 0.00 | 0.01 | 0.01 |
| 4 | 0.00 | 0.00 | 0.00 | 0.00 | 0.00 |
| 5 | 69.67 | 63.67 | 69.67 | 71.00 | 58.33 |
| 6 | 33.17 | 32.87 | 34.80 | 31.82 | 41.49 |
| 7 | 0.40 | 0.63 | 0.57 | 0.59 | 1.55 |
| 8 | 0.57 | 0.76 | 0.96 | 0.78 | 0.90 |
| 9 | 3.91 | 3.98 | 3.46 | 3.73 | 4.04 |
| 10 | 4.33 | 4.21 | 4.14 | 4.04 | 3.88 |
| 11 | 12.00 | 12.67 | 9.89 | 11.56 | 15.56 |
| 12 | 11.89 | 13.44 | 11.22 | 13.22 | 14.00 |
| 13 | 16.44 | 14.33 | 14.56 | 14.11 | 16.78 |
| 14 | 145.39 | 131.56 | 129.89 | 131.56 | 116.44 |
| 15 | 7.78 | 6.22 | 5.56 | 4.89 | 5.33 |
| 16 | 16.44 | 14.33 | 14.56 | 14.11 | 16.78 |
| 17 | 6.11 | 5.22 | 5.67 | 6.56 | 6.00 |
| 18 | 47.28 | 47.33 | 44.67 | 58.67 | 47.17 |
| 19 | 4.52 | 4.89 | 4.68 | 5.56 | 5.49 |
| 20 | 41.34 | 40.82 | 40.82 | 38.14 | 37.21 |
| 21 | 164.44 | 181.11 | 176.22 | 217.89 | 261.11 |
| 22 | 12.60 | 12.91 | 12.56 | 13.77 | 13.56 |
| 23 | 3.34 | 3.09 | 3.39 | 3.40 | 2.39 |

Table 23: Provided are the values of each of the parameters (as described above) measured in B. juncea accessions (Seed ID) under normal conditions.

TABLE 24

Correlation between the expression level of selected genes of some embodiments of the invention in various tissues and the phenotypic performance under normal or normal conditions across B. Juncea accessions

| Gene Name | R | P value | Exp. set | Corr. Set ID | Gene Name | R | P value | Exp. set | Corr. Set ID |
|---|---|---|---|---|---|---|---|---|---|
| LYD537 | 0.76 | 7.70E−02 | 2 | 19 | LYD537 | 0.84 | 3.50E−02 | 2 | 18 |
| LYD537 | 0.73 | 9.84E−02 | 2 | 17 | LYD537 | 0.73 | 9.68E−02 | 2 | 2 |
| LYD537 | 0.72 | 1.95E−02 | 3 | 4 | LYD538 | 0.77 | 7.11E−02 | 2 | 21 |
| LYD538 | 0.90 | 1.59E−02 | 2 | 2 | LYD538 | 0.72 | 1.09E−01 | 2 | 12 |
| LYD538 | 0.70 | 2.40E−02 | 3 | 19 | LYD538 | 0.82 | 4.06E−03 | 3 | 11 |
| LYD538 | 0.72 | 2.00E−02 | 3 | 3 | LYD538 | 0.76 | 6.83E−03 | 5 | 7 |
| LYD539 | 0.75 | 1.24E−02 | 3 | 4 | LYD540 | 0.80 | 5.79E−02 | 2 | 21 |
| LYD540 | 0.85 | 3.24E−02 | 2 | 3 | LYD540 | 0.80 | 5.64E−02 | 2 | 7 |
| LYD540 | 0.90 | 1.36E−02 | 2 | 2 | LYD540 | 0.86 | 2.80E−02 | 2 | 12 |
| LYD540 | 0.76 | 1.15E−02 | 3 | 4 | LYD540 | 0.74 | 9.59E−03 | 5 | 17 |

Table 24. Provided are the correlations (R) between the expression levels of yield improving genes and their homologues in tissues [Leaves, meristem, flower and pods; Expression sets (Exp)] and the phenotypic performance in various yield, biomass, growth rate and/or vigor components [Correlation vector (corr.)] under stress conditions or normal conditions across B, juncea accessions. P = p value.

Example 7

Production of B. Juncea Transcriptome and High Throughput Correlation Analysis with Yield Parameters of Juncea Grown Under Various Population Densities Using 60K B. Juncea Oligonucleotide Micro-Arrays In order to produce a high throughput correlation analysis, the present inventors utilized a B. juncea oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60,000 B. juncea genes and transcripts. In order to define correlations between the levels of RNA expression with yield components or vigor related parameters, various plant characteristics of two different B. juncea varieties grown under seven different population densities were analyzed and used for RNA expression analysis. The correlation between the RNA levels and the characterized parameters was analyzed using Pearson correlation test.

Correlation of B. juncea Genes' Expression Levels with Phenotypic Characteristics Across Seven Population Densities for Two Ecotypes Experimental Procedures Two B. juncea varieties were grown in a field under seven population densities (10, 60, 120, 160, 200, 250 and 300 plants per m²) in two repetitive plots. Briefly, the growing protocol was as follows: B. juncea seeds were sown in soil and grown under normal condition till harvest. In order to define correlations between the levels of RNA expression with yield components or vigor related parameters, the two different B. juncea varieties grown under various population densities were analyzed and used for gene expression analyses. The correlation between the RNA levels and the characterized parameters was analyzed using Pearson correlation test for each ecotype independently.

TABLE 25

Tissues used for B. juncea transcriptome expression sets

| Expression Set | Set ID |
|---|---|
| Meristem under normal growth conditions various population densities | 1 + 2 |
| Flower under normal growth conditions various population densities | 3 |

Table 25: Provided are the identification (ID) digits of each of the B, juncea expression sets.

RNA extraction—the two B. juncea varieties grown under seven population densities were sample per each treatment. Plant tissues [Flower and Lateral meristem] growing under Normal conditions were sampled and RNA was extracted as described above. For convenience, each micro-array expression information tissue type has received a Set ID.

The collected data parameters were as follows:

Fresh weight (plot-harvest) [gr/plant]—total fresh weight per plot at harvest time normalized to the number of plants per plot.

Seed weight [gr/plant]—total seeds from each plot was extracted, weighted and normalized for plant number in each plot.

Harvest index—The harvest index was calculated: seed weight/fresh weight.

Days till bolting/flowering—number of days till 50% bolting/flowering for each plot.

SPAD—Chlorophyll content was determined using a Minolta SPAD 502 chlorophyll meter and measurement was performed at time of flowering. SPAD meter readings were done on young fully developed leaf. Three measurements per leaf were taken for each plot.

Main branch—average node length—total length/total number of nods on main branch.

Lateral branch—average node length—total length/total number of nods on lateral branch.

Main branch—20th length—the length of the pod on the $20^{th}$ node from the apex of main branch.

Lateral branch—20th length—the length of the pod on the $20^{th}$ node from the apex of lateral branch.

Main branch—20th seed No.—number of seeds in the pod on the $20^{th}$ node from the apex of main branch.

Lateral branch—20th seed number—number of seeds in the pod on the $20^{th}$ node from the apex of lateral branch.

Number of lateral branches—total number of lateral branches, average of three plants per plot.

Main branch height [cm]—total length of main branch.

Min-Lateral branch position—lowest node on the main branch that has developed lateral branch.

Max-Lateral branch position [#node of main branch]—highest node on the main branch that has developed lateral branch.

Max-number of nodes in lateral branch—the highest number of node that a lateral branch had per plant.

Max-length of lateral branch [cm]—the highest length of lateral branch per plant.

Max diameter of lateral branch [mm]—the highest base diameter that a lateral branch had per plant.

Oil content—Indirect oil content analysis was carried out using Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)].

Fresh weight (single plant) (gr/plant)—average fresh weight of three plants per plot taken at the middle of the season.

Main branch base diameter [mm]—the based diameter of main branch, average of three plants per plot.

1000 Seeds [gr]—weight of 1000 seeds per plot.

Main branch-total number of pods—total number of pods on the main branch, average of three plants per plot.

Main branch-dist. 1-20—the length between the youngest pod and pod number 20 on the main branch, average of three plants per plot.

Lateral branch-total number of pods—total number of pods on the lowest lateral branch, average of three plants per plot.

Lateral branch-dis. 1-20—the length between the youngest pod and pod number 20 on the lowest lateral branch, average of three plants per plot.

Dry weight/plant—weight of total plants per plot at harvest after three days at oven at 60° C. normalized for the number of plants per plot.

Total leaf area—Total leaf area per plot was calculated based on random three plants and normalized for number of plants per plot.

Total Perim.—total perimeter of leaves, was calculated based on random three plants and normalized for number of plants per plot.

Experimental Results

Two *B. juncea* varieties were grown under seven different population densities and characterized for 30. The average for each of the measured parameter was calculated using the JMP software and values are summarized in Tables 27-29 below. Subsequent correlation analysis between the expression of selected genes in various transcriptome expression sets and the average parameters was conducted. Results were then integrated to the database.

TABLE 26

Correlation parameters in *B. juncea* accessions

| Correlated parameter with | Correlation ID |
| --- | --- |
| Main branch base diameter [mm] | 1 |
| Fresh Weight (single plant) [gr/plant] | 2 |
| Main branch height [cm] | 3 |
| Number of lateral branches (number) | 4 |
| Min-Lateral branch position (number of node on the main stem) | 5 |
| Max-Lateral branch position (number of node on the main stem) | 6 |
| Max-Number of nodes in lateral branch (number) | 7 |
| Max-Length of lateral branch [cm] | 8 |
| Max-Diameter of lateral branch [mm] | 9 |
| Main branch-total number of pods (number) | 10 |
| Main branch-dist. 1-20 | 11 |
| Main branch-20th length (cm) | 12 |
| Main branch-20th seed number (number) | 13 |
| Lateral branch-total number of pods (number) | 14 |
| Lateral branch-dist. 1-20 | 15 |
| Lateral branch-20th length (cm) | 16 |
| Lateral branch-20th seed number (number) | 17 |
| Oil content (mg) | 18 |
| SPAD | 19 |
| days till bolting (days) | 20 |
| days till flowering (days) | 21 |
| Fresh weight (at harvest)/plant (gr/plant) | 22 |
| Dry weight/plant (gr/plant) | 23 |
| Seed weight/plant (gr/plant) | 24 |
| Fresh weight (harvest)/hectare (Kg/hectare) | 25 |
| Dry weight/hectare (Kg/hectare) | 26 |
| Seed weight/hectare | 27 |
| 1000 Seeds [gr] | 28 |
| Total leaf area (cm) | 29 |
| Total perim. | 30 |

Table 26. Provided are the *B. juncea* correlated parameters.

"gr." = grams;

mm = millimeters;

"cm" = centimeters;

"mg" = milligrams;

"SPAD" = chlorophyll levels;

"Kg." = kilograms;

TABLE 27

Measured parameters in *B. juncea* accessions at various population densities (line 1-6)

| Ecotype/Treatment | Line-1 | Line-2 | Line-3 | Line-4 | Line-5 | Line-6 |
|---|---|---|---|---|---|---|
| 1 | 14.77 | 6.90 | 5.62 | 4.99 | 6.45 | 3.95 |
| 2 | 0.37 | 0.04 | 0.03 | 0.02 | 0.04 | 0.02 |
| 3 | 118.67 | 115.50 | 111.33 | 106.00 | 117.50 | 108.00 |
| 4 | 17.17 | 19.17 | 15.83 | 19.33 | 18.33 | 17.83 |
| 5 | 1.00 | 11.00 | 7.00 | 11.00 | 9.00 | 9.00 |
| 6 | 20.00 | 23.00 | 19.00 | 24.00 | 22.00 | 20.00 |
| 7 | 10.00 | 4.00 | 4.00 | 4.00 | 6.00 | 4.00 |
| 8 | 122.00 | 41.00 | 43.00 | 36.00 | 40.00 | 42.00 |
| 9 | 7.70 | 2.90 | 2.50 | 2.00 | 3.40 | 2.50 |
| 10 | 20.00 | 15.33 | 17.67 | 16.50 | 23.17 | 16.83 |
| 11 | 42.35 | 27.90 | 31.22 | 26.05 | 27.72 | 31.85 |
| 12 | 5.12 | 4.63 | 4.60 | 4.67 | 4.73 | 4.68 |
| 13 | 20.00 | 17.67 | 18.00 | 18.50 | 17.67 | 17.50 |
| 14 | 17.33 | 11.67 | 10.67 | 10.17 | 12.50 | 9.83 |
| 15 | 40.73 | 17.53 | 19.08 | 15.65 | 15.23 | 17.73 |
| 16 | 5.12 | 4.48 | 4.37 | 4.33 | 4.35 | 4.40 |
| 17 | 21.67 | 19.33 | 17.00 | 18.83 | 15.67 | 17.17 |
| 18 | 28.86 | 29.62 | 29.57 | 30.59 | 29.87 | 25.22 |
| 19 | 43.49 | 41.95 | 40.48 | 37.93 | 39.50 | 45.57 |
| 20 | 53.00 | 50.50 | 48.00 | 53.00 | 50.00 | 51.50 |
| 21 | 67.00 | 64.00 | 64.00 | 64.00 | 64.00 | 62.50 |
| 22 | 0.26 | 0.02 | 0.01 | 0.01 | 0.01 | 0.01 |
| 23 | 0.07 | 0.01 | 0.00 | 0.00 | 0.00 | 0.00 |
| 24 | 0.02 | 0.00 | 0.00 | 0.00 | 0.00 | 0.00 |
| 25 | 22434.19 | 22067.24 | 32929.29 | 18596.04 | 20654.32 | 24019.71 |
| 26 | 6109.02 | 9857.37 | 8940.70 | 4363.21 | 6702.22 | 6009.09 |
| 27 | 1797.45 | 2307.34 | 2552.84 | 1466.27 | 2100.38 | 1901.67 |
| 28 | 1.80 | 1.75 | 1.62 | 1.99 | 1.92 | 1.54 |
| 29 | 508.27 | 37.49 | 25.00 | 14.33 | 50.79 | 29.13 |
| 30 | 862.83 | 100.50 | 67.98 | 37.91 | 97.51 | 61.17 |

Table 27

TABLE 28

Measured parameters in *B. juncea* accessions at various population densities (line 7-12)

| Ecotype/Treatment | Line-7 | Line-8 | Line-9 | Line-10 | Line-11 | Line-12 |
|---|---|---|---|---|---|---|
| 1 | 7.37 | 18.90 | 7.81 | 6.79 | 6.95 | 7.53333 |
| 2 | 0.07 | 0.34 | 0.04 | 0.03 | 0.025 | 0.02833 |
| 3 | 116.00 | 133.17 | 144.58 | 144.92 | 138.5 | 144.167 |
| 4 | 16.17 | 12.50 | 15.33 | 16.83 | 16.6667 | 16.6667 |
| 5 | 5.00 | 1.00 | 8.00 | 9.00 | 8 | 10 |
| 6 | 20.00 | 14.00 | 17.00 | 21.00 | 18 | 19 |
| 7 | 6.00 | 11.00 | 6.00 | 5.00 | 4 | 6 |
| 8 | 78.00 | 127.00 | 42.00 | 34.00 | 23 | 38 |
| 9 | 4.40 | 8.40 | 3.00 | 2.60 | 2.1 | 2.8 |
| 10 | 15.17 | 30.67 | 35.17 | 29.83 | 30.8333 | 29.3333 |
| 11 | 37.58 | 38.72 | 32.85 | 28.77 | 25.3 | 26.3833 |
| 12 | 5.10 | 4.67 | 3.85 | 4.43 | 4.11667 | 4.11667 |
| 13 | 17.67 | 14.33 | 10.33 | 13.83 | 10.3333 | 11 |
| 14 | 14.00 | 29.83 | 17.33 | 12.83 | 11.1667 | 13 |
| 15 | 28.25 | 33.42 | 14.27 | 9.83 | 8.6 | 10.9833 |
| 16 | 4.95 | 4.48 | 3.67 | 3.98 | 4.03333 | 3.96667 |
| 17 | 14.55 | 12.83 | 10.17 | 12.33 | 10.6667 | 9.83333 |
| 18 | 26.78 | 34.39 | 38.65 | 39.66 | 36.795 | 37.1 |
| 19 | 40.89 | 43.83 | 41.31 | 40.86 | 39.31 | 40.46 |
| 20 | 53.00 | 55.00 | 50.50 | 47.00 | 48 | 49 |
| 21 | 62.50 | 64.00 | 61.00 | 61.00 | 61 | 61 |
| 22 | 0.05 | 0.19 | 0.02 | 0.01 | 0.0098 | 0.00884 |
| 23 | 0.01 | 0.05 | 0.00 | 0.00 | 0.00377 | 0.00296 |
| 24 | 0.00 | 0.01 | 0.00 | 0.00 | 0.00084 | 0.00082 |
| 25 | 33376.44 | 16427.35 | 15747.62 | 18531.77 | 17182.5 | 16833.3 |
| 26 | 7906.66 | 3979.78 | 4609.25 | 5801.02 | 6581.38 | 5656.27 |
| 27 | 2247.01 | 1270.04 | 1560.53 | 1732.85 | 1472.18 | 1560.8 |
| 28 | 1.56 | 2.82 | 3.20 | 2.88 | 3.25697 | 3.27691 |
| 29 | 76.39 | 1338.58 | 76.82 | 34.46 | 28.2774 | 41.3294 |
| 30 | 219.14 | 1518.31 | 162.79 | 82.77 | 75.366 | 83.49 |

Table 28.

TABLE 29

Measured parameters in *B. juncea* accessions at various population densities (line 13-14)

| Ecotype/Treatment | Line-13 | Line-14 |
|---|---|---|
| 1 | 5.44167 | 8.76667 |
| 2 | 0.02417 | 0.06583 |
| 3 | 135.75 | 157.333 |
| 4 | 15.5 | 12.8333 |
| 5 | 8 | 3 |
| 6 | 18 | 16 |
| 7 | 4 | 11 |
| 8 | 25 | 109 |
| 9 | 2.35 | 8 |
| 10 | 25.3333 | 33.8333 |
| 11 | 25.0667 | 45.25 |
| 12 | 4.23333 | 4.43333 |
| 13 | 10.6667 | 13.1667 |
| 14 | 9 | 18.5 |
| 15 | 6.35 | 21.5833 |
| 16 | 3.7 | 4.71667 |
| 17 | 9 | 11.1667 |
| 18 | 37.61 | 37.545 |
| 19 | 47.48 | 39.21 |
| 20 | 49 | 51.5 |
| 21 | 61 | 61 |
| 22 | 0.00839 | 0.03974 |
| 23 | 0.00253 | 0.01152 |
| 24 | 0.00073 | 0.0034 |
| 25 | 23055.7 | 20833.3 |
| 26 | 6882.52 | 6039.66 |
| 27 | 2005.71 | 1780.97 |
| 28 | 3.43024 | 2.77362 |
| 29 | 92.8963 | 218.155 |
| 30 | 143.902 | 328.97 |

Table 29: Provided are the values of each of the parameters (as described above) measured in *B. juncea* (grown in seven population densities (Populat. Density) under normal conditions.
Param. = parameter.

Example 8

Production of *Sorghum* Transcriptome and High Throughput Correlation Analysis with Abst Related Parameters Using 44K *Sorghum* Oligonucleotide Micro-Arrays In order to produce a high throughput correlation analysis between plant phenotype and gene expression level, the present inventors utilized a *sorghum* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 *sorghum* genes and transcripts. In order to define correlations between the levels of RNA expression with ABST, yield and NUE components or vigor related parameters, various plant characteristics of 17 different *sorghum* hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of *Sorghum* Varieties Across Ecotypes Grown Under Regular Growth Conditions, Severe Drought Conditions and Low Nitrogen Conditions Experimental Procedures 17 *Sorghum* varieties were grown in 3 repetitive plots, in field. Briefly, the growing protocol was as follows:

1. Regular growth conditions: *sorghum* plants were grown in the field using commercial fertilization and irrigation protocols (370 liter per meter$^2$, fertilization of 14 units of 21% urea per entire growth period).

TABLE 30

Correlation between the expression level of selected genes of some embodiments of the invention in various tissues and the phenotypic performance under normal conditions at different densities across *B. Juncea* accessions

| Gene Name | R | P value | Exp. set | Corr. Set ID | Gene Name | R | P value | Exp. set | Corr. Set ID |
|---|---|---|---|---|---|---|---|---|---|
| LYD537 | 0.90 | 6.06E−03 | 2 | 9 | LYD537 | 0.89 | 6.54E−03 | 2 | 8 |
| LYD537 | 0.94 | 1.69E−03 | 2 | 1 | LYD537 | 0.88 | 9.11E−03 | 2 | 7 |
| LYD537 | 0.89 | 7.83E−03 | 2 | 15 | LYD537 | 0.76 | 4.62E−02 | 2 | 16 |
| LYD537 | 0.99 | 4.02E−05 | 2 | 24 | LYD537 | 0.97 | 2.88E−04 | 2 | 13 |
| LYD537 | 0.98 | 1.22E−04 | 2 | 29 | LYD537 | 0.75 | 5.44E−02 | 2 | 11 |
| LYD537 | 0.98 | 8.94E−05 | 2 | 2 | LYD537 | 0.83 | 2.18E−02 | 2 | 14 |
| LYD537 | 0.99 | 4.94E−05 | 2 | 23 | LYD537 | 0.97 | 2.91E−04 | 2 | 30 |
| LYD537 | 0.88 | 8.80E−03 | 2 | 21 | LYD537 | 0.98 | 5.98E−05 | 2 | 22 |
| LYD537 | 0.82 | 2.42E−02 | 2 | 17 | LYD538 | 0.82 | 2.28E−02 | 2 | 9 |
| LYD538 | 0.81 | 2.80E−02 | 2 | 8 | LYD538 | 0.89 | 7.67E−03 | 2 | 1 |
| LYD538 | 0.82 | 2.47E−02 | 2 | 7 | LYD538 | 0.81 | 2.78E−02 | 2 | 15 |
| LYD538 | 0.94 | 1.52E−03 | 2 | 24 | LYD538 | 0.95 | 1.10E−03 | 2 | 13 |
| LYD538 | 0.94 | 1.59E−03 | 2 | 29 | LYD538 | 0.94 | 1.59E−03 | 2 | 2 |
| LYD538 | 0.73 | 6.00E−02 | 2 | 14 | LYD538 | 0.94 | 1.71E−03 | 2 | 23 |
| LYD538 | 0.92 | 3.68E−03 | 2 | 30 | LYD538 | 0.93 | 2.62E−03 | 2 | 21 |
| LYD538 | 0.94 | 1.94E−03 | 2 | 22 | LYD538 | 0.75 | 5.03E−02 | 2 | 17 |
| LYD539 | 0.70 | 7.93E−02 | 2 | 9 | LYD539 | 0.80 | 3.23E−02 | 2 | 8 |
| LYD539 | 0.80 | 3.12E−02 | 2 | 15 | LYD539 | 0.92 | 3.61E−03 | 2 | 16 |
| LYD539 | 0.93 | 2.08E−03 | 2 | 12 | LYD539 | 0.85 | 1.43E−02 | 2 | 11 |
| LYD539 | 0.76 | 4.93E−02 | 2 | 14 | LYD540 | 0.78 | 3.84E−02 | 2 | 6 |
| LYD540 | 0.88 | 9.11E−03 | 2 | 5 | | | | | |

Table 30. Provided are the correlations (R) between the expression levels of yield improving genes and their homologues in tissues [meristem and flower; Expression sets (Exp)] and the phenotypic performance in various yield, biomass, growth rate and/or vigor components [Correlation vector (corr.)] under stress conditions or normal conditions across *B. juncea* accessions. P = p value.

2. Drought conditions: *sorghum* seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions: *sorghum* plants were fertilized with 50% less amount of nitrogen in the field than the amount of nitrogen applied in the regular growth treatment. All the fertilizer was applied before flowering.

Analyzed *Sorghum* tissues—All 10 selected *Sorghum* hybrids were sample per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 31 below.

TABLE 31

*Sorghum* transcriptome expression sets

| Expression Set | Set ID |
|---|---|
| Flag leaf Normal | 1 |
| Flower meristem Normal | 2 |
| Flower Normal | 3 |
| Flag leaf Low Nitrogen | 4 |
| Flower meristem Low Nitrogen | 5 |
| Flower Low Nitrogen | 6 |
| Flag leaf Drought | 7 |
| Flower meristem Drought | 8 |
| Flower Drought | 9 |

Table 31: Provided are the *sorghum* transcriptome expression sets 1, 2, 3 and 4.
Flag leaf = the leaf below the flower;
Flower meristem = Apical meristem following panicle initiation;
Flower = the flower at the anthesis day.
Expression sets 1, 2 and 3 are from plants grown under normal conditions.
Expression sets 4-6 derived from plants grown under low Nitrogen conditions.
Expression sets 7-9 are from plants grown under drought conditions.

The following parameters were collected using digital imaging system:

At the end of the growing period the grains were separated from the Plant 'Head' and the following parameters were measured and collected:

Average Grain Area ($cm^2$)—A sample of ~200 grains were weighted, photographed and images were processed using the below described image processing system. The grain area was measured from those images and was divided by the number of grains.

(I) Upper and Lower Ratio Average of Grain Area, width, diameter and perimeter—Grain projection of area, width, diameter and perimeter were extracted from the digital images using open source package imagej (nih). Seed data was analyzed in plot average levels as follows:

Average of all seeds;

Average of upper 20% fraction—contained upper 20% fraction of seeds;

Average of lower 20% fraction—contained lower 20% fraction of seeds;

Further on, ratio between each fraction and the plot average was calculated for each of the data parameters.

At the end of the growing period 5 'Heads' were, photographed and images were processed using the below described image processing system.

(II) Head Average Area ($cm^2$)—At the end of the growing period 5 'Heads' were, photographed and images were processed using the below described image processing system. The 'Head' area was measured from those images and was divided by the number of 'Heads'.

(III) Head Average Length (cm)—At the end of the growing period 5 'Heads' were, photographed and images were processed using the below described image processing system. The 'Head' length (longest axis) was measured from those images and was divided by the number of 'Heads'.

(IV) Head Average width (cm)—At the end of the growing period 5 'Heads' were, photographed and images were processed using the below described image processing system. The 'Head' width was measured from those images and was divided by the number of 'Heads'.

(V) Head Average width (cm)—At the end of the growing period 5 'Heads' were, photographed and images were processed using the below described image processing system. The 'Head' perimeter was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight/Head (gr.) (grain yield)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head/Plant gram—At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr. based on plot) and for 5 (FW Head/Plant gr. based on 5 plants).

Plant height—Plants were characterized for height during growing period at 5 time points. In each measure, plants were measured for their height using a measuring tape. Height was measured from ground level to top of the longest leaf.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative fresh weight and Heads—At the end of the experiment (when Inflorescence were dry) all Inflorescence and vegetative material from plots within blocks A-C were collected. The biomass and Heads weight of each plot was separated, measured and divided by the number of Heads.

Plant biomass (Fresh weight)—At the end of the experiment (when Inflorescence were dry) the vegetative material from plots within blocks A-C were collected. The plants biomass without the Inflorescence were measured and divided by the number of Plants.

FW Heads/(FW Heads+FW Plants)—The total fresh weight of heads and their respective plant biomass were measured at the harvest day. The heads weight was divided by the sum of weights of heads and plants.

Experimental Results 17 different *sorghum* varieties were grown and characterized for different parameters: The average for each of the measured parameter was calculated using the JMP software (Tables 33-34) and a subsequent correlation analysis between the various transcriptome expression sets (Table 31) and the average parameters (Tables 33-34), was conducted (Table 35). Results were then integrated to the database.

TABLE 32

*Sorghum* correlated parameters (vectors)

| Correlated parameter with | Correlation ID |
|---|---|
| Total grain weight/Head gr (based on plot), Normal | 1 |
| Total grain weight/Head gr (based on 5 heads), Normal | 2 |
| Head Average Area (cm$^2$), Normal | 3 |
| Head Average Perimeter (cm), Normal | 4 |
| Head Average Length (cm), Normal | 5 |
| Head Average Width (cm), Normal | 6 |
| Average Grain Area (cm$^2$), Normal | 7 |
| Upper Ratio Average Grain Area, Normal | 8 |
| Lower Ratio Average Grain Area, Normal | 9 |
| Lower Ratio Average Grain Perimeter, Normal | 10 |
| Lower Ratio Average Grain Length, Normal | 11 |
| Lower Ratio Average Grain Width, Normal | 12 |
| Final Plant Height (cm), Normal | 13 |
| FW - Head/Plant gr (based on 5 plants), Normal | 14 |
| FW - Head/Plant gr (based on plot), Normal | 15 |
| FW/Plant gr (based on plot), Normal | 16 |
| Leaf SPAD 64 DPS (Days Post Sowing), Normal | 17 |
| FW Heads/(FW Heads + FW Plants) (all plot), Normal | 18 |
| [Plant biomass (FW)/SPAD 64 DPS], Normal | 19 |
| [Grain Yield + plant biomass/SPAD 64 DPS], Normal | 20 |
| [Grain yield/SPAD 64 DPS], Normal | 21 |
| Total grain weight/Head (based on plot) gr, Low N | 22 |

TABLE 32-continued

*Sorghum* correlated parameters (vectors)

| Correlated parameter with | Correlation ID |
|---|---|
| Total grain weight/Head gr (based on 5 heads), Low N | 23 |
| Head Average Area (cm$^2$), Low N | 24 |
| Head Average Perimeter (cm), Low N | 25 |
| Head Average Length (cm), Low N | 26 |
| Head Average Width (cm), Low N | 27 |
| Average Grain Area (cm$^2$), Low N | 28 |
| Upper Ratio Average Grain Area, Low N | 29 |
| Lower Ratio Average Grain Area, Low N | 30 |
| Lower Ratio Average Grain Perimeter, Low N | 31 |
| Lower Ratio Average Grain Length, Low N | 32 |
| Lower Ratio Average Grain Width, Low N | 33 |
| Final Plant Height (cm), Low N | 34 |
| FW - Head/Plant gr (based on 5 plants), Low N | 35 |
| FW - Head/Plant gr (based on plot), Low N | 36 |
| FW/Plant gr (based on plot), Low N | 37 |
| Leaf SPAD 64 DPS (Days Post Sowing), Low N | 38 |
| FW Heads/(FW Heads + FW Plants)(all plot), Low N | 39 |
| [Plant biomass (FW)/SPAD 64 DPS], Low N | 40 |
| [Grain Yield + plant biomass/SPAD 64 DPS], Low N | 41 |
| [Grain yield/SPAD 64 DPS], Low N | 42 |
| Total grain weight/Head gr (based on plot) Drought | 43 |
| Head Average Area (cm$^2$), Drought | 44 |
| Head Average Perimeter (cm), Drought | 45 |
| Head Average Length (cm), Drought | 46 |
| Head Average Width (cm), Drought | 47 |
| Average Grain Area (cm$^2$), Drought | 48 |
| Upper Ratio Average Grain Area, Drought | 49 |
| Final Plant Height (cm), Drought | 50 |
| FW - Head/Plant gr (based on plot), Drought | 51 |
| FW/Plant gr (based on plot), Drought | 52 |
| Leaf SPAD 64 DPS (Days Post Sowing), Drought | 53 |
| FW Heads/(FW Heads + FW Plants)(all plot), Drought | 54 |
| [Plant biomass (FW)/SPAD 64 DPS], Drought | 55 |

Table 32. Provided are the *Sorghum* correlated parameters (vectors).
"gr." = grams;
"SPAD" = chlorophyll levels;
"FW" = Plant Fresh weight;
"normal" = standard growth conditions.

TABLE 33

Measured parameters in Sorghum accessions

| Ecotype/Treatment | Line-1 | Line-2 | Line-3 | Line-4 | Line-5 | Line-6 | Line-7 | Line-8 | Line-9 |
|---|---|---|---|---|---|---|---|---|---|
| 1 | 31.12 | 26.35 | 18.72 | 38.38 | 26.67 | 28.84 | 47.67 | 31.00 | 39.99 |
| 2 | 47.40 | 46.30 | 28.37 | 70.40 | 32.15 | 49.23 | 63.45 | 44.45 | 56.65 |
| 3 | 120.14 | 167.60 | 85.14 | 157.26 | 104.00 | 102.48 | 168.54 | 109.32 | 135.13 |
| 4 | 61.22 | 67.90 | 56.26 | 65.38 | 67.46 | 67.46 | 74.35 | 56.16 | 61.64 |
| 5 | 25.58 | 26.84 | 21.02 | 26.84 | 23.14 | 21.82 | 31.33 | 23.18 | 25.70 |
| 6 | 5.97 | 7.92 | 4.87 | 7.43 | 5.58 | 5.88 | 6.78 | 5.99 | 6.62 |
| 7 | 0.10 | 0.11 | 0.13 | 0.13 | 0.14 | 0.14 | 0.11 | 0.11 | 0.10 |
| 8 | 1.22 | 1.30 | 1.13 | 1.14 | 1.16 | 1.15 | 1.19 | 1.23 | 1.25 |
| 9 | 0.83 | 0.74 | 0.78 | 0.80 | 0.70 | 0.70 | 0.83 | 0.81 | 0.84 |
| 10 | 0.91 | 0.87 | 0.91 | 0.95 | 0.90 | 0.91 | 0.91 | 0.91 | 0.92 |
| 11 | 0.91 | 0.88 | 0.92 | 0.91 | 0.89 | 0.88 | 0.91 | 0.90 | 0.92 |
| 12 | 0.91 | 0.83 | 0.85 | 0.87 | 0.79 | 0.80 | 0.90 | 0.89 | 0.91 |
| 13 | 95.25 | 79.20 | 197.85 | 234.20 | 189.40 | 194.67 | 117.25 | 92.80 | 112.65 |
| 14 | 406.50 | 518.00 | 148.00 | 423.00 | 92.00 | 101.33 | 423.50 | 386.50 | 409.50 |
| 15 | 175.15 | 223.49 | 56.40 | 111.62 | 67.34 | 66.90 | 126.18 | 107.74 | 123.86 |
| 16 | 162.56 | 212.59 | 334.83 | 313.46 | 462.28 | 318.26 | 151.13 | 137.60 | 167.98 |
| 17 | 43.01 | . | 43.26 | 44.74 | 45.76 | 41.61 | 45.21 | 45.14 | 43.03 |
| 18 | 0.51 | 0.51 | 0.12 | 0.26 | 0.12 | 0.18 | 0.46 | 0.43 | 0.42 |
| 19 | 0.72 | 0.43 | 0.86 | 0.58 | 0.69 | 1.05 | 0.69 | 0.93 | 0.84 |
| 20 | 4.50 | 8.17 | 7.87 | 10.68 | 8.34 | 4.40 | 3.74 | 4.83 | 3.67 |
| 21 | 3.78 | 7.74 | 7.01 | 10.10 | 7.65 | 3.34 | 3.05 | 3.90 | 2.83 |
| 22 | 25.95 | 30.57 | 19.37 | 35.62 | 25.18 | 22.18 | 49.96 | 27.48 | 51.12 |
| 23 | 50.27 | 50.93 | 36.13 | 73.10 | 37.87 | 36.40 | 71.67 | 35.00 | 76.73 |
| 24 | 96.24 | 214.72 | 98.59 | 182.83 | 119.64 | 110.19 | 172.36 | 84.81 | 156.25 |
| 25 | 56.32 | 79.20 | 53.25 | 76.21 | 67.27 | 59.49 | 79.28 | 51.52 | 69.88 |
| 26 | 23.22 | 25.58 | 20.93 | 28.43 | 24.32 | 22.63 | 32.11 | 20.38 | 26.69 |
| 27 | 5.26 | 10.41 | 5.93 | 8.25 | 6.19 | 6.12 | 6.80 | 5.25 | 7.52 |
| 28 | 0.11 | 0.11 | 0.14 | 0.12 | 0.14 | 0.13 | 0.12 | 0.12 | 0.12 |

TABLE 33-continued

Measured parameters in Sorghum accessions

| Ecotype/Treatment | Line-1 | Line-2 | Line-3 | Line-4 | Line-5 | Line-6 | Line-7 | Line-8 | Line-9 |
|---|---|---|---|---|---|---|---|---|---|
| 29 | 1.18 | 1.31 | 1.11 | 1.21 | 1.19 | 1.18 | 1.16 | 1.23 | 1.17 |
| 30 | 0.82 | 0.77 | 0.81 | 0.79 | 0.78 | 0.80 | 0.83 | 0.79 | 0.81 |
| 31 | 0.90 | 0.88 | 0.92 | 0.90 | 0.92 | 0.92 | 0.92 | 0.89 | 0.90 |
| 32 | 0.91 | 0.90 | 0.92 | 0.90 | 0.91 | 0.93 | 0.92 | 0.89 | 0.90 |
| 33 | 0.90 | 0.85 | 0.89 | 0.88 | 0.86 | 0.87 | 0.91 | 0.89 | 0.90 |
| 34 | 104.00 | 80.93 | 204.73 | 125.40 | 225.40 | 208.07 | 121.40 | 100.27 | 121.13 |
| 35 | 388.00 | 428.67 | 297.67 | 280.00 | 208.33 | 303.67 | 436.00 | 376.33 | 474.67 |
| 36 | 214.78 | 205.05 | 73.49 | 122.96 | 153.07 | 93.23 | 134.11 | 77.43 | 129.63 |
| 37 | 204.78 | 199.64 | 340.51 | 240.60 | 537.78 | 359.40 | 149.20 | 129.06 | 178.71 |
| 38 | 38.33 | 38.98 | 42.33 | 40.90 | 43.15 | 39.85 | 42.68 | 43.31 | 39.01 |
| 39 | 0.51 | 0.51 | 0.17 | 0.39 | 0.21 | 0.19 | 0.48 | 0.37 | 0.42 |
| 40 | 5.34 | 5.12 | 8.05 | 5.88 | 12.46 | 9.02 | 3.50 | 2.98 | 4.58 |
| 41 | 6.02 | 5.91 | 8.50 | 6.75 | 13.05 | 9.58 | 4.67 | 3.61 | 5.89 |
| 42 | 0.68 | 0.78 | 0.46 | 0.87 | 0.58 | 0.56 | 1.17 | 0.63 | 1.31 |
| 43 | 22.11 | 16.77 | 9.19 | 104.44 | 3.24 | 22.00 | 9.97 | 18.58 | 29.27 |
| 44 | 83.14 | 107.79 | 88.68 | 135.91 | 90.76 | 123.95 | 86.06 | 85.20 | 113.10 |
| 45 | 52.78 | 64.49 | 56.59 | 64.37 | 53.21 | 71.66 | 55.61 | 52.96 | 69.83 |
| 46 | 21.63 | 21.94 | 21.57 | 22.01 | 20.99 | 28.60 | 21.35 | 20.81 | 24.68 |
| 47 | 4.83 | 6.31 | 5.16 | 7.78 | 5.28 | 5.49 | 5.04 | 5.07 | 5.77 |
| 48 | 0.10 | 0.11 | 0.11 | 0.09 | 0.09 | 0.11 | | | |
| 49 | 1.31 | 1.19 | 1.29 | 1.46 | 1.21 | 1.21 | | | |
| 50 | 89.40 | 75.73 | 92.10 | 94.30 | 150.80 | 110.73 | 99.20 | 84.00 | 99.00 |
| 51 | 154.90 | 122.02 | 130.51 | 241.11 | 69.03 | 186.41 | 62.11 | 39.02 | 58.94 |
| 52 | 207.99 | 138.02 | 255.41 | 402.22 | 233.55 | 391.75 | 89.31 | 50.61 | 87.02 |
| 53 | 40.58 | 40.88 | 45.01 | 42.30 | 45.24 | 40.56 | 44.80 | 45.07 | 40.65 |
| 54 | 0.42 | 0.47 | 0.42 | 0.37 | 0.23 | 0.31 | 0.41 | 0.44 | 0.40 |
| 55 | 5.13 | 3.38 | 5.67 | 9.51 | 5.16 | 9.66 | 1.99 | 1.12 | 2.14 |

Table 33: Provided are the values of each of the parameters (as described above) measured in Sorghum accessions (ecotype) under normal, low nitrogen and drought conditions. Growth conditions are specified in the experimental procedure section.

TABLE 34

Additional measured parameters in Sorghum accessions

| | Treatment | | | | | | | |
|---|---|---|---|---|---|---|---|---|
| Ecotype | Line-10 | Line-11 | Line-12 | Line-13 | Line-14 | Line-15 | Line-16 | Line-17 |
| 1 | 38.36 | 32.10 | 32.69 | 32.79 | 51.53 | 35.71 | 38.31 | 42.44 |
| 2 | 60.00 | 45.45 | 58.19 | 70.60 | 70.10 | 53.95 | 59.87 | 52.65 |
| 3 | 169.03 | 156.10 | 112.14 | 154.74 | 171.70 | 168.51 | 162.51 | 170.46 |
| 4 | 71.40 | 68.56 | 56.44 | 67.79 | 71.54 | 78.94 | 67.03 | 74.11 |
| 5 | 28.82 | 28.13 | 22.97 | 28.09 | 30.00 | 30.54 | 27.17 | 29.26 |
| 6 | 7.42 | 6.98 | 6.19 | 7.02 | 7.18 | 7.00 | 7.39 | 7.35 |
| 7 | 0.12 | 0.12 | 0.11 | 0.12 | 0.11 | 0.10 | 0.11 | 0.11 |
| 8 | 1.24 | 1.32 | 1.22 | 1.18 | 1.18 | 1.22 | 1.25 | 1.22 |
| 9 | 0.79 | 0.77 | 0.80 | 0.81 | 0.82 | 0.81 | 0.82 | 0.82 |
| 10 | 0.93 | 0.91 | 0.92 | 0.90 | 0.91 | 0.90 | 0.91 | 0.91 |
| 11 | 0.92 | 0.89 | 0.91 | 0.91 | 0.91 | 0.90 | 0.91 | 0.91 |
| 12 | 0.85 | 0.86 | 0.88 | 0.90 | 0.90 | 0.91 | 0.90 | 0.90 |
| 13 | 97.50 | 98.00 | 100.00 | 105.60 | 151.15 | 117.10 | 124.45 | 126.50 |
| 14 | 328.95 | 391.00 | 435.75 | 429.50 | 441.00 | 415.75 | 429.50 | 428.50 |
| 15 | 102.75 | 82.33 | 77.59 | 91.17 | 150.44 | 109.10 | 107.58 | 130.88 |
| 16 | 128.97 | 97.62 | 99.32 | 112.24 | 157.42 | 130.55 | 135.66 | 209.21 |
| 17 | 45.59 | 44.83 | 45.33 | 46.54 | 43.99 | 45.09 | 45.14 | 43.13 |
| 18 | 0.44 | 0.46 | 0.45 | 0.45 | 0.51 | 0.46 | 0.44 | 0.39 |
| 19 | 0.72 | 0.72 | 0.70 | 1.17 | 0.79 | 0.85 | 0.98 | |
| 20 | 2.89 | 2.91 | 3.12 | 4.75 | 3.69 | 3.85 | 5.84 | |
| 21 | 2.18 | 2.19 | 2.41 | 3.58 | 2.90 | 3.01 | 4.85 | |
| 22 | 36.84 | 29.45 | 26.70 | 29.42 | 51.12 | 37.04 | 39.85 | 41.78 |
| 23 | 57.58 | 42.93 | 36.47 | 68.60 | 71.80 | 49.27 | 43.87 | 52.07 |
| 24 | 136.71 | 137.70 | 96.54 | 158.19 | 163.95 | 138.39 | 135.46 | 165.64 |
| 25 | 66.17 | 67.37 | 57.90 | 70.61 | 73.76 | 66.87 | 65.40 | 75.97 |
| 26 | 26.31 | 25.43 | 23.11 | 27.87 | 28.88 | 27.64 | 25.52 | 30.33 |
| 27 | 6.59 | 6.85 | 5.32 | 7.25 | 7.19 | 6.27 | 6.57 | 6.82 |
| 28 | 0.13 | 0.13 | 0.12 | 0.12 | 0.11 | 0.11 | 0.12 | 0.11 |
| 29 | 1.22 | 1.24 | 1.19 | 1.23 | 1.16 | 1.34 | 1.21 | 1.21 |
| 30 | 0.77 | 0.74 | 0.80 | 0.79 | 0.82 | 0.80 | 0.81 | 0.81 |
| 31 | 0.91 | 0.89 | 0.90 | 0.90 | 0.91 | 0.89 | 0.90 | 0.90 |
| 32 | 0.91 | 0.89 | 0.90 | 0.89 | 0.91 | 0.89 | 0.89 | 0.90 |
| 33 | 0.86 | 0.84 | 0.90 | 0.89 | 0.91 | 0.90 | 0.90 | 0.90 |
| 34 | 94.53 | 110.00 | 115.07 | 104.73 | 173.67 | 115.60 | 138.80 | 144.40 |
| 35 | 437.67 | 383.00 | 375.00 | 425.00 | 434.00 | 408.67 | 378.50 | 432.00 |
| 36 | 99.83 | 76.95 | 84.25 | 92.24 | 138.83 | 113.32 | 95.50 | 129.49 |

TABLE 34-continued

Additional measured parameters in *Sorghum* accessions

| Ecotype | Line-10 | Line-11 | Line-12 | Line-13 | Line-14 | Line-15 | Line-16 | Line-17 |
|---|---|---|---|---|---|---|---|---|
| 37 | 124.27 | 101.33 | 132.12 | 117.90 | 176.99 | 143.67 | 126.98 | 180.45 |
| 38 | 42.71 | 40.08 | 43.98 | 45.44 | 44.75 | 42.58 | 43.81 | 46.73 |
| 39 | 0.44 | 0.43 | 0.39 | 0.44 | 0.44 | 0.44 | 0.43 | 0.42 |
| 40 | 2.91 | 2.53 | 3.00 | 2.60 | 3.96 | 3.38 | 2.90 | 3.86 |
| 41 | 3.77 | 3.26 | 3.61 | 3.24 | 5.10 | 4.25 | 3.81 | 4.76 |
| 42 | 0.86 | 0.73 | 0.61 | 0.65 | 1.14 | 0.87 | 0.91 | 0.89 |
| 43 | 10.45 | 14.77 | 12.86 | 18.24 | 11.60 | 18.65 | 16.36 | |
| 44 | 100.79 | 80.41 | 126.89 | 86.41 | 92.29 | 77.89 | 76.93 | |
| 45 | 65.14 | 55.27 | 69.06 | 53.32 | 56.29 | 49.12 | 51.88 | |
| 46 | 24.28 | 21.95 | 24.98 | 19.49 | 20.42 | 16.81 | 18.88 | |
| 47 | 5.37 | 4.66 | 6.35 | 5.58 | 5.76 | 5.86 | 5.10 | |
| 48 | | | | | | | | |
| 49 | | | | | | | | |
| 50 | 92.20 | 81.93 | 98.80 | 86.47 | 99.60 | 83.00 | 83.53 | 92.30 |
| 51 | 76.37 | 33.47 | 42.20 | 41.53 | 131.67 | 60.84 | 44.33 | 185.44 |
| 52 | 120.43 | 37.21 | 48.18 | 44.20 | 231.60 | 116.01 | 123.08 | 342.50 |
| 53 | 45.43 | 42.58 | 44.18 | 44.60 | 42.41 | 43.25 | 40.30 | 40.75 |
| 54 | 0.44 | 0.47 | 0.47 | 0.48 | 0.35 | 0.35 | 0.23 | 0.33 |
| 55 | 2.65 | 0.87 | 1.09 | 0.99 | 5.46 | 2.68 | 3.05 | 8.40 |

Table 34: Provided are the values of each of the parameters (as described above) measured in *Sorghum* accessions (ecotype) under normal, low nitrogen and drought conditions. Growth conditions are specified in the experimental procedure section.

TABLE 35

Correlation between the expression level of selected genes of some embodiments of the invention in various tissues and the phenotypic performance under normal or abiotic stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LYD604 | 0.71 | 3.28E−02 | 1 | 20 | LYD605 | 0.72 | 2.91E−02 | 1 | 21 |
| LYD605 | 0.73 | 2.49E−02 | 1 | 20 | LYD606 | 0.73 | 1.60E−02 | 3 | 13 |
| LYD606 | 0.90 | 4.05E−04 | 3 | 1 | LYD606 | 0.70 | 2.31E−02 | 3 | 9 |
| LYD606 | 0.90 | 4.24E−04 | 8 | 53 | LYD606 | 0.76 | 1.04E−02 | 6 | 30 |
| LYD606 | 0.70 | 2.29E−02 | 6 | 33 | LYD606 | 0.78 | 8.33E−03 | 6 | 32 |
| LYD606 | 0.82 | 3.87E−03 | 6 | 31 | LYD606 | 0.81 | 7.55E−03 | 1 | 21 |
| LYD606 | 0.84 | 4.28E−03 | 1 | 20 | LYD606 | 0.92 | 1.57E−04 | 9 | 50 |
| LYD606 | 0.72 | 1.90E−02 | 7 | 51 | LYD607 | 0.71 | 2.11E−02 | 2 | 13 |
| LYD607 | 0.71 | 2.10E−02 | 2 | 1 | LYD607 | 0.82 | 3.42E−03 | 4 | 29 |
| LYD607 | 0.86 | 1.33E−03 | 5 | 22 | LYD607 | 0.85 | 1.86E−03 | 5 | 42 |
| LYD607 | 0.80 | 5.95E−03 | 5 | 34 | LYD608 | 0.88 | 9.15E−04 | 2 | 8 |
| LYD608 | 0.82 | 4.05E−03 | 2 | 7 | LYD608 | 0.86 | 1.29E−03 | 4 | 29 |
| LYD608 | 0.71 | 2.22E−02 | 4 | 27 | LYD608 | 0.77 | 8.57E−03 | 6 | 39 |
| LYD608 | 0.75 | 1.30E−02 | 6 | 32 | LYD608 | 0.72 | 1.77E−02 | 5 | 28 |
| LYD608 | 0.80 | 9.74E−03 | 1 | 21 | LYD608 | 0.83 | 5.67E−03 | 1 | 20 |
| LYD609 | 0.76 | 1.04E−02 | 2 | 1 | LYD609 | 0.79 | 6.60E−03 | 8 | 55 |
| LYD609 | 0.71 | 2.15E−02 | 8 | 51 | LYD609 | 0.80 | 5.47E−03 | 8 | 52 |
| LYD609 | 0.74 | 1.46E−02 | 5 | 36 | LYD609 | 0.74 | 1.38E−02 | 5 | 41 |
| LYD609 | 0.76 | 1.04E−02 | 5 | 37 | LYD610 | 0.89 | 6.35E−04 | 4 | 22 |
| LYD610 | 0.78 | 7.43E−03 | 4 | 26 | LYD610 | 0.83 | 2.67E−03 | 4 | 42 |
| LYD610 | 0.71 | 2.21E−02 | 4 | 31 | LYD610 | 0.81 | 4.83E−03 | 4 | 34 |
| LYD610 | 0.78 | 1.41E−02 | 8 | 43 | LYD610 | 0.77 | 1.61E−02 | 1 | 21 |
| LYD610 | 0.78 | 7.89E−03 | 1 | 15 | LYD610 | 0.77 | 1.48E−02 | 1 | 20 |

Table 35. Provided are the correlations (R) between the expression levels of yield improving genes and their homologues in tissues [Flag leaf, Flower meristem, stem and Flower; Expression sets (Exp)] and the phenotypic performance in various yield, biomass, growth rate and/or vigor components [Correlation vector (corr.)] under stress conditions (e.g., drought and low nitrogen) or normal conditions across *Sorghum* accessions.
P = p value.

Example 9

Production of Soybean (*Glycine max*) Transcriptome and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 42,000 Soybean genes and transcripts. In order to define correlations between the levels of RNA expression with yield components or plant architecture related parameters or plant vigor related parameters, various plant characteristics of 29 different *Glycine max* varieties were analyzed and 12 varieties were further used for RNA expression analysis. The correlation between the RNA levels and the characterized parameters was analyzed using Pearson correlation test.

Correlation of *Glycine max* Genes' Expression Levels with Phenotypic Characteristics Across Ecotype Experimental Procedures 29 Soybean varieties were grown in three repetitive plots, in field. Briefly, the growing protocol was as follows: Soybean seeds were sown in soil and grown under normal conditions until harvest. In order to define correlations between the levels of RNA expression with yield components or plant architecture related parameters or vigor related parameters, 12 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds).

TABLE 36

Soybean transcriptome expression sets

| Expression Set | Set ID |
|---|---|
| Apical meristem at vegetative stage under normal growth condition | 1 |
| Leaf at vegetative stage under normal growth condition | 2 |
| Leaf at flowering stage under normal growth condition | 3 |
| Leaf at pod setting stage under normal growth condition | 4 |
| Root at vegetative stage under normal growth condition | 5 |
| Root at flowering stage under normal growth condition | 6 |
| Root at pod setting stage under normal growth condition | 7 |
| Stem at vegetative stage under normal growth condition | 8 |
| Stem at pod setting stage under normal growth condition | 9 |
| Flower bud at flowering stage under normal growth condition | 10 |
| Pod (R3-R4) at pod setting stage under normal growth condition | 11 |

Table 36.

RNA extraction—All 12 selected Soybean varieties were sample per treatment. Plant tissues [leaf, root. Stem. Pod, apical meristem. Flower buds] growing under normal conditions were sampled and RNA was extracted as described above.

The collected data parameters were as follows:

Main branch base diameter [mm] at pod set—the diameter of the base of the main branch (based diameter) average of three plants per plot.

Fresh weight [gr/plant] at pod set—total weight of the vegetative portion above ground (excluding roots) before drying at pod set, average of three plants per plot.

Dry weight [gr/plant] at pod set—total weight of the vegetative portion above ground (excluding roots) after drying at 70° C. in oven for 48 hours at pod set, average of three plants per plot.

Total number of nodes with pods on lateral branches [value/plant]—counting of nodes which contain pods in lateral branches at pod set, average of three plants per plot.

Number of lateral branches at pod set [value/plant]—counting number of lateral branches at pod set, average of three plants per plot.

Total weight of lateral branches at pod set [gr/plant]—weight all lateral branches at pod set, average of three plants per plot.

Total weight of pods on main stem at pod set [gr/plant]—weight all pods on main stem at pod set, average of three plants per plot.

Total number of nodes on main stem [value/plant]—count of number of nodes on main stem starting from first node above ground, average of three plants per plot.

Total number of pods with 1 seed on lateral branches at pod set [value/plant]—count the number of pods containing 1 seed in all lateral branches at pod set, average of three plants per plot.

Total number of pods with 2 seeds on lateral branches at pod set [value/plant]—count the number of pods containing 2 seeds in all lateral branches at pod set, average of three plants per plot.

Total number of pods with 3 seeds on lateral branches at pod set [value/plant]—count the number of pods containing 3 seeds in all lateral branches at pod set, average of three plants per plot.

Total number of pods with 4 seeds on lateral branches at pod set [value/plant]—count the number of pods containing 4 seeds in all lateral branches at pod set, average of three plants per plot.

Total number of pods with 1 seed on main stem at pod set [value/plant]—count the number of pods containing 1 seed in main stem at pod set, average of three plants per plot.

Total number of pods with 2 seeds on main stem at pod set [value/plant]—count the number of pods containing 2 seeds in main stem at pod set, average of three plants per plot.

Total number of pods with 3 seeds on main stem at pod set [value/plant]—count the number of pods containing 3 seeds in main stem at pod set, average of three plants per plot.

Total number of pods with 4 seeds on main stem at pod set [value/plant]—count the number of pods containing 4 seeds in main stem at pod set, average of three plants per plot.

Total number of seeds per plant at pod set [value/plant]—count number of seeds in lateral branches and main stem at pod set, average of three plants per plot.

Total number of seeds on lateral branches at pod set [value/plant]—count total number of seeds on lateral branches at pod set, average of three plants per plot.

Total number of seeds on main stem at pod set [value/plant]—count total number of seeds on main stem at pod set, average of three plants per plot.

Plant height at pod set [cm/plant]—total length from above ground till the tip of the main stem at pod set, average of three plants per plot.

Plant height at harvest [cm/plant]—total length from above ground till the tip of the main stem at harvest, average of three plants per plot.

Total weight of pods on lateral branches at pod set [gr/plant]—weight of all pods on lateral branches at pod set, average of three plants per plot.

Ratio of the number of pods per node on main stem at pod set—calculated in Formula X, average of three plants per plot.

Total number of pods on main stem/Total number of nodes on main stem, average of three plants per plot.   Formula X Ratio of total number of seeds in main stem to number of seeds on lateral branches—calculated in formula XI, average of three plants per plot.

Total number of seeds on main stem at pod set/Total number of seeds on lateral branches at pod set.   Formula XI Total weight of pods per plant at pod set [gr/plant]—weight all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, Hypertext Transfer Protocol://World Wide Web (dot) ars-grin (dot) gov/cgi-bin/npgs/html/desclist (dot) pl?51].

Seed quality [ranked 1-5]—measure at harvest, a visual estimate based on several hundred seeds. Parameter is rated according to the following scores considering the amount and degree of wrinkling, defective coat (cracks), greenishness, and moldy or other pigment. Rating is 1-very good, 2-good, 3-fair, 4-poor, 5-very poor.

Lodging [ranked 1-5]—is rated at maturity per plot according to the following scores: 1—most plants in a plot are erected, 2—All plants leaning slightly or a few plants down, 3—all plants leaning moderately, or 25%-50% down, 4—all plants leaning considerably, or 50%-80% down, 5—most plants down. Note: intermediate score such as 1.5 are acceptable.

Seed size [gr]—weight of 1000 seeds per plot normalized to 13% moisture, measure at harvest.

Total weight of seeds per plant [gr/plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Average lateral branch seeds per pod [number]—Calculate Number of Seeds on lateral branches-at pod set and divide by the Number of Total number of pods with seeds on lateral branches-at pod set.

Average main stem seeds per pod [number]—Calculate Total Number of Seeds on main stem at pod set and divide by the Number of Total number of pods with seeds on main stem at pod setting.

Main stem average internode length [cm]—Calculate Plant height at pod set and divide by the Total number of nodes on main stem at pod setting.

Total Number of pods with seeds on main stem [number]—count all pods containing seeds on the main stem at pod setting.

Total Number of pods with seeds on lateral branches [number]—count all pods containing seeds on the lateral branches at pod setting.

Total number of pods per plant at pod set [number]—count pods on main stem and lateral branches at pod setting.

Experimental Results

Twelve different Soybean varieties were grown and characterized for 40 parameters as specified above. The average for each of the measured parameters was calculated using the JMP software and values are summarized in Tables 38-39 below. Subsequent correlation analysis between the various transcriptome expression sets and the average parameters was conducted. Results were then integrated to the database (Table 40).

TABLE 37

| Soybean correlated parameters (vectors) | |
|---|---|
| Correlated parameter with | Correlation ID |
| Base diameter at pod set (mm) | 1 |
| DW at pod set (gr) | 2 |
| fresh weight at pod set (gr) | 3 |
| Total number of nodes with pods on lateral branches (number) | 4 |
| Number of lateral branches (number) | 5 |
| Total weight of lateral branches at pod set (gr) | 6 |
| Total weight of pods on main stem at pod set (gr) | 7 |
| Total number of nodes on main stem (number) | 8 |
| Total no of pods with 1 seed on lateral branch (number) | 9 |
| Number of pods with 1 seed on main stem at pod set (number) | 10 |
| Total no of pods with 2 seed on lateral branch (number) | 11 |
| Number of pods with 2 seed on main stem (number) | 12 |
| Total no of pods with 3 seed on lateral branch (number) | 13 |
| Number of pods with 3 seed on main stem (number) | 14 |
| Total no of pods with 4 seed on lateral branch (number) | 15 |
| Number of pods with 4 seed on main stem (number) | 16 |
| Total number of seeds per plant | 17 |
| Total Number of Seeds on lateral branches | 18 |
| Total Number of Seeds on main stem at pod set | 19 |
| Plant height at pod set (cm) | 20 |
| Total weight of pods on lateral branches (gr) | 21 |
| Ratio number of pods per node on main stem (ratio) | 22 |
| Ratio number of seeds per main stem to seeds per lateral branch (ratio) | 23 |
| Total weight of pods per plant (gr) | 24 |
| 50 percent flowering (days) | 25 |
| Maturity (days) | 26 |
| 100 percent flowering (days) | 27 |
| Plant height at harvest (cm) | 28 |
| Seed quality (score 1-5) | 29 |
| Total weight of seeds per plant (gr/plant ) | 30 |
| Seed size (gr) | 31 |
| Lodging (score 1-5) | 32 |
| yield at harvest (bushel/hectare) | 33 |
| Average lateral branch seeds per pod (number) | 34 |
| Average main stem seeds per pod (number) | 35 |
| Total number of pods with seeds on main stem at pod set (number) | 36 |
| Number pods with seeds on lateral branches-at pod set (number) | 37 |
| Total number of pods per plant at pod set (number) | 38 |
| Main stem average internode length (cm/number) | 39 |
| Corrected Seed size (gr) | 40 |

Table 37.

TABLE 38

Measured parameters in Soybean varieties (lines 1-6)

| Ecotype | Line-1 | Line-2 | Line-3 | Line-4 | Line-5 | Line-6 |
|---|---|---|---|---|---|---|
| 1 | 8.33 | 9.54 | 9.68 | 8.11 | 8.82 | 10.12 |
| 2 | 53.67 | 50.33 | 38.00 | 46.17 | 60.83 | 55.67 |
| 3 | 170.89 | 198.22 | 152.56 | 163.89 | 224.67 | 265.00 |
| 4 | 23.00 | 16.00 | 23.11 | 33.00 | 15.22 | 45.25 |
| 5 | 9.00 | 8.67 | 9.11 | 9.89 | 7.67 | 17.56 |
| 6 | 67.78 | 63.78 | 64.89 | 74.89 | 54.00 | 167.22 |
| 7 | 22.11 | 14.33 | 16.00 | 15.00 | 33.78 | 9.00 |
| 8 | 16.56 | 16.78 | 16.11 | 18.11 | 16.78 | 17.11 |
| 9 | 1.56 | 3.00 | 1.78 | 1.78 | 5.67 | 5.63 |
| 10 | 1.11 | 4.38 | 1.44 | 1.44 | 4.56 | 1.67 |
| 11 | 17.00 | 18.75 | 26.44 | 32.33 | 21.56 | 33.50 |
| 12 | 16.89 | 16.25 | 13.22 | 16.89 | 27.00 | 8.11 |
| 13 | 38.44 | 2.00 | 26.44 | 31.33 | 8.89 | 82.00 |
| 14 | 29.56 | 1.75 | 19.78 | 22.33 | 11.67 | 22.78 |
| 15 | 0.00 | 0.00 | 0.00 | 0.00 | 0.00 | 1.50 |
| 16 | 0.00 | 0.00 | 0.11 | 0.11 | 0.00 | 0.44 |
| 17 | 274.44 | 99.78 | 221.67 | 263.11 | 169.00 | 412.50 |
| 18 | 150.89 | 55.89 | 134.00 | 160.44 | 75.44 | 324.63 |
| 19 | 123.56 | 43.89 | 87.67 | 102.67 | 93.56 | 88.00 |
| 20 | 86.78 | 69.56 | 62.44 | 70.89 | 69.44 | 63.89 |
| 21 | 26.00 | 14.89 | 20.11 | 20.11 | 21.11 | 30.25 |
| 22 | 2.87 | 1.38 | 2.13 | 2.26 | 2.60 | 1.87 |
| 23 | 0.89 | 0.90 | 0.87 | 0.89 | 2.32 | 0.37 |
| 24 | 48.11 | 29.22 | 36.11 | 35.11 | 54.89 | 38.88 |
| 25 | 61.00 | 65.33 | 60.67 | 61.00 | 54.67 | 68.33 |
| 26 | 24.00 | 43.67 | 30.33 | 30.33 | 38.33 | 40.00 |
| 27 | 67.33 | 71.67 | 67.67 | 67.33 | 60.00 | 74.00 |
| 28 | 96.67 | 76.67 | 67.50 | 75.83 | 74.17 | 76.67 |
| 29 | 2.33 | 3.50 | 3.00 | 2.17 | 2.83 | 2.00 |
| 30 | 15.09 | 10.50 | 17.23 | 16.51 | 12.06 | 10.25 |
| 31 | 89.00 | 219.33 | 93.00 | 86.00 | 191.33 | 71.33 |
| 32 | 1.67 | 1.83 | 1.17 | 1.67 | 2.67 | 2.83 |
| 33 | 47.57 | 43.77 | 50.37 | 56.30 | 44.00 | 40.33 |
| 34 | 2.67 | 1.95 | 2.43 | 2.53 | 2.13 | 2.68 |
| 35 | 2.60 | 1.89 | 2.52 | 2.53 | 2.17 | 2.59 |
| 36 | 47.56 | 23.11 | 34.56 | 40.78 | 43.22 | 33.00 |
| 37 | 57.00 | 28.56 | 54.67 | 65.44 | 36.11 | 122.63 |
| 38 | 104.56 | 51.67 | 89.22 | 106.22 | 79.33 | 155.63 |
| 39 | 5.24 | 4.15 | 3.91 | 3.92 | 4.15 | 3.74 |
| 40 | 89.00 | * | 93.00 | 86.00 | * | 71.33 |

Table 38.

TABLE 39

Measured parameters in Soybean varieties (lines 7-12)

| Ecotype | Line-7 | Line-8 | Line-9 | Line-10 | Line-11 | Line-12 |
|---|---|---|---|---|---|---|
| 1 | 8.46 | 8.09 | 8.26 | 7.73 | 8.16 | 7.89 |
| 2 | 48.00 | 52.00 | 44.17 | 52.67 | 56.00 | 47.50 |
| 3 | 160.67 | 196.33 | 155.33 | 178.11 | 204.44 | 164.22 |
| 4 | 8.25 | 25.44 | 21.88 | 16.33 | 22.56 | 24.22 |
| 5 | 11.67 | 12.11 | 8.00 | 9.11 | 6.78 | 10.00 |
| 6 | 45.44 | 83.22 | 64.33 | 52.00 | 76.89 | 67.00 |
| 7 | 9.03 | 16.00 | 15.89 | 14.56 | 30.44 | 18.00 |
| 8 | 18.78 | 18.89 | 16.78 | 21.11 | 19.33 | 20.78 |
| 9 | 2.88 | 3.00 | 1.25 | 2.67 | 1.78 | 3.00 |
| 10 | 4.00 | 4.33 | 2.11 | 1.89 | 3.44 | 1.22 |
| 11 | 8.50 | 22.78 | 21.75 | 10.67 | 23.78 | 25.67 |
| 12 | 21.33 | 17.67 | 20.33 | 16.11 | 28.11 | 16.56 |
| 13 | 9.00 | 42.11 | 32.75 | 25.67 | 45.00 | 44.33 |
| 14 | 11.11 | 28.22 | 24.11 | 36.44 | 39.67 | 32.33 |
| 15 | 0.00 | 0.33 | 0.00 | 1.11 | 0.00 | 0.00 |
| 16 | 0.00 | 0.56 | 0.00 | 3.89 | 0.00 | 0.00 |
| 17 | 136.00 | 302.78 | 260.50 | 264.44 | 363.00 | 318.67 |
| 18 | 46.88 | 176.22 | 143.00 | 105.44 | 184.33 | 187.33 |
| 19 | 80.00 | 126.56 | 115.11 | 159.00 | 178.67 | 131.33 |
| 20 | 89.78 | 82.11 | 70.56 | 101.67 | 79.56 | 67.22 |
| 21 | 4.13 | 20.11 | 17.00 | 9.22 | 28.11 | 22.56 |
| 22 | 1.98 | 2.71 | 2.78 | 2.75 | 3.70 | 2.84 |
| 23 | 3.90 | 0.78 | 1.18 | 1.98 | 1.03 | 0.83 |
| 24 | 14.25 | 36.11 | 32.75 | 23.78 | 58.56 | 40.56 |
| 25 | 66.50 | 65.67 | 62.33 | 67.67 | 61.67 | 64.33 |
| 26 | 41.00 | 38.33 | 31.00 | 39.00 | 27.33 | 32.67 |
| 27 | 73.00 | 72.33 | 68.67 | 73.67 | 68.00 | 70.67 |
| 28 | 101.67 | 98.33 | 75.83 | 116.67 | 76.67 | 71.67 |
| 29 | 3.50 | 2.50 | 2.17 | 2.33 | 2.17 | 2.17 |
| 30 | 7.30 | 11.38 | 15.68 | 10.83 | 12.98 | 15.16 |
| 31 | 88.00 | 75.00 | 80.67 | 75.67 | 76.33 | 77.33 |
| 32 | 2.67 | 2.50 | 1.83 | 3.50 | 3.33 | 1.50 |
| 33 | 34.23 | 44.27 | 53.67 | 42.47 | 43.60 | 52.20 |
| 34 | 2.12 | 2.58 | 2.58 | 2.67 | 2.62 | 2.58 |
| 35 | 2.22 | 2.49 | 2.47 | 2.71 | 2.51 | 2.61 |
| 36 | 36.44 | 50.78 | 43.63 | 58.33 | 71.22 | 50.11 |
| 37 | 20.38 | 68.22 | 55.75 | 40.11 | 70.56 | 73.00 |
| 38 | 61.00 | 119.00 | 103.25 | 98.44 | 141.78 | 123.11 |
| 39 | 4.80 | 4.36 | 4.20 | 4.82 | 4.12 | 3.83 |
| 40 | 88.00 | 75.00 | 80.67 | 75.67 | 76.33 | 77.33 |

Table 39.

TABLE 40

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYD611 | 0.79 | 6.52E−03 | 1 | 3 | LYD611 | 0.73 | 1.59E−02 | 1 | 1 |
| LYD611 | 0.79 | 6.87E−03 | 5 | 3 | LYD611 | 0.71 | 2.08E−02 | 5 | 2 |
| LYD611 | 0.79 | 6.22E−03 | 5 | 32 | LYD611 | 0.74 | 1.46E−02 | 5 | 15 |
| LYD611 | 0.88 | 3.55E−03 | 9 | 16 | LYD611 | 0.75 | 4.74E−03 | 1 | 3 |
| LYD612 | 0.74 | 3.62E−02 | 9 | 30 | LYD612 | 0.80 | 1.83E−02 | 9 | 33 |
| LYD613 | 0.78 | 7.35E−03 | 8 | 13 | LYD613 | 0.76 | 1.15E−02 | 8 | 18 |
| LYD613 | 0.79 | 6.10E−03 | 8 | 5 | LYD613 | 0.70 | 2.28E−02 | 8 | 17 |
| LYD613 | 0.75 | 3.20E−02 | 9 | 8 | LYD613 | 0.75 | 4.90E−03 | 10 | 23 |
| LYD613 | 0.78 | 2.59E−03 | 10 | 9 | LYD614 | 0.79 | 6.27E−03 | 7 | 30 |
| LYD614 | 0.75 | 1.33E−02 | 7 | 33 | LYD614 | 0.75 | 1.22E−02 | 5 | 8 |
| LYD614 | 0.75 | 1.33E−02 | 8 | 13 | LYD614 | 0.74 | 1.37E−02 | 8 | 18 |
| LYD614 | 0.76 | 1.13E−02 | 8 | 5 | LYD614 | 0.74 | 3.49E−02 | 9 | 30 |
| LYD614 | 0.79 | 2.02E−02 | 9 | 33 | LYD614 | 0.75 | 4.87E−03 | 1 | 20 |
| LYD614 | 0.73 | 6.88E−03 | 10 | 6 | LYD614 | 0.75 | 4.90E−03 | 10 | 4 |
| LYD615 | 0.76 | 1.10E−02 | 7 | 20 | LYD615 | 0.81 | 4.14E−03 | 7 | 28 |
| LYD615 | 0.72 | 8.42E−03 | 11 | 29 | LYD615 | 0.89 | 5.76E−04 | 5 | 14 |
| LYD615 | 0.88 | 6.96E−04 | 5 | 19 | LYD615 | 0.75 | 1.22E−02 | 5 | 22 |
| LYD615 | 0.77 | 2.49E−02 | 9 | 5 | LYD616 | 0.78 | 7.41E−03 | 8 | 3 |
| LYD616 | 0.86 | 1.37E−03 | 8 | 15 | LYD616 | 0.72 | 1.88E−02 | 8 | 6 |
| LYD616 | 0.80 | 5.71E−03 | 8 | 9 | LYD616 | 0.71 | 4.69E−02 | 9 | 30 |

TABLE 40-continued

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYD616 | 0.76 | 2.71E−02 | 9 | 33 | LYD616 | 0.72 | 8.76E−03 | 4 | 7 |
| LYD616 | 0.75 | 4.86E−03 | 10 | 13 | LYD616 | 0.72 | 8.10E−03 | 10 | 18 |
| LYD616 | 0.77 | 3.73E−03 | 10 | 17 | LYD617 | 0.70 | 2.31E−02 | 7 | 30 |
| LYD617 | 0.71 | 1.01E−02 | 11 | 30 | LYD617 | 0.75 | 5.35E−03 | 11 | 33 |
| LYD617 | 0.71 | 2.21E−02 | 5 | 18 | LYD617 | 0.81 | 4.31E−03 | 5 | 6 |
| LYD617 | 0.80 | 5.72E−03 | 5 | 5 | LYD617 | 0.79 | 6.36E−03 | 5 | 4 |
| LYD617 | 0.80 | 5.60E−03 | 5 | 1 | LYD617 | 0.72 | 4.53E−02 | 9 | 30 |
| LYD617 | 0.73 | 3.94E−02 | 9 | 24 | LYD617 | 0.72 | 4.48E−02 | 9 | 19 |
| LYD617 | 0.78 | 2.12E−02 | 9 | 22 | LYD617 | 0.76 | 2.82E−02 | 9 | 7 |
| LYD617 | 0.72 | 7.75E−03 | 1 | 12 | LYD617 | 0.79 | 2.14E−03 | 1 | 24 |
| LYD617 | 0.79 | 2.28E−03 | 1 | 7 | LYD617 | 0.72 | 8.95E−03 | 10 | 33 |
| LYD618 | 0.82 | 3.46E−03 | 7 | 13 | LYD618 | 0.87 | 1.13E−03 | 7 | 18 |
| LYD618 | 0.83 | 2.69E−03 | 7 | 11 | LYD618 | 0.87 | 1.23E−03 | 7 | 6 |
| LYD618 | 0.88 | 8.01E−04 | 7 | 4 | LYD618 | 0.88 | 1.76E−04 | 11 | 30 |
| LYD618 | 0.84 | 6.36E−04 | 11 | 33 | LYD618 | 0.77 | 8.80E−03 | 5 | 13 |
| LYD618 | 0.76 | 1.12E−02 | 5 | 18 | LYD618 | 0.74 | 1.50E−02 | 5 | 4 |
| LYD618 | 0.73 | 1.75E−02 | 5 | 17 | LYD618 | 0.71 | 2.16E−02 | 8 | 12 |
| LYD618 | 0.78 | 7.21E−03 | 8 | 7 | LYD618 | 0.72 | 4.22E−02 | 9 | 14 |
| LYD618 | 0.71 | 4.93E−02 | 9 | 16 | LYD618 | 0.91 | 1.47E−03 | 9 | 13 |
| LYD618 | 0.88 | 4.13E−03 | 9 | 18 | LYD618 | 0.73 | 3.99E−02 | 9 | 11 |
| LYD618 | 0.80 | 1.61E−02 | 9 | 3 | LYD618 | 0.98 | 3.10E−05 | 9 | 15 |
| LYD618 | 0.95 | 3.66E−04 | 9 | 6 | LYD618 | 0.92 | 1.24E−03 | 9 | 5 |
| LYD618 | 0.88 | 3.76E−03 | 9 | 4 | LYD618 | 0.92 | 1.31E−03 | 9 | 17 |
| LYD618 | 0.89 | 2.69E−03 | 9 | 9 | LYD618 | 0.75 | 7.41E−03 | 2 | 13 |
| LYD619 | 0.75 | 1.28E−02 | 7 | 23 | LYD619 | 0.72 | 1.83E−02 | 5 | 12 |
| LYD619 | 0.71 | 2.13E−02 | 5 | 19 | LYD619 | 0.76 | 1.01E−02 | 5 | 22 |
| LYD619 | 0.82 | 3.43E−03 | 8 | 15 | LYD619 | 0.83 | 1.02E−02 | 9 | 7 |
| LYD619 | 0.73 | 7.05E−03 | 4 | 14 | LYD619 | 0.73 | 7.48E−03 | 4 | 13 |
| LYD619 | 0.78 | 2.88E−03 | 4 | 17 | LYD620 | 0.72 | 1.93E−02 | 7 | 8 |
| LYD620 | 0.71 | 2.11E−02 | 7 | 20 | LYD620 | 0.76 | 4.11E−03 | 11 | 8 |
| LYD620 | 0.82 | 3.33E−03 | 5 | 29 | LYD620 | 0.71 | 2.03E−02 | 5 | 19 |
| LYD620 | 0.71 | 2.11E−02 | 8 | 18 | LYD620 | 0.84 | 2.51E−03 | 8 | 3 |
| LYD620 | 0.85 | 1.75E−03 | 8 | 15 | LYD620 | 0.80 | 5.24E−03 | 8 | 6 |
| LYD620 | 0.85 | 1.73E−03 | 8 | 5 | LYD620 | 0.72 | 1.86E−02 | 8 | 4 |
| LYD620 | 0.73 | 1.67E−02 | 8 | 1 | LYD620 | 0.76 | 1.10E−02 | 8 | 9 |
| LYD620 | 0.72 | 4.38E−02 | 9 | 8 | LYD620 | 0.81 | 1.57E−02 | 9 | 10 |
| LYD620 | 0.79 | 2.23E−03 | 1 | 3 | LYD620 | 0.76 | 4.05E−03 | 1 | 9 |
| LYD620 | 0.71 | 1.04E−02 | 10 | 33 | LYD621 | 0.78 | 7.26E−03 | 5 | 14 |
| LYD621 | 0.84 | 2.44E−03 | 5 | 19 | LYD621 | 0.79 | 6.70E−03 | 5 | 22 |
| LYD621 | 0.70 | 2.30E−02 | 8 | 13 | LYD621 | 0.74 | 1.42E−02 | 8 | 18 |
| LYD621 | 0.73 | 1.72E−02 | 8 | 3 | LYD621 | 0.71 | 2.09E−02 | 8 | 15 |
| LYD621 | 0.72 | 1.86E−02 | 8 | 6 | LYD621 | 0.78 | 7.80E−03 | 8 | 4 |
| LYD621 | 0.75 | 1.25E−02 | 8 | 9 | LYD621 | 0.74 | 8.99E−03 | 2 | 22 |
| LYD621 | 0.70 | 1.11E−02 | 4 | 14 | LYD621 | 0.74 | 5.81E−03 | 4 | 33 |
| LYD621 | 0.71 | 9.73E−03 | 4 | 22 | LYD621 | 0.76 | 3.82E−03 | 1 | 22 |
| LYD622 | 0.75 | 1.18E−02 | 7 | 33 | LYD622 | 0.83 | 8.52E−04 | 11 | 30 |
| LYD622 | 0.72 | 8.59E−03 | 11 | 33 | LYD622 | 0.81 | 4.94E−03 | 5 | 23 |
| LYD622 | 0.70 | 2.28E−02 | 8 | 14 | LYD622 | 0.84 | 8.41E−03 | 9 | 12 |
| LYD622 | 0.82 | 1.29E−02 | 9 | 3 | LYD622 | 0.73 | 3.92E−02 | 9 | 7 |
| LYD622 | 0.90 | 2.38E−03 | 9 | 15 | LYD622 | 0.90 | 2.49E−03 | 9 | 6 |
| LYD622 | 0.77 | 2.48E−02 | 9 | 5 | LYD622 | 0.81 | 1.58E−02 | 9 | 4 |
| LYD622 | 0.85 | 8.19E−03 | 9 | 1 | LYD622 | 0.81 | 1.38E−02 | 9 | 9 |
| LYD623 | 0.72 | 8.09E−03 | 11 | 19 | LYD623 | 0.74 | 5.57E−03 | 11 | 22 |
| LYD623 | 0.79 | 7.12E−03 | 8 | 30 | LYD623 | 0.80 | 5.75E−03 | 8 | 33 |
| LYD623 | 0.81 | 1.39E−02 | 9 | 30 | LYD623 | 0.74 | 3.69E−02 | 9 | 22 |
| LYD624 | 0.84 | 2.21E−03 | 7 | 13 | LYD624 | 0.86 | 1.25E−03 | 7 | 18 |
| LYD624 | 0.74 | 1.47E−02 | 7 | 11 | LYD624 | 0.85 | 1.85E−03 | 7 | 6 |
| LYD624 | 0.85 | 1.98E−03 | 7 | 4 | LYD624 | 0.83 | 2.84E−03 | 7 | 21 |
| LYD624 | 0.80 | 5.49E−03 | 7 | 17 | LYD624 | 0.75 | 1.18E−02 | 5 | 20 |
| LYD624 | 0.72 | 1.80E−02 | 5 | 28 | LYD624 | 0.73 | 1.59E−02 | 8 | 18 |
| LYD624 | 0.76 | 1.05E−02 | 8 | 15 | LYD624 | 0.86 | 1.55E−03 | 8 | 6 |
| LYD624 | 0.84 | 2.38E−03 | 8 | 4 | LYD624 | 0.81 | 1.40E−02 | 9 | 33 |
| LYD625 | 0.72 | 1.82E−02 | 5 | 23 | LYD625 | 0.78 | 2.12E−02 | 9 | 8 |
| LYD625 | 0.72 | 4.46E−02 | 9 | 19 | LYD625 | 0.85 | 7.44E−03 | 9 | 15 |
| LYD625 | 0.77 | 2.61E−02 | 9 | 6 | LYD625 | 0.80 | 1.81E−02 | 9 | 5 |
| LYD625 | 0.81 | 1.52E−02 | 9 | 1 | LYD625 | 0.73 | 4.02E−02 | 9 | 9 |
| LYD625 | 0.74 | 5.84E−03 | 4 | 14 | LYD625 | 0.71 | 9.18E−03 | 4 | 7 |
| LYD626 | 0.75 | 3.26E−02 | 9 | 30 | LYD626 | 0.73 | 7.55E−03 | 4 | 6 |
| LYD626 | 0.72 | 7.75E−03 | 4 | 5 | LYD627 | 0.74 | 3.61E−02 | 9 | 30 |
| LYD627 | 0.72 | 8.06E−03 | 1 | 11 | LYD627 | 0.74 | 5.63E−03 | 10 | 2 |
| LYD627 | 0.82 | 9.94E−04 | 10 | 32 | LYD629 | 0.74 | 1.51E−02 | 5 | 16 |
| LYD629 | 0.73 | 1.62E−02 | 5 | 26 | LYD629 | 0.73 | 1.74E−02 | 5 | 32 |
| LYD629 | 0.77 | 9.29E−03 | 8 | 15 | LYD629 | 0.71 | 2.17E−02 | 8 | 9 |

TABLE 40-continued

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYD629 | 0.76 | 2.78E−02 | 9 | 7 | LYD629 | 0.70 | 1.11E−02 | 4 | 15 |
| LYD629 | 0.73 | 6.53E−03 | 4 | 17 | LYD630 | 0.72 | 1.99E−02 | 7 | 5 |
| LYD630 | 0.83 | 2.92E−03 | 8 | 13 | LYD630 | 0.84 | 2.26E−03 | 8 | 18 |
| LYD630 | 0.82 | 3.48E−03 | 8 | 4 | LYD630 | 0.72 | 1.81E−02 | 8 | 21 |
| LYD630 | 0.84 | 2.26E−03 | 8 | 17 | LYD631 | 0.76 | 1.01E−02 | 5 | 30 |
| LYD631 | 0.75 | 1.22E−02 | 5 | 19 | LYD631 | 0.85 | 1.81E−03 | 5 | 22 |
| LYD631 | 0.71 | 2.16E−02 | 8 | 9 | LYD631 | 0.90 | 3.81E−04 | 8 | 31 |
| LYD631 | 0.76 | 2.75E−02 | 9 | 23 | LYD631 | 0.78 | 2.35E−02 | 9 | 31 |
| LYD631 | 0.72 | 8.88E−03 | 4 | 15 | LYD631 | 0.71 | 9.33E−03 | 1 | 7 |
| LYD632 | 0.73 | 1.59E−02 | 7 | 30 | LYD632 | 0.78 | 7.29E−03 | 7 | 33 |
| LYD632 | 0.84 | 2.22E−03 | 5 | 15 | LYD632 | 0.74 | 3.60E−02 | 9 | 33 |
| LYD632 | 0.70 | 1.10E−02 | 1 | 16 | LYD632 | 0.78 | 2.77E−03 | 1 | 20 |
| LYD632 | 0.78 | 3.03E−03 | 1 | 28 | LYD633 | 0.73 | 1.71E−02 | 5 | 11 |
| LYD633 | 0.79 | 6.63E−03 | 5 | 3 | LYD633 | 0.88 | 7.77E−04 | 5 | 9 |
| LYD633 | 0.70 | 2.42E−02 | 8 | 3 | LYD633 | 0.91 | 2.53E−04 | 8 | 15 |
| LYD633 | 0.82 | 3.86E−03 | 8 | 6 | LYD633 | 0.75 | 1.31E−02 | 8 | 5 |
| LYD633 | 0.76 | 1.05E−02 | 8 | 4 | LYD633 | 0.70 | 1.06E−02 | 1 | 16 |
| LYD633 | 0.72 | 8.59E−03 | 1 | 15 | LYD634 | 0.75 | 3.11E−02 | 9 | 8 |
| LYD634 | 0.81 | 1.55E−03 | 1 | 8 | LYD634 | 0.78 | 2.51E−03 | 1 | 20 |
| LYD634 | 0.77 | 3.16E−03 | 10 | 14 | LYD634 | 0.71 | 9.38E−03 | 10 | 19 |
| LYD634 | 0.73 | 7.50E−03 | 10 | 17 | LYD635 | 0.79 | 1.85E−02 | 9 | 14 |
| LYD635 | 0.77 | 2.64E−02 | 9 | 8 | LYD635 | 0.83 | 1.03E−02 | 9 | 19 |
| LYD635 | 0.83 | 1.01E−02 | 9 | 22 | LYD635 | 0.76 | 4.03E−03 | 1 | 8 |
| LYD635 | 0.73 | 6.59E−03 | 10 | 19 | LYD635 | 0.77 | 3.53E−03 | 10 | 22 |
| LYD636 | 0.80 | 4.97E−03 | 8 | 14 | LYD636 | 0.71 | 2.03E−02 | 8 | 13 |
| LYD636 | 0.77 | 9.05E−03 | 8 | 17 | LYD636 | 0.75 | 3.20E−02 | 9 | 14 |
| LYD636 | 0.74 | 3.74E−02 | 9 | 22 | LYD636 | 0.73 | 6.87E−03 | 1 | 14 |
| LYD636 | 0.78 | 2.66E−03 | 10 | 14 | LYD637 | 0.82 | 3.54E−03 | 8 | 1 |
| LYD637 | 0.73 | 7.02E−03 | 10 | 31 | LYD638 | 0.79 | 6.71E−03 | 7 | 11 |
| LYD638 | 0.77 | 3.48E−03 | 11 | 30 | LYD638 | 0.81 | 1.45E−03 | 11 | 33 |
| LYD638 | 0.77 | 9.73E−03 | 8 | 13 | LYD638 | 0.79 | 7.05E−03 | 8 | 18 |
| LYD638 | 0.90 | 3.21E−04 | 8 | 15 | LYD638 | 0.80 | 5.26E−03 | 8 | 6 |
| LYD638 | 0.71 | 2.05E−02 | 8 | 5 | LYD638 | 0.82 | 4.00E−03 | 8 | 4 |
| LYD638 | 0.73 | 1.63E−02 | 8 | 17 | LYD639 | 0.70 | 5.11E−02 | 9 | 12 |
| LYD639 | 0.78 | 2.37E−02 | 9 | 24 | LYD639 | 0.96 | 2.19E−04 | 9 | 7 |
| LYD639 | 0.87 | 2.55E−04 | 10 | 8 | LYD641 | 0.82 | 3.64E−03 | 5 | 13 |
| LYD641 | 0.78 | 7.22E−03 | 5 | 18 | LYD641 | 0.75 | 1.19E−02 | 5 | 15 |
| LYD641 | 0.75 | 1.32E−02 | 5 | 6 | LYD641 | 0.73 | 1.76E−02 | 5 | 4 |
| LYD641 | 0.75 | 1.21E−02 | 5 | 17 | LYD641 | 0.77 | 2.46E−02 | 9 | 16 |
| LYD641 | 0.84 | 8.62E−03 | 9 | 13 | LYD641 | 0.82 | 1.27E−02 | 9 | 18 |
| LYD641 | 0.71 | 4.90E−02 | 9 | 15 | LYD641 | 0.77 | 2.67E−02 | 9 | 5 |
| LYD641 | 0.76 | 2.91E−02 | 9 | 4 | LYD641 | 0.78 | 2.19E−02 | 9 | 17 |
| LYD641 | 0.79 | 3.48E−03 | 2 | 13 | LYD641 | 0.70 | 1.56E−02 | 2 | 17 |
| LYD642 | 0.77 | 9.07E−03 | 7 | 32 | LYD642 | 0.84 | 2.18E−03 | 5 | 8 |
| LYD642 | 0.71 | 2.22E−02 | 5 | 19 | LYD642 | 0.72 | 8.83E−03 | 1 | 31 |
| LYD643 | 0.85 | 1.79E−03 | 8 | 3 | LYD643 | 0.85 | 2.02E−03 | 8 | 15 |
| LYD643 | 0.80 | 5.19E−03 | 8 | 6 | LYD643 | 0.72 | 1.94E−02 | 8 | 5 |
| LYD643 | 0.71 | 2.06E−02 | 8 | 4 | LYD643 | 0.76 | 9.96E−03 | 8 | 9 |
| LYD643 | 0.78 | 2.77E−03 | 1 | 3 | LYD643 | 0.77 | 3.63E−03 | 1 | 9 |
| LYD643 | 0.75 | 4.85E−03 | 10 | 3 | LYD643 | 0.74 | 6.03E−03 | 10 | 2 |
| LYD644 | 0.76 | 1.07E−02 | 7 | 3 | LYD644 | 0.85 | 1.83E−03 | 7 | 9 |
| LYD644 | 0.80 | 5.37E−03 | 8 | 16 | LYD644 | 0.72 | 1.79E−02 | 8 | 20 |
| LYD644 | 0.84 | 2.37E−03 | 8 | 15 | LYD644 | 0.75 | 1.31E−02 | 8 | 28 |
| LYD644 | 0.74 | 3.71E−02 | 9 | 30 | LYD644 | 0.84 | 9.39E−03 | 9 | 33 |
| LYD644 | 0.74 | 6.07E−03 | 10 | 26 | LYD644 | 0.72 | 8.41E−03 | 10 | 25 |
| LYD645 | 0.85 | 7.94E−03 | 9 | 14 | LYD645 | 0.80 | 1.60E−02 | 9 | 30 |
| LYD645 | 0.84 | 9.84E−03 | 9 | 19 | LYD645 | 0.89 | 3.41E−03 | 9 | 22 |
| LYD645 | 0.70 | 1.54E−02 | 2 | 20 | LYD646 | 0.84 | 5.76E−04 | 11 | 8 |
| LYD646 | 0.76 | 3.03E−02 | 9 | 30 | LYD646 | 0.76 | 2.86E−02 | 9 | 33 |
| LYD646 | 0.70 | 1.05E−02 | 10 | 13 | LYD646 | 0.73 | 7.14E−03 | 10 | 18 |
| LYD646 | 0.71 | 1.02E−02 | 10 | 4 | LYD646 | 0.74 | 6.41E−03 | 10 | 17 |
| LYD647 | 0.73 | 3.98E−02 | 9 | 14 | LYD647 | 0.81 | 1.50E−02 | 9 | 19 |
| LYD647 | 0.83 | 1.06E−02 | 9 | 22 | LYD647 | 0.76 | 2.93E−02 | 9 | 7 |
| LYD647 | 0.73 | 7.06E−03 | 10 | 13 | LYD647 | 0.74 | 6.23E−03 | 10 | 18 |
| LYD647 | 0.70 | 1.07E−02 | 10 | 15 | LYD647 | 0.80 | 1.69E−03 | 10 | 6 |
| LYD623 | 0.77 | 9.13E−03 | 3 | 40 | LYD627 | 0.70 | 2.28E−02 | 1 | 40 |
| LYD637 | 0.85 | 7.18E−03 | 5 | 40 | LYD637 | 0.78 | 1.39E−02 | 2 | 40 |

TABLE 40-continued

Correlation between the expression level of selected genes of some
embodiments of the invention in various tissues and the phenotypic
performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYD637 | 0.76 | 1.02E−02 | 8 | 40 | LYD639 | 0.76 | 2.80E−02 | 4 | 40 |
| LYD646 | 0.72 | 4.52E−02 | 4 | 40 | | | | | |

Table 40. Provided are the correlations (R) between the expression levels yield improving genes and their homologs in various tissues [Expression (Exp) sets] and the phenotypic performance [yield, biomass, and plant architecture (Correlation vector (Corr))] under normal conditions across soybean varieties.
P = p value.

Example 10

Production of *Brachypodium* Transcriptome and High Throughput Correlation Analysis Using 60K *Brachypodium* Oligonucleotide Micro-Array In order to produce a high throughput correlation analysis comparing between plant phenotype and gene expression level, the present inventors utilized a *brachypodium* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60K *brachypodium* genes and transcripts. In order to define correlations between the levels of RNA expression and yield or vigor related parameters, various plant characteristics of 24 different *brachypodium* accessions were analyzed. Among them, 22 accessions encompassing the observed variance were selected for RNA expression analysis and comparative genomic hybridization (CGH) analysis.

The correlation between the RNA levels and the characterized parameters was analyzed using Pearson correlation test [Hypertext Transfer Protocol://World Wide Web (dot) davidmlane (dot) com/hyperstat/A34739 (dot) html].

Additional correlation analysis was done by comparing plant phenotype and gene copy number. The correlation between the normalized copy number hybridization signal and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Brachypodium* tissues—two tissues [leaf and spike] were sampled and RNA was extracted as described above. Each micro-array expression information tissue type has received a Set ID as summarized in Table 41 below.

TABLE 41

*Brachypodium* transcriptome expression sets

| Expression Set | Set ID |
|---|---|
| Leaf at flowering stage under normal growth conditions | 1 + 2 |
| spike at flowering stage under normal growth conditions | 3 |

Table 41.

*Brachypodium* yield components and vigor related parameters assessment—24 *brachypodium* accessions were grown in 4-6 repetitive plots (8 plant per plot), in a green house. The growing protocol was as follows: *brachypodium* seeds were sown in plots and grown under normal conditions. Plants were continuously phenotyped during the growth period and at harvest (Table 43-48, below). The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

At the end of the growing period the grains were separated from the spikes and the following parameters were measured using digital imaging system and collected:

No. of tillering—all tillers were counted per plant at harvest (mean per plot).

Head number—At the end of the experiment, heads were harvested from each plot and were counted.

Total Grains weight per plot (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Highest number of spikelets—The highest spikelet number per head was calculated per plant (mean per plot).

Mean number of spikelets—The mean spikelet number per head was calculated per plot.

Plant height—Each of the plants was measured for its height using measuring tape. Height was measured from ground level to spike base of the longest spike at harvest.

Spikelets weight (gr.)—The biomass and spikes weight of each plot was separated, measured per plot.

Average head weight—calculated by dividing spikelets weight with head number (gr.).

Harvest Index—The harvest index was calculated using Formula XII.

Spikelets Index—The Spikelets index is calculated using Formula XIII.

Spikelets Index=Average Spikelets weight per plant/
(Average vegetative dry weight per plant plus
Average Spikelets weight per plant).      Formula XIII Percent Number of heads with spikelets—The number of heads with more than one spikelet per plant were counted and the percent from all heads per plant was calculated.

Total dry mater per plot—Calculated as Vegetative portion above ground plus all the spikelet dry weight per plot.

1000 grain weight—At the end of the experiment all grains from all plots were collected and weighted and the weight of 1000 were calculated.

The following parameters were collected using digital imaging system:

At the end of the growing period the grains were separated from the spikes and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length, perimeter and width (cm)—A sample of ~200 grains was weighted, photographed and images were processed using the below described image processing system. The sum of grain lengths and width (longest axis) was measured from those images and was divided by the number of grains.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

TABLE 42

*Brachypodium* correlated parameters (vectors)

| Correlated parameter with | Correlation ID |
|---|---|
| % Number of heads with spikelets (number) | 1 + 26 |
| 1000 grain weight (gr) | 2 + 27 |
| Average head weight (gr) | 3 + 28 |
| Grain area ($cm^2$) | 4 + 29 |
| Grain length (cm) | 5 + 30 |
| Grain Perimeter ($cm^2$) | 6 + 31 |
| Grain width (cm) | 7 + 32 |
| Grains weight per plant (gr) | 8 + 33 |
| Grains weight per plot (gr) | 9 + 34 |
| Harvest index | 10 + 35 |
| Heads per plant (number) | 11 + 36 |
| Heads per plot (number) | 12 + 37 |
| Highest Number of spikelets per plot (number) | 13 + 38 |
| Mean Number of spikelets per plot (number) | 14 + 39 |
| Number of heads with spikelets per plant (number) | 15 + 40 |
| Plant height (cm) | 16 + 41 |
| Plant Vegetative DW (gr) | 17 + 42 |
| Plants number (number) | 18 + 43 |
| Spikelets DW per plant (gr) | 19 + 44 |
| Spikelets weight (gr) | 20 + 45 |
| Spikes index | 21 + 46 |
| Tillering (number) | 22 |
| Total dry mater per plant (gr) | 23 + 47 |
| Total dry mater per plot (gr) | 24 + 48 |
| Vegetative DW (gr) | 25 + 49 |

Table 42. Provided are the *Brachypodium* correlated parameters

Experimental Results 24 different *Brachypodium* accessions were grown and characterized for different parameters as described above. The average for each of the measured parameters was calculated using the JMP software and values are summarized in Tables 43-48 below. Subsequent correlation analysis between the various transcriptome sets and the average parameters (Tables 43-48) was conducted. Follow, results were integrated to the database.

TABLE 43

Measured parameters of correlation IDs in *Brachypodium* accessions under normal conditions (lines 1-9)

| Ecotype | Line-1 | Line-2 | Line-3 | Line-4 | Line-5 | Line-6 | Line-7 | Line-8 | Line-9 |
|---|---|---|---|---|---|---|---|---|---|
| 1 | 27.61 | 35.33 | 21.67 | 52.40 | 20.84 | 47.73 | 17.55 | 16.51 | 5.42 |
| 2 | 3.75 | 3.78 | 3.35 | 3.70 | 3.90 | 4.87 | 4.82 | 4.76 | 5.54 |
| 3 | 0.06 | 0.04 | 0.05 | 0.09 | 0.04 | 0.09 | 0.06 | 0.06 | 0.04 |
| 4 | 0.10 | 0.10 | 0.09 | 0.09 | 0.09 | 0.11 | 0.10 | 0.11 | 0.11 |
| 5 | 0.73 | 0.72 | 0.72 | 0.75 | 0.72 | 0.87 | 0.79 | 0.79 | 0.83 |
| 6 | 1.67 | 1.62 | 1.62 | 1.65 | 1.60 | 1.90 | 1.80 | 1.82 | 1.82 |
| 7 | 0.18 | 0.17 | 0.17 | 0.15 | 0.15 | 0.16 | 0.17 | 0.18 | 0.16 |
| 8 | 0.14 | 0.06 | 0.08 | 0.35 | 0.27 | 0.44 | 0.32 | 0.07 | 0.14 |
| 9 | 1.05 | 0.44 | 0.61 | 2.58 | 2.03 | 3.40 | 2.58 | 0.39 | 1.11 |
| 10 | 0.13 | 0.14 | 0.15 | 0.21 | 0.17 | 0.18 | 0.15 | 0.11 | 0.20 |
| 11 | 16.29 | 7.08 | 6.59 | 16.11 | 21.40 | 17.05 | 25.88 | 8.02 | 10.48 |
| 12 | 121.75 | 56.60 | 52.75 | 123.50 | 156.83 | 135.0 | 207.00 | 48.60 | 82.40 |
| 13 | 3.00 | 2.60 | 3.00 | 2.83 | 2.33 | 4.50 | 2.60 | 2.00 | 2.00 |
| 14 | 2.10 | 2.10 | 1.72 | 2.17 | 1.85 | 2.85 | 1.93 | 1.56 | 1.38 |
| 15 | 5.27 | 2.50 | 2.06 | 9.44 | 5.02 | 7.72 | 4.90 | 1.87 | 0.71 |
| 16 | 31.65 | 23.44 | 22.75 | 45.35 | 29.41 | 46.74 | 38.39 | 29.15 | 34.36 |
| 17 | 0.42 | 0.12 | 0.13 | 0.82 | 0.67 | 1.05 | 0.87 | 0.31 | 0.32 |
| 18 | 7.50 | 8.00 | 8.00 | 7.50 | 7.33 | 7.88 | 8.00 | 6.40 | 7.80 |
| 19 | 0.96 | 0.31 | 0.33 | 1.46 | 0.96 | 1.42 | 1.56 | 0.45 | 0.44 |
| 20 | 7.18 | 2.50 | 2.68 | 11.31 | 7.16 | 11.05 | 12.44 | 2.66 | 3.45 |
| 21 | 0.71 | 0.72 | 0.73 | 0.68 | 0.60 | 0.57 | 0.65 | 0.60 | 0.58 |
| 22 | 16.84 | 7.20 | 7.00 | 16.99 | 23.61 | 18.25 | 27.20 | 8.60 | 10.67 |
| 23 | 1.38 | 0.43 | 0.47 | 2.28 | 1.63 | 2.47 | 2.43 | 0.76 | 0.76 |
| 24 | 10.26 | 3.45 | 3.74 | 17.78 | 12.29 | 19.27 | 19.40 | 4.47 | 6.00 |
| 25 | 3.08 | 0.95 | 1.06 | 6.47 | 5.13 | 8.23 | 6.96 | 1.81 | 2.55 |

Table 43. Correlation IDs refer to those described in Table 42 above [*Brachypodium* correlated parameters (vectors)].

TABLE 44

Measured parameters of correlation IDs in Brachypodium accessions under normal conditions (lines 10-18)

| Ecotype | Line-10 | Line-11 | Line-12 | Line-13 | Line-14 | Line-15 | Line-16 | Line-17 | Line-18 |
|---|---|---|---|---|---|---|---|---|---|
| 1 | 15.42 | 14.00 | 6.40 | 4.51 | 15.52 | 20.34 | 8.11 | 53.21 | 55.41 |
| 2 | 4.98 | 4.88 | 4.83 | 5.54 | 4.73 | 5.24 | 4.96 | 4.00 | 3.84 |
| 3 | 0.06 | 0.07 | 0.05 | 0.04 | 0.05 | 0.05 | 0.06 | 0.10 | 0.08 |
| 4 | 0.11 | 0.09 | 0.10 | 0.11 | 0.10 | 0.12 | 0.10 | 0.10 | 0.10 |
| 5 | 0.82 | 0.74 | 0.78 | 0.90 | 0.75 | 0.86 | 0.74 | 0.84 | 0.75 |
| 6 | 1.83 | 1.69 | 1.74 | 1.93 | 1.69 | 1.91 | 1.71 | 1.81 | 1.68 |
| 7 | 0.17 | 0.16 | 0.17 | 0.16 | 0.17 | 0.19 | 0.17 | 0.15 | 0.17 |
| 8 | 0.14 | 0.26 | 0.14 | 0.11 | 0.39 | 0.14 | 0.13 | 0.37 | 0.08 |
| 9 | 1.07 | 1.96 | 1.09 | 0.84 | 3.07 | 1.09 | 1.07 | 2.99 | 0.50 |
| 10 | 0.16 | 0.20 | 0.14 | 0.26 | 0.22 | 0.09 | 0.18 | 0.09 | 0.07 |
| 11 | 9.09 | 11.63 | 14.13 | 5.88 | 23.75 | 16.06 | 9.74 | 22.19 | 11.89 |
| 12 | 70.13 | 83.40 | 110.33 | 47.00 | 185.50 | 125. | 80.75 | 177.50 | 81.50 |
| 13 | 2.25 | 2.20 | 1.83 | 2.00 | 2.50 | 2.40 | 2.00 | 3.50 | 3.50 |
| 14 | 1.65 | 1.69 | 1.43 | 1.25 | 1.76 | 1.83 | 1.42 | 2.71 | 2.41 |
| 15 | 1.94 | 2.08 | 1.08 | 0.35 | 4.98 | 3.70 | 0.89 | 12.58 | 7.59 |
| 16 | 28.65 | 31.95 | 28.88 | 24.74 | 37.30 | 45.09 | 22.39 | 55.04 | 31.40 |
| 17 | 0.32 | 0.38 | 0.39 | 0.13 | 0.87 | 0.69 | 0.34 | 1.72 | 0.44 |
| 18 | 7.75 | 7.20 | 7.83 | 8.00 | 7.75 | 8.00 | 8.25 | 8.00 | 6.50 |
| 19 | 0.56 | 0.88 | 0.67 | 0.26 | 1.14 | 0.83 | 0.59 | 2.27 | 0.92 |
| 20 | 4.29 | 6.42 | 5.29 | 2.04 | 8.89 | 6.65 | 4.92 | 18.15 | 6.25 |
| 21 | 0.66 | 0.71 | 0.64 | 0.66 | 0.59 | 0.54 | 0.68 | 0.56 | 0.69 |
| 22 | 9.38 | 11.97 | 14.58 | 6.35 | 25.50 | 16.56 | 10.53 | 27.15 | 12.38 |
| 23 | 0.88 | 1.25 | 1.06 | 0.38 | 2.01 | 1.53 | 0.93 | 3.99 | 1.36 |
| 24 | 6.78 | 9.12 | 8.34 | 3.04 | 15.79 | 12.20 | 7.76 | 31.94 | 9.21 |
| 25 | 2.48 | 2.69 | 3.05 | 1.00 | 6.89 | 5.55 | 2.84 | 13.80 | 2.96 |

Table 44. Correlation IDs refer to those described in Table 42 above [Brachypodium correlated parameters (vectors)].

TABLE 45

Measured parameters of correlation IDs in Brachypodium accessions under normal conditions (lines 19-22)

| Ecotype/Treatment | Line-19 | Line-20 | Line-21 | Line-22 |
|---|---|---|---|---|
| 1 | 47.81 | 42.81 | 59.01 | 34.92 |
| 2 | 4.26 | 5.99 | 3.76 | 4.34 |
| 3 | 0.08 | 0.08 | 0.09 | 0.06 |
| 4 | 0.09 | 0.12 | 0.09 | 0.09 |
| 5 | 0.80 | 0.84 | 0.76 | 0.74 |
| 6 | 1.75 | 1.87 | 1.68 | 1.66 |
| 7 | 0.14 | 0.18 | 0.15 | 0.16 |
| 8 | 0.49 | 0.31 | 0.30 | 0.20 |
| 9 | 3.52 | 2.41 | 1.92 | 1.47 |
| 10 | 0.16 | 0.18 | 0.09 | 0.11 |
| 11 | 24.32 | 13.25 | 25.54 | 19.22 |
| 12 | 172.80 | 98.60 | 177.00 | 143.17 |
| 13 | 3.80 | 2.80 | 3.17 | 2.83 |
| 14 | 2.61 | 2.12 | 2.79 | 2.15 |
| 15 | 12.13 | 6.35 | 15.36 | 7.15 |
| 16 | 45.34 | 40.20 | 58.82 | 39.18 |
| 17 | 1.32 | 0.48 | 1.73 | 0.63 |
| 18 | 7.00 | 7.60 | 6.83 | 7.33 |
| 19 | 1.91 | 1.09 | 2.25 | 1.26 |
| 20 | 13.49 | 8.35 | 15.55 | 9.42 |
| 21 | 0.59 | 0.70 | 0.57 | 0.66 |
| 22 | 26.30 | 13.56 | 29.09 | 20.79 |
| 23 | 3.23 | 1.57 | 3.98 | 1.89 |
| 24 | 22.78 | 12.04 | 27.67 | 14.14 |
| 25 | 9.28 | 3.70 | 12.12 | 4.72 |

Table 45. Correlation IDs refer to those described in Table 51 above [Brachypodium correlated parameters (vectors)].

TABLE 46

Measured parameters of correlation IDs in Brachypodium accessions under normal conditions (lines 23-30)

| Ecotype | Line-23 | Line-24 | Line-25 | Line-26 | Line-27 | Line-28 | Line-29 | Line-30 |
|---|---|---|---|---|---|---|---|---|
| 26 | 27.61 | 35.33 | 21.67 | 14.00 | 5.42 | 15.42 | 6.40 | 4.51 |
| 27 | 3.75 | 3.78 | 3.35 | 4.88 | 5.54 | 4.98 | 4.83 | 5.54 |
| 28 | 0.06 | 0.04 | 0.05 | 0.07 | 0.04 | 0.06 | 0.05 | 0.04 |
| 29 | 0.10 | 0.10 | 0.09 | 0.09 | 0.11 | 0.11 | 0.10 | 0.11 |
| 30 | 0.73 | 0.72 | 0.72 | 0.74 | 0.83 | 0.82 | 0.78 | 0.90 |
| 31 | 1.67 | 1.62 | 1.62 | 1.69 | 1.82 | 1.83 | 1.74 | 1.93 |
| 32 | 0.18 | 0.17 | 0.17 | 0.16 | 0.16 | 0.17 | 0.17 | 0.16 |
| 33 | 0.14 | 0.06 | 0.08 | 0.26 | 0.14 | 0.14 | 0.14 | 0.11 |
| 34 | 1.05 | 0.44 | 0.61 | 1.96 | 1.11 | 1.07 | 1.09 | 0.84 |
| 35 | 0.13 | 0.14 | 0.15 | 0.20 | 0.20 | 0.16 | 0.14 | 0.26 |
| 36 | 16.29 | 7.08 | 6.59 | 11.63 | 10.48 | 9.09 | 14.13 | 5.88 |

TABLE 46-continued

Measured parameters of correlation IDs in *Brachypodium* accessions under normal conditions (lines 23-30)

| Ecotype | Line-23 | Line-24 | Line-25 | Line-26 | Line-27 | Line-28 | Line-29 | Line-30 |
|---|---|---|---|---|---|---|---|---|
| 37 | 121.75 | 56.60 | 52.75 | 83.40 | 82.40 | 70.13 | 110.33 | 47.00 |
| 38 | 3.00 | 2.60 | 3.00 | 2.20 | 2.00 | 2.25 | 1.83 | 2.00 |
| 39 | 2.10 | 2.10 | 1.72 | 1.69 | 1.38 | 1.65 | 1.43 | 1.25 |
| 40 | 5.27 | 2.50 | 2.06 | 2.08 | 0.71 | 1.94 | 1.08 | 0.35 |
| 41 | 31.65 | 23.44 | 22.75 | 31.95 | 34.36 | 28.65 | 28.88 | 24.74 |
| 42 | 0.42 | 0.12 | 0.13 | 0.38 | 0.32 | 0.32 | 0.39 | 0.13 |
| 43 | 7.50 | 8.00 | 8.00 | 7.20 | 7.80 | 7.75 | 7.83 | 8.00 |
| 44 | 0.96 | 0.31 | 0.33 | 0.88 | 0.44 | 0.56 | 0.67 | 0.26 |
| 45 | 7.18 | 2.50 | 2.68 | 6.42 | 3.45 | 4.29 | 5.29 | 2.04 |
| 46 | 0.71 | 0.72 | 0.73 | 0.71 | 0.58 | 0.66 | 0.64 | 0.66 |
| 22 | 16.84 | 7.20 | 7.00 | 11.97 | 10.67 | 9.38 | 14.58 | 6.35 |
| 47 | 1.38 | 0.43 | 0.47 | 1.25 | 0.76 | 0.88 | 1.06 | 0.38 |
| 48 | 10.26 | 3.45 | 3.74 | 9.12 | 6.00 | 6.78 | 8.34 | 3.04 |
| 49 | 3.08 | 0.95 | 1.06 | 2.69 | 2.55 | 2.48 | 3.05 | 1.00 |

Table 46. Correlation IDs refer to those described in Table 42 above [*Brachypodium* correlated parameters (vectors)].

TABLE 47

Measured parameters of correlation IDs in *Brachypodium* accessions under normal conditions (lines 31-40)

| Ecotype | Line-31 | Line-32 | Line-33 | Line-34 | Line-35 | Line-36 | Line-37 | Line-38 | Line-39 | Line-40 |
|---|---|---|---|---|---|---|---|---|---|---|
| 26 | 55.41 | 16.51 | 15.52 | 20.34 | 8.11 | 53.21 | 47.81 | 42.81 | 34.92 | 52.40 |
| 27 | 3.84 | 4.76 | 4.73 | 5.24 | 4.96 | 4.00 | 4.26 | 5.99 | 4.34 | 3.70 |
| 28 | 0.08 | 0.06 | 0.05 | 0.05 | 0.06 | 0.10 | 0.08 | 0.08 | 0.06 | 0.09 |
| 29 | 0.10 | 0.11 | 0.10 | 0.12 | 0.10 | 0.10 | 0.09 | 0.12 | 0.09 | 0.09 |
| 30 | 0.75 | 0.79 | 0.75 | 0.86 | 0.74 | 0.84 | 0.80 | 0.84 | 0.74 | 0.75 |
| 31 | 1.68 | 1.82 | 1.69 | 1.91 | 1.71 | 1.81 | 1.75 | 1.87 | 1.66 | 1.65 |
| 32 | 0.17 | 0.18 | 0.17 | 0.19 | 0.17 | 0.15 | 0.14 | 0.18 | 0.16 | 0.15 |
| 33 | 0.08 | 0.07 | 0.39 | 0.14 | 0.13 | 0.37 | 0.49 | 0.31 | 0.20 | 0.35 |
| 34 | 0.50 | 0.39 | 3.07 | 1.09 | 1.07 | 2.99 | 3.52 | 2.41 | 1.47 | 2.58 |
| 35 | 0.07 | 0.11 | 0.22 | 0.09 | 0.18 | 0.09 | 0.16 | 0.18 | 0.11 | 0.21 |
| 36 | 11.89 | 8.02 | 23.75 | 16.06 | 9.74 | 22.19 | 24.32 | 13.25 | 19.22 | 16.11 |
| 37 | 81.50 | 48.60 | 185.50 | 125.00 | 80.75 | 177.50 | 172.80 | 98.6 | 143.17 | 123.5 |
| 38 | 3.50 | 2.00 | 2.50 | 2.40 | 2.00 | 3.50 | 3.80 | 2.80 | 2.83 | 2.83 |
| 39 | 2.41 | 1.56 | 1.76 | 1.83 | 1.42 | 2.71 | 2.61 | 2.12 | 2.15 | 2.17 |
| 40 | 7.59 | 1.87 | 4.98 | 3.70 | 0.89 | 12.58 | 12.13 | 6.35 | 7.15 | 9.44 |
| 41 | 31.40 | 29.15 | 37.30 | 45.09 | 22.39 | 55.04 | 45.34 | 40.20 | 39.18 | 45.35 |
| 42 | 0.44 | 0.31 | 0.87 | 0.69 | 0.34 | 1.72 | 1.32 | 0.48 | 0.63 | 0.82 |
| 43 | 6.50 | 6.40 | 7.75 | 8.00 | 8.25 | 8.00 | 7.00 | 7.60 | 7.33 | 7.50 |
| 44 | 0.92 | 0.45 | 1.14 | 0.83 | 0.59 | 2.27 | 1.91 | 1.09 | 1.26 | 1.46 |
| 45 | 6.25 | 2.66 | 8.89 | 6.65 | 4.92 | 18.15 | 13.49 | 8.35 | 9.42 | 11.31 |
| 46 | 0.69 | 0.60 | 0.59 | 0.54 | 0.68 | 0.56 | 0.59 | 0.70 | 0.66 | 0.68 |
| 22 | 12.38 | 8.60 | 25.50 | 16.56 | 10.53 | 27.15 | 26.30 | 13.56 | 20.79 | 16.99 |
| 47 | 1.36 | 0.76 | 2.01 | 1.53 | 0.93 | 3.99 | 3.23 | 1.57 | 1.89 | 2.28 |
| 48 | 9.21 | 4.47 | 15.79 | 12.20 | 7.76 | 31.94 | 22.78 | 12.04 | 14.14 | 17.78 |
| 49 | 2.96 | 1.81 | 6.89 | 5.55 | 2.84 | 13.8 | 9.28 | 3.70 | 4.72 | 6.47 |

Table 47. Correlation IDs refer to those described in Table 42 above [*Brachypodium* correlated parameters (vectors)].

TABLE 48

Measured parameters of correlation IDs in *Brachypodium* accessions under normal conditions (lines 41-44)

| Ecotype/Treatment | Line-41 | Line-42 | Line-43 | Line-44 |
|---|---|---|---|---|
| 26 | 20.84 | 17.55 | 47.73 | 59.01 |
| 27 | 3.90 | 4.82 | 4.87 | 3.76 |
| 28 | 0.04 | 0.06 | 0.09 | 0.09 |
| 29 | 0.09 | 0.10 | 0.11 | 0.09 |
| 30 | 0.72 | 0.79 | 0.87 | 0.76 |
| 31 | 1.60 | 1.80 | 1.90 | 1.68 |
| 32 | 0.15 | 0.17 | 0.16 | 0.15 |
| 33 | 0.27 | 0.32 | 0.44 | 0.30 |
| 34 | 2.03 | 2.58 | 3.40 | 1.92 |
| 35 | 0.17 | 0.15 | 0.18 | 0.09 |
| 36 | 21.40 | 25.88 | 17.05 | 25.54 |
| 37 | 156.83 | 207.00 | 135.00 | 177.00 |
| 38 | 2.33 | 2.60 | 4.50 | 3.17 |
| 39 | 1.85 | 1.93 | 2.85 | 2.79 |

TABLE 48-continued

Measured parameters of correlation IDs in *Brachypodium* accessions under normal conditions (lines 41-44)

| Ecotype/Treatment | Line-41 | Line-42 | Line-43 | Line-44 |
|---|---|---|---|---|
| 40 | 5.02 | 4.90 | 7.72 | 15.36 |
| 41 | 29.41 | 38.39 | 46.74 | 58.82 |
| 42 | 0.67 | 0.87 | 1.05 | 1.73 |
| 43 | 7.33 | 8.00 | 7.88 | 6.83 |
| 44 | 0.96 | 1.56 | 1.42 | 2.25 |
| 45 | 7.16 | 12.44 | 11.05 | 15.55 |
| 46 | 0.60 | 0.65 | 0.57 | 0.57 |
| 22 | 23.61 | 27.20 | 18.25 | 29.09 |
| 47 | 1.63 | 2.43 | 2.47 | 3.98 |
| 48 | 12.29 | 19.40 | 19.27 | 27.67 |
| 49 | 5.13 | 6.96 | 8.23 | 12.12 |

Table 48. Correlation IDs refer to those described in Table 42 above [*Brachypodium* correlated parameters (vectors)].

TABLE 49

Correlation between the expression level of selected genes of some embodiments of the invention in various tissues and the phenotypic performance under normal conditions across *brachypodium* varieties

| Gene Name | R | P value | Exp. set | Corr. Set ID | Gene Name | R | P value | Exp. set | Corr. Set ID |
|---|---|---|---|---|---|---|---|---|---|
| LYD542 | 0.80 | 3.32E−03 | 2 | 46 | LYD543 | 0.75 | 1.17E−02 | 3 | 30 |
| LYD543 | 0.75 | 1.22E−02 | 3 | 31 | LYD544 | 0.72 | 8.85E−03 | 1 | 8 |
| LYD544 | 0.73 | 7.10E−03 | 1 | 9 | LYD544 | 0.71 | 1.39E−02 | 2 | 29 |
| LYD545 | 0.82 | 1.84E−03 | 2 | 37 | LYD545 | 0.86 | 7.41E−04 | 2 | 22 |
| LYD545 | 0.79 | 3.49E−03 | 2 | 48 | LYD545 | 0.80 | 3.10E−03 | 2 | 44 |
| LYD545 | 0.80 | 3.05E−03 | 2 | 49 | LYD545 | 0.82 | 1.88E−03 | 2 | 42 |
| LYD545 | 0.79 | 4.13E−03 | 2 | 40 | LYD545 | 0.78 | 4.87E−03 | 2 | 45 |
| LYD545 | 0.83 | 1.68E−03 | 2 | 36 | LYD545 | 0.82 | 2.17E−03 | 2 | 47 |
| LYD546 | 0.70 | 1.06E−02 | 1 | 8 | LYD546 | 0.78 | 2.93E−03 | 1 | 9 |

Table 49. Provided are the correlations (R) between the expression levels yield improving genes and their homologs in various tissues [Expression (Exp) sets] and the phenotypic performance [yield, biomass, growth rate and/or vigor components (Correlation vector (Corr))] under normal conditions across *brachypodium* varieties.
P = p value.

Example 11

Plant Fiber Development in Cotton Production of Cotton Transcriptome and High Throughput Correlation Analysis Using Cotton Oligonucleotide Microarray In order to conduct high throughput gene expression correlation analysis, the present inventors used cotton oligonucleotide microarray, designed and produced by "Comparative Evolutionary Genomics of Cotton" [Hypertext Transfer Protocol (http)://cottonevolution (dot) info/). This Cotton Oligonucleotide Microarray is composed of 12,006 Integrated DNA Technologies (IDT) oligonucleotides derived from an assembly of more than 180,000 *Gossypium* ESTs sequenced from 30 cDNA libraries. For additional details see PCT/IL2005/000627 and PCT/IL2007/001590 which are fully incorporated herein by reference.

TABLE 50

Cotton transcriptome experimental sets

| Expression Set | Set ID |
|---|---|
| Fiber 15 days after anthesis under normal growth conditions | 1 |
| Fiber 5 days after anthesis under normal growth conditions | 2 |
| Fiber 10 days after anthesis under normal growth conditions | 3 |

Table 50. Provided are the cotton transcriptome expression sets.

In order to define correlations between the levels of RNA expression and fiber length, fibers from 8 different cotton lines were analyzed. These fibers were selected showing very good fiber quality and high lint index (Pima types, originating from other cotton species, namely *G. barbadense*), different levels of quality and lint indexes from various *G. hirsutum* lines: good quality and high lint index (Acala type), and poor quality and short lint index (Tamcot type, and old varieties). A summary of the fiber length of the different lines is provided in Table 51.

Experimental Procedures

RNA extraction—Fiber development stages, representing different fiber characteristics, at 5, 10 and 15 DPA were sampled and RNA was extracted as described above.

Fiber length assessment—Fiber length of the selected cotton lines was measured using fibrograph. The fibrograph system was used to compute length in terms of "Upper Half Mean" length. The upper half mean (UHM) is the average length of longer half of the fiber distribution. The fibrograph measures length in span lengths at a given percentage point World Wide Web (dot) cottoninc (dot) com/Classification-ofCotton/?Pg=4#Length].

Experimental Results

Eight different cotton lines were grown, and their fiber length was measured. The fibers UHM values are summarized in Table 51 herein below. The R square was calculated for each of the genes.

TABLE 51

Summary of the fiber length of the 8 different cotton lines

| | Treatment | | | | | | | |
|---|---|---|---|---|---|---|---|---|
| Ecotype | Line-1 | Line-2 | Line-3 | Line-4 | Line-5 | Line-6 | Line-7 | Line-8 |
| 1 | 1.21 | 1.1 | 1.36 | 1.26 | 0.89 | 1.01 | 1.06 | 1.15 |

Table 51: Presented are the means 8 different cotton lines.

TABLE 52

Correlation between the expression level of selected genes of some embodiments of the invention in various tissues and the phenotypic performance under normal conditions across cotton ecotypes

| Gene Name | R | P value | Exp. set | Corr. Set ID | Gene Name | R | P value | Exp. set | Corr. Set ID |
|---|---|---|---|---|---|---|---|---|---|
| LYD554 | 0.90 | 2.19E−03 | 1 | 1 | LYD555 | 0.73 | 3.82E−02 | 1 | 1 |
| LYD555 | 0.85 | 1.50E−02 | 3 | 1 | | | | | |

Table 52. Provided are the correlations (R) between the expression levels yield improving genes and their homologs in various tissues [Expression (Exp) sets] and the phenotypic performance [yield, biomass, growth rate and/or vigor components (Correlation vector (Corr))] under normal conditions across cotton ecotypes.
P = p value.

Example 12

Identification of Genes which Increase Yield, Biomass, Growth Rate, Vigor, Oil Content, Abiotic Stress Tolerance of Plants and Nitrogen Use Efficiency Based on the above described bioinformatics and experimental tools, the present inventors have identified 164 genes which have a major impact on yield, seed yield, oil yield, biomass, growth rate, vigor, oil content, fiber yield, fiber quality, abiotic stress tolerance, and/or nitrogen use efficiency when expression thereof is increased in plants. The identified genes (including genes identified by bioinformatics tools and curated sequences thereof), and polypeptide sequences encoded thereby are summarized in Table 53, hereinbelow.

TABLE 53

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Organism/Cluster tag | Polyn. SEQ ID NO: | Polyp SEQ ID NO: |
|---|---|---|---|
| LYD521 | arabidopsis\|10v1\|AT1G08410 | 1 | 362 |
| LYD522 | arabidopsis\|10v1\|AT1G19110 | 2 | 363 |
| LYD524 | arabidopsis\|10v1\|AT2G20340 | 3 | 364 |
| LYD525 | arabidopsis\|10v1\|AT2G45030 | 4 | 365 |
| LYD526 | arabidopsis\|10v1\|AT2G45730 | 5 | 366 |
| LYD527 | arabidopsis\|10v1\|AT2G47920 | 6 | 367 |
| LYD528 | arabidopsis\|10v1\|AT3G15650 | 7 | 368 |
| LYD529 | arabidopsis\|10v1\|AT4G00500 | 8 | 369 |
| LYD530 | arabidopsis\|10v1\|AT4G13110 | 9 | 370 |
| LYD531 | arabidopsis\|10v1\|AT4G16146 | 10 | 371 |
| LYD532 | arabidopsis\|10v1\|AT5G02830 | 11 | 372 |
| LYD533 | arabidopsis\|10v1\|AT5G06700 | 12 | 373 |
| LYD534 | arabidopsis\|10v1\|AT5G43150 | 13 | 374 |
| LYD535 | arabidopsis\|10v1\|AT5G46790 | 14 | 375 |
| LYD536 | arabidopsis\|10v1\|AT5G65280 | 15 | 376 |
| LYD537 | b_juncea\|10v2\|E6ANDIZ01AI14E | 16 | 377 |
| LYD538 | b_juncea\|10v2\|E6ANDIZ01AWH6F | 17 | 378 |
| LYD539 | b_juncea\|10v2\|E6ANDIZ01B0PVK | 18 | 379 |
| LYD540 | b_juncea\|10v2\|E6ANDIZ01CQ2ZQ | 19 | 380 |
| LYD541 | b_rapa\|11v1\|BQ704427 | 20 | 381 |
| LYD542 | brachypodium\|09v1\|DV480497 | 21 | 382 |
| LYD543 | brachypodium\|09v1\|GT759735 | 22 | 383 |
| LYD544 | brachypodium\|09v1\|GT835824 | 23 | 384 |
| LYD545 | brachypodium\|09v1\|GT841411 | 24 | 385 |
| LYD546 | brachypodium\|09v1\|SRR031797S0017542 | 25 | 386 |
| LYD547 | canola\|10v1\|CD822163 | 26 | 387 |
| LYD548 | canola\|10v1\|CX192172 | 27 | 388 |
| LYD549 | canola\|10v1\|EE556201 | 28 | 389 |
| LYD550 | canola\|11v1\|DY020414 | 29 | 390 |
| LYD551 | canola\|11v1\|EE429972 | 30 | 391 |
| LYD552 | canola\|11v1\|EE440823 | 31 | 392 |
| LYD553 | canola\|11v1\|EE481252 | 32 | 393 |
| LYD554 | cotton\|10v2\|DN804535 | 33 | 394 |
| LYD555 | cotton\|11v1\|CO098912 | 34 | 395 |
| LYD556 | lotus\|09v1\|AW719664 | 35 | 396 |
| LYD557 | medicago\|09v1\|LLAW329230 | 36 | 397 |
| LYD558 | medicago\|11v1\|AI083094 | 37 | 398 |
| LYD559 | medicago\|11v1\|AI974457 | 38 | 399 |
| LYD560 | medicago\|11v1\|AJ388759 | 39 | 400 |
| LYD561 | medicago\|11v1\|AL368425 | 40 | 401 |
| LYD562 | medicago\|11v1\|AL370319 | 41 | 402 |
| LYD563 | medicago\|11v1\|AL372358 | 42 | 403 |
| LYD564 | medicago\|11v1\|AL383170 | 43 | 404 |
| LYD565 | medicago\|11v1\|AL384827 | 44 | 405 |
| LYD566 | medicago\|11v1\|AW125911 | 45 | 406 |
| LYD567 | medicago\|11v1\|AW126198 | 46 | 407 |
| LYD568 | medicago\|11v1\|AW299069 | 47 | 408 |
| LYD570 | medicago\|11v1\|AW299099 | 48 | 409 |
| LYD571 | medicago\|11v1\|AW683620 | 49 | 410 |
| LYD572 | medicago\|11v1\|AW684312 | 50 | 411 |
| LYD573 | medicago\|11v1\|AW686798 | 51 | 412 |
| LYD574 | medicago\|11v1\|AW688064 | 52 | 413 |
| LYD575 | medicago\|11v1\|AW688428 | 53 | 414 |
| LYD576 | medicago\|11v1\|AW690765 | 54 | 415 |

TABLE 53-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Organism/Cluster tag | Polyn. SEQ ID NO: | Polyp SEQ ID NO: |
|---|---|---|---|
| LYD578 | medicago\|11v1\|AW691134 | 55 | 416 |
| LYD579 | medicago\|11v1\|AW695894 | 56 | 417 |
| LYD580 | medicago\|11v1\|AW775280 | 57 | 418 |
| LYD581 | medicago\|11v1\|AW980738 | 58 | 419 |
| LYD583 | medicago\|11v1\|BE204527 | 59 | 420 |
| LYD584 | medicago\|11v1\|BE325825 | 60 | 421 |
| LYD585 | medicago\|11v1\|BE942833 | 61 | 422 |
| LYD586 | medicago\|11v1\|BE998813 | 62 | 423 |
| LYD587 | medicago\|11v1\|BF005808 | 63 | 424 |
| LYD588 | medicago\|11v1\|BF640823 | 64 | 425 |
| LYD589 | medicago\|11v1\|BG644974 | 65 | 426 |
| LYD590 | medicago\|11v1\|BQ139188 | 66 | 427 |
| LYD591 | medicago\|11v1\|EV259134 | 67 | 428 |
| LYD592 | medicago\|11v1\|XM_003625686 | 68 | 429 |
| LYD593 | medicago\|12v1\|AL366306 | 69 | 430 |
| LYD594 | medicago\|12v1\|BF633538 | 70 | 431 |
| LYD595 | rice\|gb170\|OS01G51360 | 71 | 432 |
| LYD596 | rice\|gb170\|OS01G70930 | 72 | 433 |
| LYD597 | rice\|gb170\|OS02G22020 | 73 | 434 |
| LYD598 | rice\|gb170\|OS03G12840 | 74 | 435 |
| LYD599 | rice\|gb170\|OS04G40100 | 75 | 436 |
| LYD600 | rice\|gb170\|OS06G01200 | 76 | 437 |
| LYD601 | rice\|gb170\|OS06G04250 | 77 | 438 |
| LYD602 | rice\|gb170\|OS06G33810 | 78 | 439 |
| LYD603 | rice\|gb170\|OS08G29170 | 79 | 440 |
| LYD604 | sorghum\|09v1\|SB01G049980 | 80 | 441 |
| LYD605 | sorghum\|09v1\|SB02G037340 | 81 | 442 |
| LYD606 | sorghum\|09v1\|SB03G025590 | 82 | 443 |
| LYD607 | sorghum\|09v1\|SB03G037600 | 83 | 444 |
| LYD608 | sorghum\|09v1\|SB06G006920 | 84 | 445 |
| LYD609 | sorghum\|09v1\|SB09G025850 | 85 | 446 |
| LYD610 | sorghum\|11v1\|SB01G036260 | 86 | 447 |
| LYD611 | soybean\|11v1\|GLYMA01G02290 | 87 | 448 |
| LYD612 | soybean\|11v1\|GLYMA02G02070 | 88 | 449 |
| LYD613 | soybean\|11v1\|GLYMA02G04840 | 89 | 450 |
| LYD614 | soybean\|11v1\|GLYMA02G42250 | 90 | 451 |
| LYD615 | soybean\|11v1\|GLYMA03G27800 | 91 | 452 |
| LYD616 | soybean\|11v1\|GLYMA03G36910 | 92 | 453 |
| LYD617 | soybean\|11v1\|GLYMA03G37120 | 93 | 454 |
| LYD618 | soybean\|11v1\|GLYMA03G41760 | 94 | 455 |
| LYD619 | soybean\|11v1\|GLYMA04G38690 | 95 | 456 |
| LYD620 | soybean\|11v1\|GLYMA05G00370 | 96 | 457 |
| LYD621 | soybean\|11v1\|GLYMA05G34620 | 97 | 458 |
| LYD622 | soybean\|11v1\|GLYMA06G03760 | 98 | 459 |
| LYD623 | soybean\|11v1\|GLYMA06G05880 | 99 | 460 |
| LYD624 | soybean\|11v1\|GLYMA06G11430 | 100 | 461 |
| LYD625 | soybean\|11v1\|GLYMA07G27370 | 101 | 462 |
| LYD626 | soybean\|11v1\|GLYMA08G14740 | 102 | 463 |
| LYD627 | soybean\|11v1\|GLYMA08G39520 | 103 | 464 |
| LYD628 | soybean\|11v1\|GLYMA09G27600 | 104 | 465 |
| LYD629 | soybean\|11v1\|GLYMA09G30190 | 105 | 466 |
| LYD630 | soybean\|11v1\|GLYMA09G35750 | 106 | 467 |
| LYD631 | soybean\|11v1\|GLYMA09G36720 | 107 | 468 |
| LYD632 | soybean\|11v1\|GLYMA10G40890 | 108 | 469 |
| LYD633 | soybean\|11v1\|GLYMA12G02590 | 109 | 470 |
| LYD633 | soybean\|11v1\|GLYMA12G02590 | 109 | 543 |
| LYD634 | soybean\|11v1\|GLYMA12G09830 | 110 | 471 |
| LYD635 | soybean\|11v1\|GLYMA13G04780 | 111 | 472 |
| LYD636 | soybean\|11v1\|GLYMA13G18990 | 112 | 473 |
| LYD637 | soybean\|11v1\|GLYMA13G22160 | 113 | 474 |
| LYD638 | soybean\|11v1\|GLYMA13G41580 | 114 | 475 |
| LYD639 | soybean\|11v1\|GLYMA14G32430 | 115 | 476 |
| LYD640 | soybean\|11v1\|GLYMA14G35690 | 116 | 477 |
| LYD641 | soybean\|11v1\|GLYMA15G02690 | 117 | 478 |
| LYD642 | soybean\|11v1\|GLYMA15G15380 | 118 | 479 |
| LYD643 | soybean\|11v1\|GLYMA16G03140 | 119 | 480 |
| LYD644 | soybean\|11v1\|GLYMA17G01400 | 120 | 481 |
| LYD645 | soybean\|11v1\|GLYMA17G02420 | 121 | 482 |
| LYD646 | soybean\|11v1\|GLYMA17G10240 | 122 | 483 |
| LYD647 | soybean\|11v1\|GLYMA18G15530 | 123 | 484 |
| LYD648 | tomato\|10v1\|AI780847 | 124 | 485 |
| LYD650 | tomato\|11v1\|AF204783 | 125 | 486 |
| LYD651 | tomato\|11v1\|AF211784 | 126 | 487 |
| LYD652 | tomato\|11v1\|AI771255 | 127 | 488 |
| LYD653 | tomato\|11v1\|AI778101 | 128 | 489 |
| LYD654 | tomato\|11v1\|AI782247 | 129 | 490 |
| LYD655 | tomato\|11v1\|AI896168 | 130 | 491 |
| LYD657 | tomato\|11v1\|AW030194 | 131 | 492 |
| LYD658 | tomato\|11v1\|AW094631 | 132 | 493 |
| LYD659 | tomato\|11v1\|AW217526 | 133 | 494 |
| LYD660 | tomato\|11v1\|AW616260 | 134 | 495 |
| LYD661 | tomato\|11v1\|AW616620 | 135 | 496 |
| LYD662 | tomato\|11v1\|AW618546 | 136 | 497 |
| LYD663 | tomato\|11v1\|AY376851 | 137 | 498 |
| LYD664 | tomato\|11v1\|BE460507 | 138 | 499 |
| LYD665 | tomato\|11v1\|BF097728 | 139 | 500 |
| LYD666 | tomato\|11v1\|BG123259 | 140 | 501 |
| LYD667 | tomato\|11v1\|BG123287 | 141 | 502 |
| LYD668 | tomato\|11v1\|BG125390 | 142 | 503 |
| LYD669 | tomato\|11v1\|BG125858 | 143 | 504 |
| LYD670 | tomato\|11v1\|BG126384 | 144 | 505 |
| LYD671 | tomato\|11v1\|BG129734 | 145 | 506 |
| LYD672 | tomato\|11v1\|BG131939 | 146 | 507 |
| LYD673 | tomato\|11v1\|BG132287 | 147 | 508 |
| LYD674 | tomato\|11v1\|BG133722 | 148 | 509 |
| LYD675 | tomato\|11v1\|BG134175 | 149 | 510 |
| LYD676 | tomato\|11v1\|BG135207 | 150 | 511 |
| LYD677 | tomato\|11v1\|BG592613 | 151 | 512 |
| LYD678 | tomato\|11v1\|BG626546 | 152 | 513 |
| LYD679 | tomato\|11v1\|BG628242 | 153 | 514 |
| LYD680 | tomato\|11v1\|BG628985 | 154 | 515 |
| LYD681 | tomato\|11v1\|BG630045 | 155 | 516 |
| LYD682 | tomato\|11v1\|BG630298 | 156 | 517 |
| LYD683 | tomato\|11v1\|BG643762 | 157 | 518 |
| LYD684 | tomato\|11v1\|BG734982 | 158 | 519 |
| LYD685 | tomato\|11v1\|BI210592 | 159 | 520 |
| LYD686 | tomato\|11v1\|BI405665 | 160 | 521 |
| LYD687 | tomato\|11v1\|BM066565 | 161 | 522 |
| LYD688 | tomato\|11v1\|BM067954 | 162 | 523 |
| LYD689 | tomato\|11v1\|BQ512926 | 163 | 524 |
| LYD690 | tomato\|11v1\|DV623174 | 164 | 525 |
| LYD539_H11 | arabidopsis\|10v1\|AT2G35260 | 165 | 526 |
| LYD532 | arabidopsis\|10v1\|AT5G02830 | 166 | 527 |
| LYD535 | arabidopsis\|10v1\|AT5G46790 | 167 | 375 |
| LYD538 | b_juncea\|10v2\|E6ANDIZ01AWH6F | 168 | 528 |
| LYD539 | b_juncea\|10v2\|E6ANDIZ01BOPVK | 169 | 529 |
| LYD540 | b_juncea\|10v2\|E6ANDIZ01CQ2ZQ | 170 | 530 |
| LYD541 | b_rapa\|11v1\|BQ704427 | 171 | 381 |
| LYD544 | brachypodium\|09v1\|GT835824 | 172 | 531 |
| LYD546 | brachypodium\|09v1\|SRR031797S0017542 | 173 | 532 |
| LYD548 | canola\|10v1\|CX192172 | 174 | 533 |
| LYD549 | canola\|10v1\|EE556201 | 175 | 534 |
| LYD550 | canola\|11v1\|DY020414 | 176 | 535 |
| LYD552 | canola\|11v1\|EE440823 | 177 | 392 |
| LYD553 | canola\|11v1\|EE481252 | 178 | 536 |
| LYD567 | medicago\|11v1\|AW125911 | 179 | 406 |
| LYD581 | medicago\|11v1\|AW980738 | 180 | 419 |
| LYD584 | medicago\|11v1\|BE325825 | 181 | 537 |
| LYD587 | medicago\|11v1\|BF005808 | 182 | 538 |
| LYD589 | medicago\|11v1\|BG644974 | 183 | 426 |
| LYD591 | medicago\|11v1\|EV259134 | 184 | 428 |
| LYD592 | medicago\|11v1\|XM_003625686 | 185 | 539 |
| LYD595 | rice\|gb170\|OS01G51360 | 186 | 432 |
| LYD597 | rice\|gb170\|OS02G22020 | 187 | 434 |
| LYD600 | rice\|gb170\|OS06G01200 | 188 | 437 |
| LYD604 | sorghum\|09v1\|SB01G049980 | 189 | 441 |
| LYD606 | sorghum\|09v1\|SB03G025590 | 190 | 443 |
| LYD616 | soybean\|11v1\|GLYMA03G36910 | 191 | 453 |
| LYD619 | soybean\|11v1\|GLYMA04G38690 | 192 | 540 |
| LYD628 | soybean\|11v1\|GLYMA09G27600 | 193 | 541 |
| LYD632 | soybean\|11v1\|GLYMA10G40890 | 194 | 542 |
| LYD654 | tomato\|11v1\|AI782247 | 195 | 544 |

TABLE 53-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Organism/Cluster tag | Polyn. SEQ ID NO: | Polyp SEQ ID NO: |
|---|---|---|---|
| LYD663 | tomato\|11v1\|AY376851 | 196 | 498 |
| LYD676 | tomato\|11v1\|BG135207 | 197 | 545 |
| LYD681 | tomato\|11v1\|BG630045 | 198 | 516 |
| LYD685 | tomato\|11v1\|BI210592 | 199 | 520 |
| LYD687 | tomato\|11v1\|BM066565 | 200 | 522 |
| LYD690 | tomato\|11v1\|DV623174 | 201 | 546 |
| LYD521 | *arabidopsis*\|10v1\|AT1G08410 | 202 | 362 |
| LYD522 | *arabidopsis*\|10v1\|AT1G19110 | 203 | 363 |
| LYD524 | *arabidopsis*\|10v1\|AT2G20340 | 204 | 364 |
| LYD525 | *arabidopsis*\|10v1\|AT2G45030 | 205 | 365 |
| LYD526 | *arabidopsis*\|10v1\|AT2G45730 | 206 | 366 |
| LYD527 | *arabidopsis*\|10v1\|AT2G47920 | 207 | 547 |
| LYD528 | *arabidopsis*\|10v1\|AT3G15650 | 208 | 368 |
| LYD529 | *arabidopsis*\|10v1\|AT4G00500 | 209 | 369 |
| LYD530 | *arabidopsis*\|10v1\|AT4G13110 | 210 | 548 |
| LYD531 | *arabidopsis*\|10v1\|AT4G16146 | 211 | 371 |
| LYD532 | *arabidopsis*\|10v1\|AT5G02830 | 212 | 549 |
| LYD533 | *arabidopsis*\|10v1\|AT5G06700 | 213 | 373 |
| LYD534 | *arabidopsis*\|10v1\|AT5G43150 | 214 | 374 |
| LYD535 | *arabidopsis*\|10v1\|AT5G46790 | 215 | 375 |
| LYD536 | *arabidopsis*\|10v1\|AT5G65280 | 216 | 376 |
| LYD537 | *b_juncea*\|10v2\|E6ANDIZ01AI14E | 217 | 550 |
| LYD538 | *b_juncea*\|10v2\|E6ANDIZ01AWH6F | 218 | 378 |
| LYD540 | *b_juncea*\|10v2\|E6ANDIZ01CQ2ZQ | 219 | 551 |
| LYD541 | *b_rapa*\|11v1\|BQ704427 | 220 | 381 |
| LYD542 | *brachypodium*\|09v1\|DV480497 | 221 | 382 |
| LYD543 | *brachypodium*\|09v1\|GT759735 | 222 | 552 |
| LYD545 | *brachypodium*\|09v1\|GT841411 | 223 | 385 |
| LYD546 | *brachypodium*\|09v1\|SRR031797S0017542 | 224 | 386 |
| LYD547 | canola\|10v1\|CD822163 | 225 | 387 |
| LYD548 | canola\|10v1\|CX192172 | 226 | 553 |
| LYD549 | canola\|10v1\|EE556201 | 227 | 554 |
| LYD550 | canola\|11v1\|DY020414 | 228 | 555 |
| LYD551 | canola\|11v1\|EE429972 | 229 | 391 |
| LYD552 | canola\|11v1\|EE440823 | 230 | 392 |
| LYD553 | canola\|11v1\|EE481252 | 231 | 556 |
| LYD554 | cotton\|10v2\|DN804535 | 232 | 557 |
| LYD555 | cotton\|11v1\|CO098912 | 233 | 558 |
| LYD556 | *lotus*\|09v1\|AW719664 | 234 | 396 |
| LYD558 | *medicago*\|09v1\|LLAW329230 | 235 | 397 |
| LYD559 | *medicago*\|11v1\|AI083094 | 236 | 559 |
| LYD560 | *medicago*\|11v1\|AI974457 | 237 | 560 |
| LYD561 | *medicago*\|11v1\|AJ388759 | 238 | 400 |
| LYD562 | *medicago*\|11v1\|AL368425 | 239 | 401 |
| LYD563 | *medicago*\|11v1\|AL370319 | 240 | 402 |
| LYD564 | *medicago*\|11v1\|AL372358 | 241 | 403 |
| LYD565 | *medicago*\|11v1\|AL383170 | 242 | 404 |
| LYD566 | *medicago*\|11v1\|AL384827 | 243 | 561 |
| LYD567 | *medicago*\|11v1\|AW125911 | 244 | 406 |
| LYD568 | *medicago*\|11v1\|AW126198 | 245 | 407 |
| LYD570 | *medicago*\|11v1\|AW299069 | 246 | 562 |
| LYD571 | *medicago*\|11v1\|AW299099 | 247 | 563 |
| LYD572 | *medicago*\|11v1\|AW683620 | 248 | 564 |
| LYD573 | *medicago*\|11v1\|AW684312 | 249 | 411 |
| LYD574 | *medicago*\|11v1\|AW686798 | 250 | 412 |
| LYD575 | *medicago*\|11v1\|AW688064 | 251 | 565 |
| LYD576 | *medicago*\|11v1\|AW688428 | 252 | 414 |
| LYD577 | *medicago*\|11v1\|AW690765 | 253 | 566 |
| LYD578 | *medicago*\|11v1\|AW691134 | 254 | 567 |
| LYD579 | *medicago*\|11v1\|AW695894 | 255 | 568 |
| LYD580 | *medicago*\|11v1\|AW775280 | 256 | 569 |
| LYD581 | *medicago*\|11v1\|AW980738 | 257 | 419 |
| LYD583 | *medicago*\|11v1\|BE204527 | 258 | 570 |
| LYD584 | *medicago*\|11v1\|BE325825 | 259 | 421 |
| LYD585 | *medicago*\|11v1\|BE942833 | 260 | 422 |
| LYD586 | *medicago*\|11v1\|BE998813 | 261 | 423 |
| LYD587 | *medicago*\|11v1\|BF005808 | 262 | 571 |
| LYD588 | *medicago*\|11v1\|BF640823 | 263 | 572 |
| LYD589 | *medicago*\|11v1\|BG644974 | 264 | 573 |
| LYD591 | *medicago*\|11v1\|EV259134 | 265 | 574 |
| LYD592 | *medicago*\|11v1\|XM_003625686 | 266 | 575 |
| LYD593 | *medicago*\|11v1\|AL366306 | 267 | 576 |
| LYD594 | *medicago*\|11v1\|BF633538 | 268 | 577 |
| LYD595 | rice\|gb170\|OS01G51360 | 269 | 432 |
| LYD596 | rice\|gb170\|OS01G70930 | 270 | 433 |
| LYD597 | rice\|gb170\|OS02G22020 | 271 | 434 |
| LYD598 | rice\|gb170\|OS03G12840 | 272 | 435 |
| LYD599 | rice\|gb170\|OS04G40100 | 273 | 436 |
| LYD600 | rice\|gb170\|OS06G01200 | 274 | 437 |
| LYD601 | rice\|gb170\|OS06G04250 | 275 | 438 |
| LYD602 | rice\|gb170\|OS06G33810 | 276 | 439 |
| LYD603 | rice\|gb170\|OS08G29170 | 277 | 440 |
| LYD604 | *sorghum*\|09v1\|SB01G049980 | 278 | 441 |
| LYD605 | *sorghum*\|09v1\|SB02G037340 | 279 | 578 |
| LYD606 | *sorghum*\|09v1\|SB03G025590 | 280 | 443 |
| LYD607 | *sorghum*\|09v1\|SB03G037600 | 281 | 444 |
| LYD608 | *sorghum*\|09v1\|SB06G006920 | 282 | 445 |
| LYD609 | *sorghum*\|09v1\|SB09G025850 | 283 | 446 |
| LYD610 | *sorghum*\|09v1\|SB01G036260 | 284 | 447 |
| LYD611 | soybean\|11v1\|GLYMA01G02290 | 285 | 448 |
| LYD612 | soybean\|11v1\|GLYMA02G02070 | 286 | 449 |
| LYD613 | soybean\|11v1\|GLYMA02G04840 | 287 | 450 |
| LYD614 | soybean\|11v1\|GLYMA02G42250 | 288 | 451 |
| LYD615 | soybean\|11v1\|GLYMA03G27800 | 289 | 452 |
| LYD616 | soybean\|11v1\|GLYMA03G36910 | 290 | 453 |
| LYD617 | soybean\|11v1\|GLYMA03G37120 | 291 | 454 |
| LYD618 | soybean\|11v1\|GLYMA03G41760 | 292 | 579 |
| LYD619 | soybean\|11v1\|GLYMA04G38690 | 293 | 580 |
| LYD620 | soybean\|11v1\|GLYMA05G00370 | 294 | 457 |
| LYD621 | soybean\|11v1\|GLYMA05G34620 | 295 | 458 |
| LYD622 | soybean\|11v1\|GLYMA06G03760 | 296 | 459 |
| LYD623 | soybean\|11v1\|GLYMA06G05880 | 297 | 460 |
| LYD624 | soybean\|11v1\|GLYMA06G11430 | 298 | 461 |
| LYD625 | soybean\|11v1\|GLYMA07G27370 | 299 | 462 |
| LYD626 | soybean\|11v1\|GLYMA08G14740 | 300 | 463 |
| LYD627 | soybean\|11v1\|GLYMA08G39520 | 301 | 464 |
| LYD628 | soybean\|11v1\|GLYMA09G27600 | 302 | 465 |
| LYD629 | soybean\|11v1\|GLYMA09G30190 | 303 | 466 |
| LYD630 | soybean\|11v1\|GLYMA09G35750 | 304 | 467 |
| LYD631 | soybean\|11v1\|GLYMA09G36720 | 305 | 468 |
| LYD632 | soybean\|11v1\|GLYMA10G40890 | 306 | 581 |
| LYD633 | soybean\|11v1\|GLYMA12G02590 | 307 | 470 |
| LYD634 | soybean\|11v1\|GLYMA12G09830 | 308 | 471 |
| LYD635 | soybean\|11v1\|GLYMA13G04780 | 309 | 472 |
| LYD636 | soybean\|11v1\|GLYMA13G18990 | 310 | 473 |
| LYD637 | soybean\|11v1\|GLYMA13G22160 | 311 | 582 |
| LYD638 | soybean\|11v1\|GLYMA13G41580 | 312 | 475 |
| LYD639 | soybean\|11v1\|GLYMA14G32430 | 313 | 476 |
| LYD640 | soybean\|11v1\|GLYMA14G35690 | 314 | 477 |
| LYD641 | soybean\|11v1\|GLYMA15G02690 | 315 | 583 |
| LYD642 | soybean\|11v1\|GLYMA15G15380 | 316 | 479 |
| LYD643 | soybean\|11v1\|GLYMA16G03140 | 317 | 480 |
| LYD644 | soybean\|11v1\|GLYMA17G01400 | 318 | 481 |
| LYD645 | soybean\|11v1\|GLYMA17G02420 | 319 | 482 |
| LYD646 | soybean\|11v1\|GLYMA17G10240 | 320 | 584 |
| LYD647 | soybean\|11v1\|GLYMA18G15530 | 321 | 484 |
| LYD648 | tomato\|10v1\|AI780847 | 322 | 485 |
| LYD650 | tomato\|11v1\|AF204783 | 323 | 585 |
| LYD651 | tomato\|11v1\|AF211784 | 324 | 586 |
| LYD652 | tomato\|11v1\|AI771255 | 325 | 587 |
| LYD654 | tomato\|11v1\|AI782247 | 326 | 490 |
| LYD655 | tomato\|11v1\|AI896168 | 327 | 491 |
| LYD657 | tomato\|11v1\|AW030194 | 328 | 492 |
| LYD658 | tomato\|11v1\|AW094631 | 329 | 493 |
| LYD659 | tomato\|11v1\|AW217526 | 330 | 494 |
| LYD660 | tomato\|11v1\|AW616260 | 331 | 588 |
| LYD661 | tomato\|11v1\|AW616620 | 332 | 496 |
| LYD662 | tomato\|11v1\|AW618546 | 333 | 497 |
| LYD663 | tomato\|11v1\|AY376851 | 334 | 498 |
| LYD664 | tomato\|11v1\|BE460507 | 335 | 499 |
| LYD665 | tomato\|11v1\|BF097728 | 336 | 589 |
| LYD666 | tomato\|11v1\|BG123259 | 337 | 590 |

TABLE 53-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Organism/Cluster tag | Polyn. SEQ ID NO: | Polyp SEQ ID NO: |
|---|---|---|---|
| LYD667 | tomato\|11v1\|BG123287 | 338 | 591 |
| LYD668 | tomato\|11v1\|BG125390 | 339 | 592 |
| LYD669 | tomato\|11v1\|BG125858 | 340 | 504 |
| LYD670 | tomato\|11v1\|BG126384 | 341 | 505 |
| LYD671 | tomato\|11v1\|BG129734 | 342 | 593 |
| LYD672 | tomato\|11v1\|BG131939 | 343 | 507 |
| LYD673 | tomato\|11v1\|BG132287 | 344 | 594 |
| LYD674 | tomato\|11v1\|BG133722 | 345 | 509 |
| LYD675 | tomato\|11v1\|BG134175 | 346 | 595 |
| LYD676 | tomato\|11v1\|BG135207 | 347 | 596 |
| LYD677 | tomato\|11v1\|BG592613 | 348 | 512 |
| LYD678 | tomato\|11v1\|BG626546 | 349 | 513 |
| LYD679 | tomato\|11v1\|BG628242 | 350 | 597 |
| LYD680 | tomato\|11v1\|BG628985 | 351 | 598 |
| LYD681 | tomato\|11v1\|BG630045 | 352 | 516 |
| LYD682 | tomato\|11v1\|BG630298 | 353 | 517 |
| LYD683 | tomato\|11v1\|BG643762 | 354 | 599 |
| LYD684 | tomato\|11v1\|BG734982 | 355 | 519 |
| LYD685 | tomato\|11v1\|BI210592 | 356 | 600 |
| LYD686 | tomato\|11v1\|BI405665 | 357 | 521 |
| LYD688 | tomato\|11v1\|BM067954 | 358 | 601 |
| LYD689 | tomato\|11v1\|BQ512926 | 359 | 524 |
| LYD690 | tomato\|11v1\|DV623174 | 360 | 525 |
| LYD539_H11 | *arabidopsis*\|10v1\|AT2G35260 | 361 | 526 |

Table 53: Provided are the identified genes, their annotation (cluster tag), organism and polynucleotide and polypeptide sequence identifiers.
"polyn." = polynucleotide;
"polyp." = polypeptide.

Example 13

Identification of Homologous Sequences that Increase Seed Yield, Oil Yield, Growth Rate, Oil Content, Fiber Yield, Fiber Quality, Biomass, Vigor, Abst and/or Nue of a Plant The concepts of orthology and paralogy have recently been applied to functional characterizations and classifications on the scale of whole-genome comparisons.

Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To identify putative orthologs of the genes affecting plant yield, oil yield, oil content, seed yield, growth rate, vigor, biomass, abiotic stress tolerance and/or nitrogen use efficiency, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level -identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database.

Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 53 (Example 12 above) were identified from the databases using BLAST software with the Blastp and tBlastn algorithms as filters for the first stage, and the needle (EMBOSS package) or Frame+ algorithm alignment for the second stage. Local identity (Blast alignments) was defined with a very permissive cutoff—60% Identity on a span of 60% of the sequences lengths because it is used only as a filter for the global alignment stage. The default filtering of the Blast package was not utilized (by setting the parameter "–F F").

In the second stage, homologs were defined based on a global identity of at least 80% to the core gene polypeptide sequence. Two distinct forms for finding the optimal global alignment for protein or nucleotide sequences were used in this application:

1. Between two proteins (following the blastp filter):
EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the tblastn filter):
GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options described hereinabove.

The query polypeptide sequences were SEQ ID NOs: 362-601 (which are encoded by the polynucleotides SEQ ID NOs:1-361, shown in Table 53 above) and the identified orthologous and homologous sequences having at least 80% global sequence identity are provided in Table 54, below. These homologous genes are expected to increase plant yield, seed yield, oil yield, oil content, growth rate, fiber yield, fiber quality, biomass, vigor, ABST and/or NUE of a plant.

TABLE 54

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD521_H1 | arabidopsis_lyrata\|09v1\|JGIAL000805_P1 | 602 | 2429 | 362 | 95.9 | globlastp |
| LYD521_H2 | thellungiella_parvulum\|11v1\|BY806918 | 603 | 2430 | 362 | 89.2 | globlastp |
| LYD521_H3 | thellungiella_halophilum\|11v1\|BY806918 | 604 | 2431 | 362 | 88.3 | globlastp |
| LYD521_H6 | b_rapa\|11v1\|CD813110_P1 | 605 | 2432 | 362 | 85.6 | globlastp |
| LYD521_H4 | canola\|11v1\|EE468045_P1 | 606 | 2433 | 362 | 85.2 | globlastp |
| LYD521_H5 | canola\|11v1\|ES952287_T1 | 607 | 2434 | 362 | 82.37 | glotblastn |
| LYD522_H1 | arabidopsis_lyrata\|09v1\|JGIAL002005_P1 | 608 | 2435 | 363 | 96.9 | globlastp |
| LYD522_H2 | thellungiella_halophilum\|11v1\|BQ079260 | 609 | 2436 | 363 | 92.1 | globlastp |
| LYD522_H3 | thellungiella_parvulum\|11v1\|BQ079260 | 610 | 2437 | 363 | 90.8 | globlastp |
| LYD522_H4 | canola\|11v1\|FG573664_T1 | 611 | 2438 | 363 | 89.27 | glotblastn |
| LYD522_H7 | b_rapa\|11v1\|DY013296_P1 | 612 | 2439 | 363 | 89 | globlastp |
| LYD522_H8 | b_rapa\|11v1\|EE443767_P1 | 613 | 2440 | 363 | 88.4 | globlastp |
| LYD522_H5 | canola\|11v1\|ES902667_T1 | 614 | 2441 | 363 | 88.39 | glotblastn |
| LYD522_H6 | canola\|11v1\|EE443767_P1 | 615 | 2442 | 363 | 87.6 | globlastp |
| LYD522_H9 | b_rapa\|11v1\|ES270429_P1 | 616 | 2443 | 363 | 87.2 | globlastp |
| LYD524_H1 | arabidopsis_lyrata\|09v1\|JGIAL012501_P1 | 617 | 2444 | 364 | 97.1 | globlastp |
| LYD524_H6 | b_rapa\|11v1\|E6ANDIZ01A63NK_P1 | 618 | 2445 | 364 | 89.8 | globlastp |
| LYD524_H2 | thellungiella_halophilum\|11v1\|EHJGI11021169 | 619 | 2446 | 364 | 89.6 | globlastp |
| LYD524_H3 | thellungiella_halophilum\|11v1\|EHJGI11027144 | 620 | 2447 | 364 | 87.8 | globlastp |
| LYD524_H7 | b_rapa\|11v1\|CD822356_P1 | 621 | 2448 | 364 | 86.8 | globlastp |
| LYD524_H8 | b_rapa\|11v1\|ES908014_P1 | 622 | 2449 | 364 | 85.7 | globlastp |
| LYD524_H4 | radish\|gb164\|EV536118 | 623 | 2450 | 364 | 84.8 | globlastp |
| LYD524_H5 | thellungiella_parvulum\|11v1\|EPCRP013365 | 624 | 2451 | 364 | 82.3 | globlastp |
| LYD524_H9 | b_rapa\|11v1\|SRR001111.64443_P1 | 625 | 2452 | 364 | 81.8 | globlastp |
| LYD525_H1 | arabidopsis_lyrata\|09v1\|JGIAL015890_P1 | 626 | 2453 | 365 | 98.7 | globlastp |
| LYD525_H2 | arabidopsis\|10v1\|AT1G45332_P1 | 627 | 2454 | 365 | 98.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD525_H3 | thellungiella_halophilum\|11v1\|BY819164 | 628 | 2455 | 365 | 95.5 | globlastp |
| LYD525_H4 | thellungiella_parvulum\|11v1\|BY819164 | 629 | 2456 | 365 | 94.2 | globlastp |
| LYD525_H38 | b_rapa\|11v1\|AT000510_P1 | 630 | 2457 | 365 | 92.7 | globlastp |
| LYD525_H5 | cacao\|10v1\|CU478363_P1 | 631 | 2458 | 365 | 87.3 | globlastp |
| LYD525_H39 | cotton\|11v1\|DT462624_P1 | 632 | 2459 | 365 | 86.3 | globlastp |
| LYD525_H6 | cotton\|10v2\|SRR032367S0023872 | 633 | 2460 | 365 | 86.3 | globlastp |
| LYD525_H40 | gossypium_raimondii\|12v1\|DT462624_P1 | 634 | 2461 | 365 | 86.1 | globlastp |
| LYD525_H41 | cotton\|11v1\|DT047985_P1 | 635 | 2462 | 365 | 86 | globlastp |
| LYD525_H42 | gossypium_raimondii\|12v1\|ES825881_P1 | 636 | 2463 | 365 | 86 | globlastp |
| LYD525_H43 | bean\|12v1\|CB539945_P1 | 637 | 2464 | 365 | 85.3 | globlastp |
| LYD525_H44 | chickpea\|11v1\|GR393166_P1 | 638 | 2465 | 365 | 84.8 | globlastp |
| LYD525_H7 | grape\|11v1\|GSVIVT01018186001_P1 | 639 | 2466 | 365 | 84.5 | globlastp |
| LYD525_H45 | beech\|11v1\|SRR006294.21324_P1 | 640 | 2467 | 365 | 84.4 | globlastp |
| LYD525_H8 | cotton\|10v2\|SRR032367S0009321 | 641 | 2468 | 365 | 84.2 | globlastp |
| LYD525_H9 | apple\|11v1\|CN899815_P1 | 642 | 2469 | 365 | 84.1 | globlastp |
| LYD525_H10 | clementine\|11v1\|DY261585_P1 | 643 | 2470 | 365 | 84 | globlastp |
| LYD525_H11 | orange\|11v1\|DY261585_P1 | 644 | 2470 | 365 | 84 | globlastp |
| LYD525_H12 | cucumber\|09v1\|DV631607_P1 | 645 | 2471 | 365 | 83.9 | globlastp |
| LYD525_H13 | amsonia\|11v1\|SRR098688X113063_T1 | 646 | 2472 | 365 | 83.66 | glotblastn |
| LYD525_H14 | poplar\|10v1\|BI136702_P1 | 647 | 2473 | 365 | 83.6 | globlastp |
| LYD525_H15 | aquilegia\|10v2\|DT749020_P1 | 648 | 2474 | 365 | 83.4 | globlastp |
| LYD525_H16 | eucalyptus\|11v2\|SRR001659X12134_P1 | 649 | 2475 | 365 | 83.3 | globlastp |
| LYD525_H17 | watermelon\|11v1\|AM716765 | 650 | 2476 | 365 | 83.2 | globlastp |
| LYD525_H18 | prunus\|10v1\|CN899815 | 651 | 2477 | 365 | 83.1 | globlastp |
| LYD525_H19 | euphorbia\|11v1\|DV149525_P1 | 652 | 2478 | 365 | 82.9 | globlastp |
| LYD525_H20 | cassava\|09v1\|JGICASSAVA2572VALIDM1_P1 | 653 | 2479 | 365 | 82.5 | globlastp |
| LYD525_H21 | strawberry\|11v1\|DV439076 | 654 | 2480 | 365 | 82.3 | globlastp |
| LYD525_H22 | tomato\|11v1\|AW032413 | 655 | 2481 | 365 | 82.3 | globlastp |
| LYD525_H46 | poppy\|11v1\|SRR030259.126125_T1 | 656 | 2482 | 365 | 82.26 | glotblastn |
| LYD525_H47 | banana\|12v1\|MAGEN2012034630_P1 | 657 | 2483 | 365 | 82 | globlastp |
| LYD525_H23 | vinca\|11v1\|SRR098690X120383 | 658 | 2484 | 365 | 82 | globlastp |
| LYD525_H24 | valeriana\|11v1\|SRR099039X102865 | 659 | 2485 | 365 | 81.87 | glotblastn |
| LYD525_H25 | potato\|10v1\|BG591483_P1 | 660 | 2486 | 365 | 81.8 | globlastp |
| LYD525_H26 | solanum_phureja\|09v1\|SPHAW032413 | 661 | 2486 | 365 | 81.8 | globlastp |
| LYD525_H48 | medicago\|12v1\|BF634704_P1 | 662 | 2487 | 365 | 81.7 | globlastp |
| LYD525_H27 | poplar\|10v1\|CX282997_T1 | 663 | 2488 | 365 | 81.44 | glotblastn |
| LYD525_H28 | lettuce\|10v1\|DW064105 | 664 | 2489 | 365 | 81.2 | globlastp |
| LYD525_H49 | beet\|12v1\|BI096237_P1 | 665 | 2490 | 365 | 81.1 | globlastp |
| LYD525_H29 | phalaenopsis\|11v1\|SRR125771.1000581_P1 | 666 | 2491 | 365 | 81 | globlastp |
| LYD525_H30 | trigonella\|11v1\|SRR066195X105848 | 667 | 2492 | 365 | 80.9 | glotblastn |
| LYD525_H50 | oil_palm\|11v1\|EY403951_P1 | 668 | 2493 | 365 | 80.8 | globlastp |
| LYD525_H51 | brachypodium\|12v1\|BRADI1G41990_P1 | 669 | 2494 | 365 | 80.7 | globlastp |
| LYD525_H31 | brachypodium\|09v1\|DV479885 | 670 | 2494 | 365 | 80.7 | globlastp |
| LYD525_H32 | flaveria\|11v1\|SRR149229.134858_P1 | 671 | 2495 | 365 | 80.7 | globlastp |
| LYD525_H33 | flaveria\|11v1\|SRR149229.104091_P1 | 672 | 2496 | 365 | 80.6 | globlastp |
| LYD525_H34 | monkeyflower\|10v1\|CV521415_T1 | 673 | 2497 | 365 | 80.5 | glotblastn |
| LYD525_H35 | arnica\|11v1\|SRR099034X126312_T1 | 674 | 2498 | 365 | 80.39 | glotblastn |
| LYD525_H52 | sorghum\|12v1\|SB01G001500_T1 | 675 | 2499 | 365 | 80.26 | glotblastn |
| LYD525_H36 | sorghum\|11v1\|SB01G001500 | 676 | 2499 | 365 | 80.26 | glotblastn |
| LYD525_H37 | rice\|11v1\|AA749912_P1 | 677 | 2500 | 365 | 80.1 | globlastp |
| LYD525_H37 | rice\|gb170\|OS03G36780 | 678 | 2500 | 365 | 80.1 | globlastp |
| LYD526_H1 | arabidopsis_lyrata\|09v1\|JGIAL015968_T1 | 679 | 2501 | 366 | 94.87 | glotblastn |
| LYD526_H2 | thellungiella_halophilum\|11v1\|EHJGI11009328 | 680 | 2502 | 366 | 88.3 | globlastp |
| LYD526_H3 | thellungiella_parvulum\|11v1\|BY818477 | 681 | 2503 | 366 | 87.7 | globlastp |
| LYD526_H4 | canola\|11v1\|EE446150_T1 | 682 | 2504 | 366 | 85.27 | glotblastn |
| LYD526_H5 | radish\|gb164\|EV543432 | 683 | 2505 | 366 | 84.73 | glotblastn |
| LYD526_H8 | b_rapa\|11v1\|EE446150_P1 | 684 | 2506 | 366 | 84 | globlastp |
| LYD526_H9 | b_juncea\|12v1\|E6ANDIZ02HAY46_P1 | 685 | 2507 | 366 | 82.7 | globlastp |
| LYD526_H6 | canola\|11v1\|SRR019557.37442_T1 | 686 | 2508 | 366 | 82.55 | glotblastn |
| LYD526_H10 | b_rapa\|11v1\|CN829199_P1 | 687 | 2509 | 366 | 82.4 | globlastp |
| LYD526_H7 | canola\|11v1\|EV120639_P1 | 688 | 2510 | 366 | 81.8 | globlastp |
| LYD527_H1 | arabidopsis_lyrata\|09v1\|JGIAL016215_P1 | 689 | 2511 | 367 | 86.3 | globlastp |
| LYD527_H2 | arabidopsis_lyrata\|09v1\|CRPALE018554_P1 | 690 | 2512 | 367 | 85.9 | globlastp |
| LYD528_H1 | arabidopsis_lyrata\|09v1\|JGIAL010051_P1 | 691 | 2513 | 368 | 98.4 | globlastp |
| LYD528_H2 | thellungiella_parvulum\|11v1\|EPCRP009845 | 692 | 2514 | 368 | 94.9 | globlastp |
| LYD528_H17 | b_rapa\|11v1\|DN964807_P1 | 693 | 2515 | 368 | 94.5 | globlastp |
| LYD528_H3 | canola\|11v1\|SRR329661.233011_P1 | 694 | 2516 | 368 | 94.1 | globlastp |
| LYD528_H4 | thellungiella_halophilum\|11v1\|EHJGI11003890 | 695 | 2517 | 368 | 93.3 | globlastp |
| LYD528_H5 | canola\|11v1\|SRR341923.1074360_T1 | 696 | 2518 | 368 | 92.94 | glotblastn |
| LYD528_H6 | canola\|11v1\|SRR329661.212936_T1 | 697 | 2519 | 368 | 92.55 | glotblastn |
| LYD528_H7 | canola\|11v1\|SRR329661.203365_T1 | 698 | 2520 | 368 | 92.16 | glotblastn |
| LYD528_H18 | b_rapa\|11v1\|EX109671_P1 | 699 | 2521 | 368 | 89.6 | globlastp |
| LYD528_H19 | b_rapa\|11v1\|E6ANDIZ01EED7M_P1 | 700 | 2522 | 368 | 89.2 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD528_H8 | thellungiella_parvulum\|11v1\|EPCRP002185 | 701 | 2523 | 368 | 87.1 | globlastp |
| LYD528_H9 | arabidopsis_lyrata\|09v1\|JGIAL004771_T1 | 702 | 2524 | 368 | 86.77 | glotblastn |
| LYD528_H10 | arabidopsis\|10v1\|AT1G52700_P1 | 703 | 2525 | 368 | 86.3 | globlastp |
| LYD528_H11 | thellungiella_halophilum\|11v1\|EHJGI11004658 | 704 | 2526 | 368 | 85.5 | globlastp |
| LYD528_H12 | canola\|11v1\|SRR341920.125536_P1 | 705 | 2527 | 368 | 85.1 | globlastp |
| LYD528_H13 | radish\|gb164\|EW717735 | 706 | 2528 | 368 | 85.1 | globlastp |
| LYD528_H20 | b_rapa\|11v1\|BRA030973_P1 | 707 | 2529 | 368 | 84.7 | globlastp |
| LYD528_H14 | b_rapa\|gb162\|DN964807 | 708 | 2530 | 368 | 83.9 | globlastp |
| LYD528_H21 | b_rapa\|11v1\|E6ANDIZ01EBPM4_T1 | 709 | 2531 | 368 | 81.96 | glotblastn |
| LYD528_H15 | castorbean\|11v1\|EG661187_P1 | 710 | 2532 | 368 | 81.8 | globlastp |
| LYD528_H16 | poplar\|10v1\|BU891181_P1 | 711 | 2533 | 368 | 80.6 | globlastp |
| LYD529_H1 | arabidopsis_lyrata\|09v1\|JGIAL023826_P1 | 712 | 2534 | 369 | 96.1 | globlastp |
| LYD529_H2 | thellungiella_halophilum\|11v1\|EHJGI11017680 | 713 | 2535 | 369 | 90 | globlastp |
| LYD529_H3 | thellungiella_parvulum\|11v1\|EPCRP024486 | 714 | 2536 | 369 | 89.3 | globlastp |
| LYD529_H4 | canola\|11v1\|EV182687_T1 | 715 | 2537 | 369 | 87.04 | glotblastn |
| LYD529_H5 | b_rapa\|11v1\|EV182687_P1 | 716 | 2538 | 369 | 86.8 | globlastp |
| LYD531_H1 | arabidopsis_lyrata\|09v1\|JGIAL026618_P1 | 717 | 2539 | 371 | 90.2 | globlastp |
| LYD531_H2 | canola\|11v1\|EE458414_P1 | 718 | 2540 | 371 | 83.3 | globlastp |
| LYD531_H3 | b_oleracea\|gb161\|EH427989_P1 | 719 | 2541 | 371 | 80.4 | globlastp |
| LYD532_H1 | arabidopsis_lyrata\|09v1\|CRPALE021692_P1 | 720 | 2542 | 372 | 93 | globlastp |
| LYD532_H2 | thellungiella_halophilum\|11v1\|EHJGI11026551 | 721 | 2543 | 372 | 88.7 | globlastp |
| LYD532_H3 | thellungiella_parvulum\|11v1\|EPCRP024311 | 722 | 2544 | 372 | 88.5 | globlastp |
| LYD532_H4 | b_rapa\|11v1\|H07430_P1 | 723 | 2545 | 372 | 85.5 | globlastp |
| LYD533_H1 | arabidopsis_lyrata\|09v1\|JGIAL020349_P1 | 724 | 2546 | 373 | 95.3 | globlastp |
| LYD533_H2 | thellungiella_halophilum\|11v1\|DN772696 | 725 | 2547 | 373 | 85 | globlastp |
| LYD533_H3 | thellungiella_parvulum\|11v1\|DN772696 | 726 | 2548 | 373 | 85 | globlastp |
| LYD533_H4 | b_rapa\|11v1\|DY006448_P1 | 727 | 2549 | 373 | 80.6 | globlastp |
| LYD534_H1 | arabidopsis_lyrata\|09v1\|JGIAL028732_P1 | 728 | 2550 | 374 | 94.6 | globlastp |
| LYD534_H2 | thellungiella_halophilum\|11v1\|EHJGI11028247 | 729 | 2551 | 374 | 83.5 | globlastp |
| LYD534_H3 | b_juncea\|10v2\|E6ANDIZ01AURFX_P1 | 730 | 2552 | 374 | 83 | globlastp |
| LYD534_H3 | b_juncea\|10v2\|E6ANDIZ01AURFX | 731 | — | 374 | 83 | globlastp |
| LYD534_H4 | b_oleracea\|gb161\|AM062082_T1 | 732 | 2553 | 374 | 82.61 | glotblastn |
| LYD534_H5 | thellungiella_halophilum\|11v1\|EHPRD125218 | 733 | 2554 | 374 | 82.47 | glotblastn |
| LYD534_H6 | b_rapa\|gb162\|CV546549 | 734 | 2555 | 374 | 81.91 | glotblastn |
| LYD534_H7 | radish\|gb164\|EW725622 | 735 | 2556 | 374 | 81.91 | glotblastn |
| LYD534_H12 | b_rapa\|11v1\|CV546549_P1 | 736 | 2557 | 374 | 81.9 | globlastp |
| LYD534_H8 | b_juncea\|10v2\|E6ANDIZ01BUSA3 | 737 | 2558 | 374 | 81.9 | globlastp |
| LYD534_H9 | canola\|11v1\|EV089507_P1 | 738 | 2557 | 374 | 81.9 | globlastp |
| LYD534_H10 | canola\|11v1\|EE446184_P1 | 739 | 2559 | 374 | 81.5 | globlastp |
| LYD534_H13 | b_juncea\|12v1\|E6ANDIZ01BUSA3_P1 | 740 | 2560 | 374 | 80.9 | globlastp |
| LYD534_H11 | b_juncea\|10v2\|E6ANDIZ01A0W7T | 741 | 2561 | 374 | 80.9 | globlastp |
| LYD534_H14 | b_rapa\|11v1\|CD829151_P1 | 742 | 2562 | 374 | 80.2 | globlastp |
| LYD534_H15 | b_rapa\|11v1\|EE505776_P1 | 743 | 2562 | 374 | 80.2 | globlastp |
| LYD535_H1 | arabidopsis_lyrata\|09v1\|JGIAL028142_P1 | 744 | 2563 | 375 | 89.1 | globlastp |
| LYD536_H1 | arabidopsis_lyrata\|09v1\|JGIAL031214_P1 | 745 | 2564 | 376 | 92.6 | globlastp |
| LYD536_H2 | thellungiella_halophilum\|11v1\|EHJGI11019132 | 746 | 2565 | 376 | 88.8 | globlastp |
| LYD536_H3 | thellungiella_parvulum\|11v1\|EPCRP006079 | 747 | 2566 | 376 | 87.56 | glotblastn |
| LYD536_H4 | canola\|11v1\|DW999348_P1 | 748 | 2567 | 376 | 87.2 | globlastp |
| LYD536_H6 | b_rapa\|11v1\|CD815782_P1 | 749 | 2568 | 376 | 87 | globlastp |
| LYD536_H7 | b_juncea\|12v1\|E6ANDIZ01CHJGT_P1 | 750 | 2569 | 376 | 86.3 | globlastp |
| LYD536_H5 | radish\|gb164\|EW715863 | 751 | 2570 | 376 | 86.3 | globlastp |
| LYD537_H10 | b_rapa\|11v1\|EH416474_P1 | 752 | 2571 | 377 | 97.5 | globlastp |
| LYD537_H1 | b_rapa\|gb162\|EX039662 | 753 | 2571 | 377 | 97.5 | globlastp |
| LYD537_H3 | b_oleracea\|gb161\|AM387255_T1 | 754 | 2572 | 377 | 96.45 | glotblastn |
| LYD537_H4 | canola\|11v1\|EV093336_T1 | 755 | 2573 | 377 | 95.43 | glotblastn |
| LYD537_H6 | thellungiella_halophilum\|11v1\|DN774047 | 756 | 2574 | 377 | 89.4 | globlastp |
| LYD537_H7 | thellungiella\|gb167\|DN774047 | 757 | 2574 | 377 | 89.4 | globlastp |
| LYD537_H9 | arabidopsis_lyrata\|09v1\|JGIAL011355_P1 | 758 | 2575 | 377 | 86 | globlastp |
| LYD538_H22 | b_rapa\|11v1\|D78493_P1 | 759 | 378 | 378 | 100 | globlastp |
| LYD538_H2 | b_rapa\|gb162\|D78493 | 760 | 378 | 378 | 100 | globlastp |
| LYD538_H23 | b_juncea\|12v1\|E6ANDIZ01A102H_P1 | 761 | 2576 | 378 | 98.3 | globlastp |
| LYD538_H3 | b_oleracea\|gb161\|AM388274_P1 | 762 | 2577 | 378 | 98.3 | globlastp |
| LYD538_H4 | canola\|11v1\|CN829815_P1 | 763 | 2578 | 378 | 97.9 | globlastp |
| LYD538_H24 | b_juncea\|12v1\|E6ANDIZ01A6UK3_P1 | 764 | 2579 | 378 | 97.4 | globlastp |
| LYD538_H25 | b_juncea\|12v1\|E6ANDIZ01D1DA8_P1 | 765 | 2580 | 378 | 97.4 | globlastp |
| LYD538_H5 | b_juncea\|10v2\|E6ANDIZ01A102H | 766 | 2581 | 378 | 97 | globlastp |
| LYD538_H6 | b_juncea\|10v2\|E6ANDIZ01D1DA8 | 767 | 2582 | 378 | 97 | globlastp |
| LYD538_H1 | canola\|11v1\|DY025281_P1 | 768 | 2583 | 378 | 96.2 | globlastp |
| LYD538_H8 | b_rapa\|gb162\|CA992498 | 769 | 2584 | 378 | 94.9 | globlastp |
| LYD538_H9 | canola\|11v1\|CN732901_P1 | 770 | 2585 | 378 | 94.9 | globlastp |
| LYD538_H26 | b_juncea\|12v1\|E6ANDIZ01A8ZZF_P1 | 771 | 2586 | 378 | 94.4 | globlastp |
| LYD538_H27 | wheat\|12v3\|ERR125558X206533D1_P1 | 772 | 2587 | 378 | 94.4 | globlastp |
| LYD538_H7 | b_juncea\|10v2\|E6ANDIZ01AFTUB | 773 | 2586 | 378 | 94.4 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD538_H11 | b_juncea\|10v2\|E6ANDIZ01A8ZZF | 774 | 2588 | 378 | 94.4 | globlastp |
| LYD538_H28 | b_rapa\|11v1\|CD830505_P1 | 775 | 2589 | 378 | 94 | globlastp |
| LYD538_H12 | radish\|gb164\|EX762568 | 776 | 2590 | 378 | 94 | globlastp |
| LYD538_H15 | radish\|gb164\|EY906991 | 777 | 2591 | 378 | 93.6 | globlastp |
| LYD538_H14 | radish\|gb164\|EV543577 | 778 | 2592 | 378 | 93.2 | globlastp |
| LYD538_H16 | thellungiella_halophilum\|11v1\|DN773489 | 779 | 2593 | 378 | 92.7 | globlastp |
| LYD538_H17 | thellungiella_parvulum\|11v1\|DN773489 | 780 | 2594 | 378 | 92.7 | globlastp |
| LYD538_H18 | thellungiella_parvulum\|11v1\|EPPRD115512 | 781 | 2594 | 378 | 92.7 | globlastp |
| LYD538_H19 | thellungiella\|gb167\|DN773489 | 782 | 2593 | 378 | 92.7 | globlastp |
| LYD538_H20 | radish\|gb164\|EV536694 | 783 | 2595 | 378 | 91.9 | globlastp |
| LYD538_H10 | arabidopsis_lyrata\|09v1\|JGIAL022891_P1 | 784 | 2596 | 378 | 85.9 | globlastp |
| LYD538_H13 | arabidopsis\|10v1\|AT4G09650_P1 | 785 | 2597 | 378 | 85.1 | globlastp |
| LYD538_H21 | cleome_spinosa\|10v1\|SRR015531S0004048_P1 | 786 | 2598 | 378 | 80.1 | globlastp |
| LYD539_H14 | b_rapa\|11v1\|ES922502_P1 | 787 | 2599 | 379 | 95.7 | globlastp |
| LYD539_H7 | canola\|11v1\|EV186519_P1 | 788 | 2600 | 379 | 95.7 | globlastp |
| LYD539_H10 | b_rapa\|gb162\|EX024134 | 789 | 2601 | 379 | 95.21 | glotblastn |
| LYD539_H8 | canola\|11v1\|EV204662_P1 | 790 | 2602 | 379 | 93.4 | globlastp |
| LYD539_H15 | b_juncea\|12v1\|E6ANDIZ01B2FLS_P1 | 791 | 2603 | 379 | 92.8 | globlastp |
| LYD539_H16 | b_rapa\|11v1\|EH415044_P1 | 792 | 2604 | 379 | 92.8 | globlastp |
| LYD539_H1 | canola\|11v1\|EE473969_P1 | 793 | 2605 | 379 | 92.3 | globlastp |
| LYD539_H2 | canola\|11v1\|EE431340_P1 | 794 | 2606 | 379 | 92.3 | globlastp |
| LYD539_H4 | thellungiella_parvulum\|11v1\|DN772747 | 795 | 2607 | 379 | 91.1 | globlastp |
| LYD539_H3 | radish\|gb164\|EV546508 | 796 | 2608 | 379 | 90.2 | globlastp |
| LYD539_H6 | arabidopsis_lyrata\|09v1\|JGIAL014664_P1 | 797 | 2609 | 379 | 90.2 | globlastp |
| LYD539_H9 | thellungiella_halophilum\|11v1\|DN772747 | 798 | 2610 | 379 | 89.5 | globlastp |
| LYD540_H5 | b_rapa\|11v1\|CN830957_P1 | 799 | 2611 | 380 | 89.5 | globlastp |
| LYD540_H1 | canola\|11v1\|CN830957_P1 | 800 | 2612 | 380 | 88.7 | globlastp |
| LYD541_H1 | canola\|11v1\|ES977027_T1 | 801 | 2613 | 381 | 99.23 | glotblastn |
| LYD541_H7 | wheat\|12v3\|TA12V3PRD011584_T1 | 802 | 2614 | 381 | 92.81 | glotblastn |
| LYD541_H2 | thellungiella_parvulum\|11v1\|EPCRP002741 | 803 | 2615 | 381 | 88.7 | globlastp |
| LYD541_H3 | canola\|11v1\|ES976757_T1 | 804 | 2616 | 381 | 88.55 | glotblastn |
| LYD541_H8 | b_rapa\|11v1\|AM395348_P1 | 805 | 2617 | 381 | 86.8 | globlastp |
| LYD541_H4 | thellungiella_halophilum\|11v1\|EHJGI11022196 | 806 | 2618 | 381 | 86.42 | glotblastn |
| LYD541_H5 | canola\|11v1\|EE503031XX1_P1 | 807 | 2619 | 381 | 84.1 | globlastp |
| LYD541_H6 | arabidopsis_lyrata\|09v1\|JGIAL017560_P1 | 808 | 2620 | 381 | 80.9 | globlastp |
| LYD542_H1 | barley\|10v2\|BF622260 | 809 | 2621 | 382 | 92.3 | globlastp |
| LYD542_H2 | wheat\|10v2\|BE428760 | 810 | 2622 | 382 | 92.1 | globlastp |
| LYD542_H2 | wheat\|12v3\|BQ579180_P1 | 811 | 2622 | 382 | 92.1 | globlastp |
| LYD542_H3 | foxtail_millet\|11v3\|PHY7SI017408M_P1 | 812 | 2623 | 382 | 87.2 | globlastp |
| LYD542_H7 | sorghum\|12v1\|SB04G028030_P1 | 813 | 2624 | 382 | 87 | globlastp |
| LYD542_H4 | sorghum\|11v1\|SB04G028030 | 814 | 2624 | 382 | 87 | globlastp |
| LYD542_H5 | maize\|10v1\|AI600679_P1 | 815 | 2625 | 382 | 85.6 | globlastp |
| LYD542_H6 | rice\|11v1\|CA753844_P1 | 816 | 2626 | 382 | 84.4 | globlastp |
| LYD542_H6 | rice\|gb170\|OS02G51100 | 817 | 2627 | 382 | 81.8 | globlastp |
| LYD542_H8 | rye\|12v1\|DRR001012.114491_P1 | 818 | 2628 | 382 | 80.4 | globlastp |
| LYD544_H1 | brachypodium\|12v1\|BRADI2G59740_T1 | 819 | 2629 | 384 | 86.63 | glotblastn |
| LYD545_H14 | brachypodium\|12v1\|BRADI1G39260_P1 | 820 | 2630 | 385 | 95.6 | globlastp |
| LYD545_H1 | rice\|11v1\|BI808593_P1 | 821 | 2631 | 385 | 89.3 | globlastp |
| LYD545_H1 | rice\|gb170\|OS06G31100 | 822 | 2631 | 385 | 89.3 | globlastp |
| LYD545_H15 | sorghum\|12v1\|SB10G020060_P1 | 823 | 2632 | 385 | 89.1 | globlastp |
| LYD545_H2 | sorghum\|11v1\|SB10G020060 | 824 | 2632 | 385 | 89.1 | globlastp |
| LYD545_H3 | foxtail_millet\|11v3\|PHY7SI006167M_P1 | 825 | 2633 | 385 | 88.6 | globlastp |
| LYD545_H16 | rye\|12v1\|BE587152_P1 | 826 | 2634 | 385 | 88.4 | globlastp |
| LYD545_H17 | rye\|12v1\|DRR001012.114248_P1 | 827 | 2635 | 385 | 88.4 | globlastp |
| LYD545_H18 | rye\|12v1\|DRR001012.135473_P1 | 828 | 2636 | 385 | 88.3 | globlastp |
| LYD545_H4 | sugarcane\|10v1\|CA093342 | 829 | 2637 | 385 | 88.3 | globlastp |
| LYD545_H5 | wheat\|12v3\|BE404680_P1 | 830 | 2638 | 385 | 88.3 | globlastp |
| LYD545_H5 | wheat\|10v2\|BE403258 | 831 | 2639 | 385 | 87.9 | globlastp |
| LYD545_H6 | wheat\|10v2\|BG906212 | 832 | 2640 | 385 | 87.6 | globlastp |
| LYD545_H7 | wheat\|10v2\|BE586039 | 833 | 2641 | 385 | 87.4 | globlastp |
| LYD545_H8 | leymus\|gb166\|EG379479_P1 | 834 | 2642 | 385 | 87.3 | globlastp |
| LYD545_H9 | maize\|10v1\|BG458966_P1 | 835 | 2643 | 385 | 87.2 | globlastp |
| LYD545_H19 | wheat\|12v3\|BE586039_P1 | 836 | 2644 | 385 | 84.7 | globlastp |
| LYD545_H10 | switchgrass\|gb167\|FE609538 | 837 | 2645 | 385 | 80.64 | glotblastn |
| LYD545_H11 | maize\|10v1\|BG517650_T1 | 838 | 2646 | 385 | 80.28 | glotblastn |
| LYD545_H20 | sorghum\|12v1\|SB04G009720_T1 | 839 | 2647 | 385 | 80.11 | glotblastn |
| LYD545_H12 | sorghum\|11v1\|SB04G009720 | 840 | 2647 | 385 | 80.11 | glotblastn |
| LYD545_H13 | foxtail_millet\|11v3\|EC613481_P1 | 841 | 2648 | 385 | 80 | globlastp |
| LYD547_H11 | b_rapa\|11v1\|CD822163_P1 | 842 | 387 | 387 | 100 | globlastp |
| LYD547_H1 | b_rapa\|gb162\|CV545936 | 843 | 387 | 387 | 100 | globlastp |
| LYD547_H12 | b_juncea\|12v1\|E6ANDIZ01BB4X5_P1 | 844 | 2649 | 387 | 96.7 | globlastp |
| LYD547_H2 | b_oleracea\|gb161\|EE535189_P1 | 845 | 2650 | 387 | 95 | globlastp |
| LYD547_H3 | radish\|gb164\|EX749320 | 846 | 2651 | 387 | 89 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD547_H4 | radish\|gb164\|EX772827 | 847 | 2652 | 387 | 88.4 | glotblastn |
| LYD547_H5 | radish\|gb164\|EV524435 | 848 | 2653 | 387 | 87.8 | globlastp |
| LYD547_H6 | b_juncea\|10v2\|E6ANDIZ01BB4X5 | 849 | 2654 | 387 | 86.74 | glotblastn |
| LYD547_H7, LYD547_H8 | arabidopsis\|10v1\|AT1G10522_P1 | 850 | 2655 | 387 | 83.5 | globlastp |
| LYD547_H7, LYD547_H8 | arabidopsis\|10v1\|AT1G10522 | 851 | — | 387 | 83.5 | globlastp |
| LYD547_H9 | thellungiella_halophilum\|11v1\|BY811044 | 852 | 2656 | 387 | 82.6 | globlastp |
| LYD547_H10 | thellungiella\|gb167\|BY811044 | 853 | 2656 | 387 | 82.6 | globlastp |
| LYD548_H15 | b_rapa\|11v1\|CV433382_P1 | 854 | 2657 | 388 | 99.4 | globlastp |
| LYD548_H1 | canola\|11v1\|EV096783_P1 | 855 | 2658 | 388 | 99.1 | globlastp |
| LYD548_H2 | b_rapa\|gb162\|CV433382 | 856 | 2659 | 388 | 99.1 | globlastp |
| LYD548_H16 | b_juncea\|12v1\|E6ANDIZ01BQSST_P1 | 857 | 2660 | 388 | 97.8 | globlastp |
| LYD548_H4 | radish\|gb164\|EV524991 | 858 | 2661 | 388 | 97.5 | globlastp |
| LYD548_H5 | thellungiella_parvulum\|11v1\|BI698654 | 859 | 2662 | 388 | 96 | globlastp |
| LYD548_H7 | thellungiella_halophilum\|11v1\|DN772727 | 860 | 2663 | 388 | 93.8 | globlastp |
| LYD548_H8 | thellungiella\|gb167\|BI698654 | 861 | 2663 | 388 | 93.8 | globlastp |
| LYD548_H6 | arabidopsis\|10v1\|AT4G09750_P1 | 862 | 2664 | 388 | 92.9 | globlastp |
| LYD548_H9 | arabidopsis_lyrata\|09v1\|JGIAL022899_P1 | 863 | 2665 | 388 | 92.9 | globlastp |
| LYD548_H10 | cleome_spinosa\|10v1\|SRR015531S0001848_P1 | 864 | 2666 | 388 | 85.1 | globlastp |
| LYD548_H17 | nasturtium\|11v1\|SRR032558.125769_P1 | 865 | 2667 | 388 | 82 | globlastp |
| LYD548_H18 | heritiera\|10v1\|SRR005794S0003093_P1 | 866 | 2668 | 388 | 80 | globlastp |
| LYD549_H2 | thellungiella_parvulum\|11v1\|BY806948 | 867 | 2669 | 389 | 85 | globlastp |
| LYD549_H3 | thellungiella_halophilum\|11v1\|BY806948 | 868 | 2670 | 389 | 80.7 | globlastp |
| LYD549_H4 | arabidopsis_lyrata\|09v1\|JGIAL014484_P1 | 869 | 2671 | 389 | 80.7 | globlastp |
| LYD549_H5 | arabidopsis\|10v1\|AT2G33580_P1 | 870 | 2672 | 389 | 80.7 | globlastp |
| LYD550_H46 | b_rapa\|11v1\|CX270458_P1 | 871 | 2673 | 390 | 95.7 | globlastp |
| LYD550_H2 | thellungiella_halophilum\|11v1\|DN774121 | 872 | 2674 | 390 | 89.2 | globlastp |
| LYD550_H3 | thellungiella_parvulum\|11v1\|DN774121 | 873 | 2675 | 390 | 87.8 | globlastp |
| LYD550_H5 | arabidopsis_lyrata\|09v1\|JGIAL010121_P1 | 874 | 2676 | 390 | 87.6 | globlastp |
| LYD551_H9 | b_rapa\|11v1\|BQ791522_P1 | 875 | 391 | 391 | 100 | globlastp |
| LYD551_H1 | b_rapa\|gb162\|BQ791522 | 876 | 391 | 391 | 100 | globlastp |
| LYD551_H2 | canola\|11v1\|DY024382_P1 | 877 | 2677 | 391 | 98.4 | globlastp |
| LYD551_H3 | radish\|gb164\|EV524465 | 878 | 2678 | 391 | 94 | globlastp |
| LYD551_H4 | thellungiella_parvulum\|11v1\|EPCRP002902 | 879 | 2679 | 391 | 92.8 | globlastp |
| LYD551_H5 | thellungiella_halophilum\|11v1\|EHJGI11006208 | 880 | 2680 | 391 | 88.8 | globlastp |
| LYD551_H6 | arabidopsis_lyrata\|09v1\|JGIAL000319_P1 | 881 | 2681 | 391 | 86.4 | globlastp |
| LYD551_H7 | arabidopsis\|10v1\|AT1G03870_P1 | 882 | 2682 | 391 | 84.4 | globlastp |
| LYD551_H8 | thellungiella_parvulum\|11v1\|EPCRP008913 | 883 | 2683 | 391 | 80.08 | glotblastn |
| LYD552_H4 | b_rapa\|11v1\|EE440823_P1 | 884 | 2684 | 392 | 94.9 | globlastp |
| LYD552_H1 | radish\|gb164\|EV537053 | 885 | 2685 | 392 | 88.5 | globlastp |
| LYD552_H5 | b_rapa\|11v1\|CD839492_T1 | 886 | 2686 | 392 | 86.64 | glotblastn |
| LYD552_H2 | b_rapa\|gb162\|EX018471 | 887 | 2687 | 392 | 86.4 | globlastp |
| LYD552_H3 | thellungiella_parvulum\|11v1\|BY800613 | 888 | 2688 | 392 | 81.35 | glotblastn |
| LYD553_H5 | thellungiella_halophilum\|11v1\|EHJGI11004320 | 889 | 2689 | 393 | 94.2 | globlastp |
| LYD554_H3 | cotton\|11v1\|AI728201_P1 | 890 | 2690 | 394 | 99.2 | globlastp |
| LYD555_H5 | cotton\|10v2\|ES850546 | 891 | 2691 | 395 | 96.68 | glotblastn |
| LYD555_H2 | gossypium_raimondii\|12v1\|DT457613_P1 | 892 | 2692 | 395 | 92.8 | globlastp |
| LYD556_H2 | pigeonpea\|11v1\|SRR054580X111609_T1 | 893 | 2693 | 396 | 80.73 | glotblastn |
| LYD556_H1 | pigeonpea\|10v1\|SRR054580S0002555 | 894 | 2693 | 396 | 80.73 | glotblastn |
| LYD558_H1 | trigonella\|11v1\|SRR066194X122160 | 895 | 2694 | 397 | 91.08 | glotblastn |
| LYD558_H2 | chickpea\|11v1\|SRR133517.102289_P1 | 896 | 2695 | 397 | 85.1 | globlastp |
| LYD559_H22 | chickpea\|11v1\|DY475242_P1 | 897 | 2696 | 398 | 85.8 | globlastp |
| LYD559_H2 | chickpea\|09v2\|DY475242 | 898 | 2696 | 398 | 85.8 | globlastp |
| LYD559_H23 | pigeonpea\|11v1\|SRR054580X120956_P1 | 899 | 2697 | 398 | 84.1 | globlastp |
| LYD559_H4 | soybean\|11v1\|GLYMA12G16380 | 900 | 2698 | 398 | 83.7 | globlastp |
| LYD559_H5 | spurge\|gb161\|DV117048 | 901 | 2699 | 398 | 83 | globlastp |
| LYD559_H6 | lotus\|09v1\|AI967656_P1 | 902 | 2700 | 398 | 82.7 | globlastp |
| LYD559_H24 | cotton\|11v1\|AW186999_P1 | 903 | 2701 | 398 | 82 | globlastp |
| LYD559_H25 | gossypium_raimondii\|12v1\|AW186999_P1 | 904 | 2701 | 398 | 82 | globlastp |
| LYD559_H8 | cotton\|10v2\|CO071682 | 905 | 2701 | 398 | 82 | globlastp |
| LYD559_H9 | eucalyptus\|11v2\|CD668373_P1 | 906 | 2702 | 398 | 81.7 | globlastp |
| LYD559_H26 | cotton\|11v1\|CO069437_P1 | 907 | 2703 | 398 | 81.4 | globlastp |
| LYD559_H27 | cotton\|11v1\|DT543683_P1 | 908 | 2704 | 398 | 81.4 | globlastp |
| LYD559_H10 | euphorbia\|11v1\|DV117048_P1 | 909 | 2705 | 398 | 81.2 | globlastp |
| LYD559_H11 | peanut\|10v1\|CD038760_P1 | 910 | 2706 | 398 | 81.2 | globlastp |
| LYD559_H12 | valeriana\|11v1\|SRR099039X101600 | 911 | 2707 | 398 | 81.1 | globlastp |
| LYD559_H13 | pigeonpea\|10v1\|SRR054580S0006801 | 912 | 2708 | 398 | 80.9 | globlastp |
| LYD559_H14 | poplar\|10v1\|AI166111_P1 | 913 | 2709 | 398 | 80.8 | globlastp |
| LYD559_H15 | kiwi\|gb166\|FG427674_P1 | 914 | 2710 | 398 | 80.6 | globlastp |
| LYD559_H16 | chestnut\|gb170\|SRR006295S0023483_P1 | 915 | 2711 | 398 | 80.4 | globlastp |
| LYD559_H17 | primula\|11v1\|SRR098679X101226XX1_T1 | 916 | 2712 | 398 | 80.33 | glotblastn |
| LYD559_H18 | platanus\|11v1\|AM260510_P1 | 917 | 2713 | 398 | 80.2 | globlastp |

TABLE 54-continued

Homologous polynucleotides and polypeptides which can increase plant yield, seed yield, oil yield,
oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD559_H28 | b_juncea|12v1|E6ANDIZ01A1HSY_T1 | 918 | 2714 | 398 | 80.11 | glotblastn |
| LYD559_H20 | fraxinus|11v1|SRR058827.103366_P1 | 919 | 2715 | 398 | 80.1 | globlastp |
| LYD559_H21 | scabiosa|11v1|SRR063723X100713 | 920 | 2716 | 398 | 80.1 | globlastp |
| LYD560_H1 | trigonella|11v1|SRR066194X100341 | 921 | 2717 | 399 | 97.6 | globlastp |
| LYD560_H3 | pea|11v1|Y17796_P1 | 922 | 2718 | 399 | 92.6 | globlastp |
| LYD560_H158 | pigeonpea|11v1|SRR054580X104938_P1 | 923 | 2719 | 399 | 86.7 | globlastp |
| LYD560_H15 | strawberry|11v1|CO378466 | 924 | 2720 | 399 | 85.4 | globlastp |
| LYD560_H29 | phyla|11v2|SRR099035X102776_P1 | 925 | 2721 | 399 | 84.1 | globlastp |
| LYD560_H34 | euonymus|11v1|SRR070038X101097_T1 | 926 | 2722 | 399 | 83.87 | glotblastn |
| LYD560_H38 | euonymus|11v1|SRR070038X127843_P1 | 927 | 2723 | 399 | 83.7 | globlastp |
| LYD560_H43 | tripterygium|11v1|SRR098677X102820 | 928 | 2724 | 399 | 83.6 | globlastp |
| LYD560_H48 | orobanche|10v1|SRR023189S0012604_P1 | 929 | 2725 | 399 | 83.4 | globlastp |
| LYD560_H58 | clementine|11v1|BQ623022_P1 | 930 | 2726 | 399 | 83.2 | globlastp |
| LYD560_H71 | citrus|gb166|BQ623022 | 931 | 2727 | 399 | 83 | globlastp |
| LYD560_H94 | rice|11v1|AA750598_P1 | 932 | 2728 | 399 | 82.5 | globlastp |
| LYD560_H94 | rice|gb170|OS05G49800 | 933 | 2728 | 399 | 82.5 | globlastp |
| LYD560_H99 | clementine|11v1|CB293579_P1 | 934 | 2729 | 399 | 82.4 | globlastp |
| LYD560_H100 | orange|11v1|BQ623022_P1 | 935 | 2729 | 399 | 82.4 | globlastp |
| LYD560_H159 | blueberry|12v1|SRR353282X18635D1_T1 | 936 | 2730 | 399 | 82.31 | glotblastn |
| LYD560_H106 | antirrhinum|gb166|AJ558721_T1 | 937 | 2731 | 399 | 82.03 | glotblastn |
| LYD560_H107 | cassava|09v1|CK646362_P1 | 938 | 2732 | 399 | 82 | globlastp |
| LYD560_H123 | tripterygium|11v1|SRR098677X101139 | 939 | 2733 | 399 | 81.5 | globlastp |
| LYD560_H131 | cotton|10v2|BE053665 | 940 | 2734 | 399 | 80.8 | globlastp |
| LYD560_H160 | poppy|11v1|SRR030259.11437_T1 | 941 | 2735 | 399 | 80.72 | glotblastn |
| LYD560_H161 | gossypium_raimondii|12v1|BE053665_P1 | 942 | 2736 | 399 | 80.6 | globlastp |
| LYD560_H162 | cotton|11v1|BE053665_P1 | 943 | 2737 | 399 | 80.3 | globlastp |
| LYD560_H149 | tobacco|gb162|DW004467 | 944 | 2738 | 399 | 80.23 | glotblastn |
| LYD560_H163 | blueberry|12v1|SRR353282X40527D1_P1 | 945 | 2739 | 399 | 80 | globlastp |
| LYD561_H1 | trigonella|11v1|SRR066194X416969 | 946 | 2740 | 400 | 91.6 | globlastp |
| LYD561_H2 | clover|gb162|BB903437_P1 | 947 | 2741 | 400 | 83.6 | globlastp |
| LYD562_H1 | soybean|11v1|GLYMA16G01070 | 948 | 2742 | 401 | 83.4 | globlastp |
| LYD562_H2 | soybean|11v1|GLYMA07G04480 | 949 | 2743 | 401 | 83.1 | globlastp |
| LYD562_H4 | bean|12v1|FG228272_P1 | 950 | 2744 | 401 | 83 | globlastp |
| LYD562_H5 | pigeonpea|11v1|GR464005_P1 | 951 | 2745 | 401 | 83 | globlastp |
| LYD562_H3 | pigeonpea|10v1|GR464005 | 952 | 2746 | 401 | 82.5 | globlastp |
| LYD563_H1 | trigonella|11v1|SRR066194X190527 | 953 | 2747 | 402 | 92.3 | globlastp |
| LYD563_H4 | chickpea|11v1|GR392227_P1 | 954 | 2748 | 402 | 87 | globlastp |
| LYD563_H2 | pea|11v1|FG534485_P1 | 955 | 2749 | 402 | 86.7 | globlastp |
| LYD563_H3 | lotus|09v1|AV413185_P1 | 956 | 2750 | 402 | 80 | globlastp |
| LYD564_H1 | trigonella|11v1|SRR066194X144531 | 957 | 2751 | 403 | 99.5 | globlastp |
| LYD564_H130 | chickpea|11v1|GR396842_P1 | 958 | 2752 | 403 | 95.2 | globlastp |
| LYD564_H2 | pea|11v1|FG530295XX1_P1 | 959 | 2753 | 403 | 94.1 | globlastp |
| LYD564_H3 | chickpea|09v2|GR396842 | 960 | 2754 | 403 | 93.4 | globlastp |
| LYD564_H4 | cowpea|12v1|FF538026_P1 | 961 | 2755 | 403 | 92.5 | globlastp |
| LYD564_H5 | soybean|11v1|GLYMA04G25800 | 962 | 2756 | 403 | 92.5 | globlastp |
| LYD564_H6 | soybean|11v1|GLYMA11G16210 | 963 | 2757 | 403 | 90.5 | globlastp |
| LYD564_H131 | bean|12v1|CA896686_P1 | 964 | 2758 | 403 | 89.5 | globlastp |
| LYD564_H7 | bean|gb167|BQ481858 | 965 | 2759 | 403 | 89.5 | globlastp |
| LYD564_H8 | cowpea|12v1|FF556286_P1 | 966 | 2760 | 403 | 89.5 | globlastp |
| LYD564_H8 | cowpea|gb166|FF556286 | 967 | 2760 | 403 | 89.5 | globlastp |
| LYD564_H9 | cirsium|11v1|SRR346952.16734_T1 | 968 | 2761 | 403 | 89.07 | glotblastn |
| LYD564_H132 | sunflower|12v1|DY907147_P1 | 969 | 2762 | 403 | 88.6 | globlastp |
| LYD564_H10 | fagopyrum|11v1|SRR063703X104472_T1 | 970 | 2763 | 403 | 88.52 | glotblastn |
| LYD564_H11 | orobanche|10v1|SRR023189S0000792_T1 | 971 | 2764 | 403 | 88.52 | glotblastn |
| LYD564_H12 | ambrosia|11v1|SRR346935.602112_P1 | 972 | 2765 | 403 | 88.5 | globlastp |
| LYD564_H13 | dandelion|10v1|DY824048_P1 | 973 | 2766 | 403 | 88.5 | globlastp |
| LYD564_H14 | senecio|gb170|DY663921 | 974 | 2767 | 403 | 88.5 | globlastp |
| LYD564_H15 | tragopogon|10v1|SRR020205S0016332 | 975 | 2768 | 403 | 88.5 | globlastp |
| LYD564_H133 | pigeonpea|11v1|GW352750_P1 | 976 | 2769 | 403 | 88.1 | globlastp |
| LYD564_H16 | fagopyrum|11v1|SRR063689X100418_T1 | 977 | 2770 | 403 | 88.04 | glotblastn |
| LYD564_H17 | flaveria|11v1|SRR149229.110435_P1 | 978 | 2771 | 403 | 88 | globlastp |
| LYD564_H18 | safflower|gb162|EL407197 | 979 | 2772 | 403 | 88 | globlastp |
| LYD564_H19 | phyla|11v2|SRR099036X248170_T1 | 980 | 2773 | 403 | 87.98 | glotblastn |
| LYD564_H20 | centaurea|gb166|EH717776_P1 | 981 | 2774 | 403 | 87.6 | globlastp |
| LYD564_H21 | sunflower|10v1|DY907147 | 982 | 2775 | 403 | 87.6 | globlastp |
| LYD564_H134 | bean|12v1|CA900936_P1 | 983 | 2776 | 403 | 87.4 | globlastp |
| LYD564_H22 | bean|gb167|CA900936 | 984 | 2776 | 403 | 87.4 | globlastp |
| LYD564_H135 | sunflower|12v1|DY923354_P1 | 985 | 2777 | 403 | 87.2 | globlastp |
| LYD564_H136 | sunflower|12v1|DY944220_P1 | 986 | 2777 | 403 | 87.2 | globlastp |
| LYD564_H23 | cynara|gb167|GE588051_P1 | 987 | 2778 | 403 | 87.2 | globlastp |
| LYD564_H24 | flaveria|11v1|SRR149229.111588_P1 | 988 | 2779 | 403 | 87.2 | globlastp |
| LYD564_H25 | grape|11v1|GSVIVT01032214001_P1 | 989 | 2780 | 403 | 87.2 | globlastp |
| LYD564_H26 | lotus|09v1|LLBG662335_P1 | 990 | 2781 | 403 | 87.2 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD564_H27 | sunflower\|10v1\|DY923354 | 991 | 2777 | 403 | 87.2 | globlastp |
| LYD564_H28 | cleome_gynandra\|10v1\|SRR015532S0011580_P1 | 992 | 2782 | 403 | 87.1 | globlastp |
| LYD564_H29 | ambrosia\|11v1\|SRR346943.287416_T1 | 993 | 2783 | 403 | 87.03 | glotblastn |
| LYD564_H137 | sesame\|12v1\|JK047154_P1 | 994 | 2784 | 403 | 86.9 | globlastp |
| LYD564_H30 | artemisia\|10v1\|EY062833_P1 | 995 | 2785 | 403 | 86.9 | globlastp |
| LYD564_H31 | petunia\|gb171\|FN000395_P1 | 996 | 2786 | 403 | 86.9 | globlastp |
| LYD564_H32 | flaveria\|11v1\|SRR149232.13647_P1 | 997 | 2787 | 403 | 86.7 | globlastp |
| LYD564_H33 | triphysaria\|10v1\|EY002738 | 998 | 2788 | 403 | 86.2 | globlastp |
| LYD564_H34 | sarracenia\|11v1\|SRR192669.103612 | 999 | 2789 | 403 | 86.1 | glotblastn |
| LYD564_H35 | pepper\|12v1\|CA520536_P1 | 1000 | 2790 | 403 | 85.9 | globlastp |
| LYD564_H35 | pepper\|gb171\|CA520536 | 1001 | 2790 | 403 | 85.9 | globlastp |
| LYD564_H36 | salvia\|10v1\|CV170107 | 1002 | 2791 | 403 | 85.9 | globlastp |
| LYD564_H37 | tobacco\|gb162\|DV157807 | 1003 | 2792 | 403 | 85.9 | globlastp |
| LYD564_H38 | coffea\|10v1\|DV664647_P1 | 1004 | 2793 | 403 | 85.6 | globlastp |
| LYD564_H39 | catharanthus\|11v1\|FD660937_P1 | 1005 | 2794 | 403 | 85.4 | globlastp |
| LYD564_H40 | citrus\|gb166\|BQ623391 | 1006 | 2795 | 403 | 85.35 | glotblastn |
| LYD564_H41 | clementine\|11v1\|BQ623391_T1 | 1007 | 2796 | 403 | 85.35 | glotblastn |
| LYD564_H42 | orange\|11v1\|BQ623391_T1 | 1008 | 2795 | 403 | 85.35 | glotblastn |
| LYD564_H43 | tomato\|11v1\|BG643022 | 1009 | 2797 | 403 | 85.3 | globlastp |
| LYD564_H44 | ipomoea_nil\|10v1\|BJ561525_P1 | 1010 | 2798 | 403 | 85.2 | globlastp |
| LYD564_H45 | oak\|10v1\|DB997519_P1 | 1011 | 2799 | 403 | 85.1 | globlastp |
| LYD564_H46 | oak\|10v1\|SRR039735S0009498_P1 | 1012 | 2799 | 403 | 85.1 | globlastp |
| LYD564_H47 | tabernaemontana\|11v1\|SRR098689X106773 | 1013 | 2800 | 403 | 85.1 | globlastp |
| LYD564_H48 | lettuce\|10v1\|DW075465 | 1014 | 2801 | 403 | 84.9 | globlastp |
| LYD564_H138 | nasturtium\|11v1\|SRR032558.116424_T1 | 1015 | 2802 | 403 | 84.82 | glotblastn |
| LYD564_H49 | artemisia\|10v1\|SRR019254S0026008_P1 | 1016 | 2803 | 403 | 84.8 | globlastp |
| LYD564_H50 | cichorium\|gb171\|EH703642_P1 | 1017 | 2804 | 403 | 84.8 | globlastp |
| LYD564_H51 | eggplant\|10v1\|FS001669_P1 | 1018 | 2805 | 403 | 84.8 | globlastp |
| LYD564_H52 | utricularia\|11v1\|SRR094438.107075 | 1019 | 2806 | 403 | 84.8 | globlastp |
| LYD564_H139 | blueberry\|12v1\|SRR353282X27016D1_P1 | 1020 | 2807 | 403 | 84.7 | globlastp |
| LYD564_H53 | dandelion\|10v1\|DY802954_P1 | 1021 | 2808 | 403 | 84.7 | globlastp |
| LYD564_H54 | lettuce\|10v1\|DW076259 | 1022 | 2809 | 403 | 84.7 | globlastp |
| LYD564_H55 | castorbean\|11v1\|XM_002517708_T1 | 1023 | 2810 | 403 | 84.62 | glotblastn |
| LYD564_H140 | plantago\|11v2\|SRR066373X110282_P1 | 1024 | 2811 | 403 | 84.6 | globlastp |
| LYD564_H56 | canola\|11v1\|EE511611_P1 | 1025 | 2812 | 403 | 84.6 | globlastp |
| LYD564_H57 | plantago\|11v1\|SRR066373X110282 | 1026 | 2811 | 403 | 84.6 | globlastp |
| LYD564_H141 | gossypium_raimondii\|12v1\|AI727289_T1 | 1027 | 2813 | 403 | 84.54 | glotblastn |
| LYD564_H58 | cotton\|10v2\|BQ412972 | 1028 | 2813 | 403 | 84.54 | glotblastn |
| LYD564_H59 | thellungiella_halophilum\|11v1\|EHJGI11025782 | 1029 | 2814 | 403 | 84.46 | glotblastn |
| LYD564_H60 | potato\|10v1\|BG592695_P1 | 1030 | 2815 | 403 | 84.3 | globlastp |
| LYD564_H61 | solanum_phureja\|09v1\|SPHBG643022 | 1031 | 2815 | 403 | 84.3 | globlastp |
| LYD564_H62 | chestnut\|gb170\|SRR006295S0014027_P1 | 1032 | 2816 | 403 | 84.2 | globlastp |
| LYD564_H63 | oak\|10v1\|FN723381_P1 | 1033 | 2816 | 403 | 84.2 | globlastp |
| LYD564_H64 | vinca\|11v1\|SRR098690X111539 | 1034 | 2817 | 403 | 84.2 | globlastp |
| LYD564_H65 | valeriana\|11v1\|SRR099039X212264 | 1035 | 2818 | 403 | 84.15 | glotblastn |
| LYD564_H142 | cotton\|11v1\|AI727289_T1 | 1036 | 2819 | 403 | 84.02 | glotblastn |
| LYD564_H66 | lettuce\|10v1\|DW123070 | 1037 | 2820 | 403 | 84 | globlastp |
| LYD564_H67 | strawberry\|11v1\|EX659306 | 1038 | 2821 | 403 | 84 | globlastp |
| LYD564_H48, LYD564_H66 | lettuce\|12v1\|DW075465_P1 | 1039 | 2820 | 403 | 84 | globlastp |
| LYD564_H68 | eucalyptus\|11v2\|CU394869_T1 | 1040 | 2822 | 403 | 83.92 | glotblastn |
| LYD564_H143 | lettuce\|12v1\|DW076259_P1 | 1041 | 2823 | 403 | 83.6 | globlastp |
| LYD564_H69 | bruguiera\|gb166\|BP939279_P1 | 1042 | 2824 | 403 | 83.6 | globlastp |
| LYD564_H70 | peanut\|10v1\|EE124748_P1 | 1043 | 2825 | 403 | 83.6 | globlastp |
| LYD564_H71 | platanus\|11v1\|SRR096786X116310_P1 | 1044 | 2826 | 403 | 83.6 | globlastp |
| LYD564_H72 | radish\|gb164\|EW715474 | 1045 | 2827 | 403 | 83.6 | globlastp |
| LYD564_H73 | tripterygium\|11v1\|SRR098677X11813 | 1046 | 2828 | 403 | 83.6 | globlastp |
| LYD564_H74 | thellungiella_parvulum\|11v1\|EPCRP023807 | 1047 | 2829 | 403 | 83.5 | globlastp |
| LYD564_H75 | humulus\|11v1\|SRR098683X103967XX1_T1 | 1048 | 2830 | 403 | 83.42 | glotblastn |
| LYD564_H76 | b_oleracea\|gb161\|ES943633_P1 | 1049 | 2831 | 403 | 83.4 | globlastp |
| LYD564_H77 | thellungiella_halophilum\|11v1\|EHJGI11024070 | 1050 | 2832 | 403 | 83.4 | globlastp |
| LYD564_H78 | kiwi\|gb166\|FG439670_P1 | 1051 | 2833 | 403 | 83.2 | globlastp |
| LYD564_H79 | olea\|11v1\|SRR014463.26573_P1 | 1052 | 2834 | 403 | 83.2 | globlastp |
| LYD564_H80 | arabidopsis\|10v1\|AT5G13780_P1 | 1053 | 2835 | 403 | 83 | globlastp |
| LYD564_H81 | papaya\|gb165\|EX281447_P1 | 1054 | 2836 | 403 | 83 | globlastp |
| LYD564_H82 | arabidopsis_lyrata\|09v1\|JGIAL021061_P1 | 1055 | 2837 | 403 | 82.9 | globlastp |
| LYD564_H144 | banana\|12v1\|FL657740_T1 | 1056 | 2838 | 403 | 82.89 | glotblastn |
| LYD564_H83 | antirrhinum\|gb166\|AJ791317_P1 | 1057 | 2839 | 403 | 82.8 | globlastp |
| LYD564_H145 | oil_palm\|11v1\|EY408003_T1 | 1058 | 2840 | 403 | 82.7 | glotblastn |
| LYD564_H84 | ginger\|gb164\|DY360679_T1 | 1059 | 2841 | 403 | 82.7 | glotblastn |
| LYD564_H85 | cassava\|09v1\|DR083932_P1 | 1060 | 2842 | 403 | 82.6 | globlastp |
| LYD564_H146 | spruce\|11v1\|ES254811_T1 | 1061 | 2843 | 403 | 82.51 | glotblastn |
| LYD564_H147 | b_rapa\|11v1\|CD823802_P1 | 1062 | 2844 | 403 | 82.5 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD564_H86 | b_rapa\|gb162\|CV546927 | 1063 | 2844 | 403 | 82.5 | globlastp |
| LYD564_H87 | tea\|10v1\|GE650599 | 1064 | 2845 | 403 | 82.4 | globlastp |
| LYD564_H88 | canola\|11v1\|DY024886_P1 | 1065 | 2846 | 403 | 82.3 | globlastp |
| LYD564_H89 | ipomoea_batatas\|10v1\|BU690124_P1 | 1066 | 2847 | 403 | 82.3 | globlastp |
| LYD564_H90 | monkeyflower\|10v1\|GO989362_P1 | 1067 | 2848 | 403 | 82.3 | globlastp |
| LYD564_H91 | aristolochia\|10v1\|FD763380_P1 | 1068 | 2849 | 403 | 82.2 | globlastp |
| LYD564_H92 | euphorbia\|11v1\|SRR098678X101714_P1 | 1069 | 2850 | 403 | 82.1 | globlastp |
| LYD564_H148 | spruce\|11v1\|ES251408_T1 | 1070 | 2851 | 403 | 81.97 | glotblastn |
| LYD564_H149 | spruce\|11v1\|EX364957_T1 | 1071 | 2851 | 403 | 81.97 | glotblastn |
| LYD564_H93 | spruce\|gb162\|CO483132 | 1072 | 2851 | 403 | 81.97 | glotblastn |
| LYD564_H94 | amorphophallus\|11v2\|SRR089351X207625_T1 | 1073 | 2852 | 403 | 81.91 | glotblastn |
| LYD564_H95 | b_juncea\|10v2\|E6ANDIZ01A14OT | 1074 | 2853 | 403 | 81.9 | globlastp |
| LYD564_H96 | canola\|11v1\|DY024420_P1 | 1075 | 2854 | 403 | 81.9 | globlastp |
| LYD564_H97 | curcuma\|10v1\|DY391831_T1 | 1076 | 2855 | 403 | 81.82 | glotblastn |
| LYD564_H98 | poplar\|10v1\|AI162059_P1 | 1077 | 2856 | 403 | 81.7 | globlastp |
| LYD564_H99 | cassava\|09v1\|DV445645_P1 | 1078 | 2857 | 403 | 81.6 | globlastp |
| LYD564_H150 | banana\|12v1\|FL662727_T1 | 1079 | 2858 | 403 | 81.54 | glotblastn |
| LYD564_H151 | oil_palm\|11v1\|ES370541_T1 | 1080 | 2859 | 403 | 81.52 | glotblastn |
| LYD564_H100 | euphorbia\|11v1\|AW821927_P1 | 1081 | 2860 | 403 | 81.5 | globlastp |
| LYD564_H101 | abies\|11v2\|SRR098676X107677_T1 | 1082 | 2861 | 403 | 81.42 | glotblastn |
| LYD564_H102 | distylium\|11v1\|SRR065077X14314_T1 | 1083 | 2862 | 403 | 81.42 | glotblastn |
| LYD564_H103 | podocarpus\|10v1\|SRR065014S0008986_T1 | 1084 | 2863 | 403 | 81.42 | glotblastn |
| LYD564_H104 | pseudotsuga\|11v1\|SRR065119S0002063 | 1085 | 2864 | 403 | 81.42 | glotblastn |
| LYD564_H105 | sciadopitys\|10v1\|SRR065035S0030946 | 1086 | 2865 | 403 | 81.42 | glotblastn |
| LYD564_H106 | euonymus\|11v1\|SRR070038X112482_P1 | 1087 | 2866 | 403 | 81.3 | globlastp |
| LYD564_H107 | poplar\|10v1\|BU833771_P1 | 1088 | 2867 | 403 | 81.3 | globlastp |
| LYD564_H108 | tripterygium\|11v1\|SRR098677X133407 | 1089 | 2868 | 403 | 81.25 | glotblastn |
| LYD564_H109 | cannabis\|12v1\|EW701715_P1 | 1090 | 2869 | 403 | 81.2 | globlastp |
| LYD564_H110 | phalaenopsis\|11v1\|CB032868_T1 | 1091 | 2870 | 403 | 81.18 | glotblastn |
| LYD564_H111 | cleome_spinosa\|10v1\|GR931668_P1 | 1092 | 2871 | 403 | 81 | globlastp |
| LYD564_H112 | chelidonium\|11v1\|SRR084752X104265_T1 | 1093 | 2872 | 403 | 80.83 | glotblastn |
| LYD564_H113 | canola\|11v1\|EE480839_P1 | 1094 | 2873 | 403 | 80.8 | globlastp |
| LYD564_H114 | prunus\|10v1\|CN489292 | 1095 | 2874 | 403 | 80.77 | glotblastn |
| LYD564_H115 | spurge\|gb161\|AW821927 | 1096 | 2875 | 403 | 80.7 | globlastp |
| LYD564_H152 | b_rapa\|11v1\|CD823960_P1 | 1097 | 2876 | 403 | 80.6 | globlastp |
| LYD564_H116 | b_rapa\|gb162\|CV546937 | 1098 | 2876 | 403 | 80.6 | globlastp |
| LYD564_H117 | cacao\|10v1\|CA798010_P1 | 1099 | 2877 | 403 | 80.6 | globlastp |
| LYD564_H118 | flax\|11v1\|JG027336_P1 | 1100 | 2878 | 403 | 80.6 | globlastp |
| LYD564_H119 | flax\|11v1\|JG032028_P1 | 1101 | 2879 | 403 | 80.6 | globlastp |
| LYD564_H153 | poppy\|11v1\|SRR030259.103044_P1 | 1102 | 2880 | 403 | 80.5 | globlastp |
| LYD564_H154 | poppy\|11v1\|SRR030259.106398XX1_P1 | 1103 | 2880 | 403 | 80.5 | globlastp |
| LYD564_H120 | euonymus\|11v1\|SRR070038X116092_P1 | 1104 | 2881 | 403 | 80.5 | globlastp |
| LYD564_H121 | silene\|11v1\|GH292679 | 1105 | 2882 | 403 | 80.5 | globlastp |
| LYD564_H122 | silene\|11v1\|SRR096785X122338 | 1106 | 2882 | 403 | 80.5 | globlastp |
| LYD564_H123 | aquilegia\|10v2\|JGIAC016088_T1 | 1107 | 2883 | 403 | 80.41 | glotblastn |
| LYD564_H155 | spruce\|11v1\|SRR065814X412166_T1 | 1108 | 2884 | 403 | 80.33 | glotblastn |
| LYD564_H124 | cephalotaxus\|11v1\|SRR064395X117984_T1 | 1109 | 2885 | 403 | 80.33 | glotblastn |
| LYD564_H125 | distylium\|11v1\|SRR065077X112028_T1 | 1110 | 2886 | 403 | 80.33 | glotblastn |
| LYD564_H126 | maritime_pine\|10v1\|BX254986_T1 | 1111 | 2887 | 403 | 80.33 | glotblastn |
| LYD564_H156 | rose\|12v1\|SRR397984.111801_P1 | 1112 | 2888 | 403 | 80.3 | globlastp |
| LYD564_H127 | canola\|11v1\|SRR019556.1870_P1 | 1113 | 2889 | 403 | 80.2 | globlastp |
| LYD564_H157 | poppy\|11v1\|SRR096789.168678_P1 | 1114 | 2890 | 403 | 80.1 | globlastp |
| LYD564_H128 | beet\|gb162\|BI543861 | 1115 | 2891 | 403 | 80 | globlastp |
| LYD564_H129 | cynodon\|10v1\|ES293564_T1 | 1116 | 2892 | 403 | 80 | glotblastn |
| LYD565_H5 | chickpea\|11v1\|SRR133517.116272_T1 | 1117 | 2893 | 404 | 86.65 | glotblastn |
| LYD565_H6 | pigeonpea\|11v1\|SRR054580X109139_P1 | 1118 | 2894 | 404 | 85.1 | globlastp |
| LYD565_H1 | pigeonpea\|10v1\|SRR054580S0046177 | 1119 | 2894 | 404 | 85.1 | globlastp |
| LYD565_H7 | bean\|12v1\|CA913713_P1 | 1120 | 2895 | 404 | 83.5 | globlastp |
| LYD565_H2 | soybean\|11v1\|GLYMA04G01720 | 1121 | 2896 | 404 | 82.41 | glotblastn |
| LYD565_H3 | soybean\|11v1\|GLYMA06G01810 | 1122 | 2897 | 404 | 80.58 | glotblastn |
| LYD565_H4 | peanut\|10v1\|EG030338_P1 | 1123 | 2898 | 404 | 80.2 | globlastp |
| LYD566_H2 | medicago\|12v1\|AW127599_P1 | 1124 | 2899 | 405 | 97.5 | globlastp |
| LYD566_H1 | medicago\|09v1\|AW127599 | 1125 | 2899 | 405 | 97.5 | globlastp |
| LYD567_H1 | medicago\|09v1\|LLCO511773 | 1126 | 2900 | 406 | 93.3 | globlastp |
| LYD567_H2 | pea\|11v1\|AJ308129_P1 | 1127 | 2901 | 406 | 92 | globlastp |
| LYD567_H3 | pea\|11v1\|CD860470_P1 | 1128 | 2902 | 406 | 92 | globlastp |
| LYD567_H10 | chickpea\|11v1\|FE669744_P1 | 1129 | 2903 | 406 | 90.8 | globlastp |
| LYD567_H4 | chickpea\|09v2\|FE669744 | 1130 | 2903 | 406 | 90.8 | globlastp |
| LYD567_H5 | pea\|11v1\|AJ308126_P1 | 1131 | 2904 | 406 | 89.3 | globlastp |
| LYD567_H6 | clover\|gb162\|BB915852_P1 | 1132 | 2905 | 406 | 88 | globlastp |
| LYD567_H7 | trigonella\|11v1\|SRR066194X123223 | 1133 | 2906 | 406 | 86.7 | globlastp |
| LYD567_H11 | chickpea\|11v1\|X95708_T1 | 1134 | 2907 | 406 | 85.53 | glotblastn |
| LYD567_H12 | chickpea\|11v1\|SRR133522.101553_P1 | 1135 | 2908 | 406 | 85.5 | globlastp |

TABLE 54-continued

Homologous polynucleotides and polypeptides which can increase plant yield, seed yield, oil yield,
oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD567_H8 | chickpea|09v2|CD051353 | 1136 | 2908 | 406 | 85.5 | globlastp |
| LYD567_H9 | trigonella|11v1|SRR066194X28674 | 1137 | 2909 | 406 | 85.3 | globlastp |
| LYD568_H16 | chickpea|11v1|AJ630657_P1 | 1138 | 2910 | 407 | 91.6 | globlastp |
| LYD568_H1 | chickpea|09v2|AJ630657 | 1139 | 2910 | 407 | 91.6 | globlastp |
| LYD568_H17 | pigeonpea|11v1|SRR054580X103634_P1 | 1140 | 2911 | 407 | 90.4 | globlastp |
| LYD568_H2 | pigeonpea|10v1|SRR054580S0000977 | 1141 | 2911 | 407 | 90.4 | globlastp |
| LYD568_H3 | liquorice|gb171|FS248176_P1 | 1142 | 2912 | 407 | 89.9 | globlastp |
| LYD568_H4 | lotus|09v1|AW163923_P1 | 1143 | 2913 | 407 | 89.9 | globlastp |
| LYD568_H18 | peanut|10v1|GO266966_T1 | 1144 | 2914 | 407 | 86.52 | glotblastn |
| LYD568_H5 | soybean|11v1|GLYMA04G01390 | 1145 | 2915 | 407 | 86.5 | globlastp |
| LYD568_H6 | cowpea|12v1|FF389144_P1 | 1146 | 2916 | 407 | 82 | globlastp |
| LYD568_H6 | cowpea|gb166|FF389144 | 1147 | 2916 | 407 | 82 | globlastp |
| LYD568_H7 | flax|11v1|GW866793_P1 | 1148 | 2917 | 407 | 81.8 | globlastp |
| LYD568_H8 | cacao|10v1|CU490694_P1 | 1149 | 2918 | 407 | 81.5 | globlastp |
| LYD568_H9 | flax|11v1|EU830291_T1 | 1150 | 2919 | 407 | 81.46 | glotblastn |
| LYD568_H19 | cotton|11v1|AI055160_P1 | 1151 | 2920 | 407 | 80.9 | globlastp |
| LYD568_H20 | cotton|11v1|DT461579_P1 | 1152 | 2921 | 407 | 80.9 | globlastp |
| LYD568_H21 | gossypium_raimondii|12v1|AI055160_P1 | 1153 | 2921 | 407 | 80.9 | globlastp |
| LYD568_H22 | nasturtium|11v1|SRR032558.13527_P1 | 1154 | 2922 | 407 | 80.9 | globlastp |
| LYD568_H10 | bean|gb167|CV538261 | 1155 | 2923 | 407 | 80.9 | glotblastn |
| LYD568_H11 | castorbean|11v1|EE259809_T1 | 1156 | 2924 | 407 | 80.9 | glotblastn |
| LYD568_H12 | cotton|10v2|AI055160 | 1157 | 2921 | 407 | 80.9 | globlastp |
| LYD568_H13 | cassava|09v1|CK645402_P1 | 1158 | 2925 | 407 | 80.7 | globlastp |
| LYD568_H23 | bean|12v1|SRR001334.136593_T1 | 1159 | 2926 | 407 | 80.34 | glotblastn |
| LYD568_H14 | poplar|10v1|BU813245_P1 | 1160 | 2927 | 407 | 80.3 | globlastp |
| LYD568_H15 | tomato|11v1|BG129131 | 1161 | 2928 | 407 | 80.3 | globlastp |
| LYD570_H1 | trigonella|11v1|SRR066194X239168 | 1162 | 2929 | 408 | 92.9 | globlastp |
| LYD570_H2 | chickpea|09v2|EH058717 | 1163 | 2930 | 408 | 83 | globlastp |
| LYD572_H1 | medicago|12v1|EV255012_P1 | 1164 | 2931 | 410 | 98.2 | globlastp |
| LYD573_H1 | trigonella|11v1|SRR066194X104366 | 1165 | 2932 | 411 | 94 | globlastp |
| LYD573_H2 | chickpea|11v1|SRR133517.141259_T1 | 1166 | 2933 | 411 | 88.61 | glotblastn |
| LYD574_H20 | chickpea|11v1|SRR133517.128864_P1 | 1167 | 2934 | 412 | 94.9 | globlastp |
| LYD574_H21 | pigeonpea|11v1|SRR054580X111703_P1 | 1168 | 2935 | 412 | 91.5 | globlastp |
| LYD574_H1 | soybean|11v1|GLYMA02G02340 | 1169 | 2936 | 412 | 90.8 | globlastp |
| LYD574_H2 | lotus|09v1|LLBG662424_P1 | 1170 | 2937 | 412 | 90 | globlastp |
| LYD574_H22 | bean|12v1|CA908921_P1 | 1171 | 2938 | 412 | 89.5 | globlastp |
| LYD574_H3 | peanut|10v1|EG029423_P1 | 1172 | 2939 | 412 | 87.6 | globlastp |
| LYD574_H4 | poplar|10v1|BU869776_P1 | 1173 | 2940 | 412 | 82.3 | globlastp |
| LYD574_H5 | peanut|10v1|EC366411_P1 | 1174 | 2941 | 412 | 82.2 | globlastp |
| LYD574_H6 | soybean|11v1|GLYMA01G05160 | 1175 | 2942 | 412 | 82.02 | glotblastn |
| LYD574_H7 | chestnut|gb170|SRR006295S0025482_P1 | 1176 | 2943 | 412 | 81.9 | globlastp |
| LYD574_H23 | bean|12v1|SRR001334.279981_T1 | 1177 | 2944 | 412 | 81.88 | glotblastn |
| LYD574_H8 | bean|gb167|CV542123 | 1178 | 2944 | 412 | 81.88 | glotblastn |
| LYD574_H9 | soybean|11v1|GLYMA08G40920 | 1179 | 2945 | 412 | 81.6 | globlastp |
| LYD574_H24 | beech|11v1|SRR006293.10412_P1 | 1180 | 2946 | 412 | 81.5 | globlastp |
| LYD574_H10 | prunus|10v1|BU039536 | 1181 | 2947 | 412 | 81.2 | globlastp |
| LYD574_H11 | poplar|10v1|BU820298_P1 | 1182 | 2948 | 412 | 81.1 | globlastp |
| LYD574_H25 | pigeonpea|11v1|SRR054580X100050_T1 | 1183 | 2949 | 412 | 80.96 | glotblastn |
| LYD574_H12 | pigeonpea|10v1|SRR054580S0004056 | 1184 | 2949 | 412 | 80.96 | glotblastn |
| LYD574_H13 | soybean|11v1|GLYMA18G16060 | 1185 | 2950 | 412 | 80.9 | globlastp |
| LYD574_H14 | oak|10v1|FP041194_T1 | 1186 | 2951 | 412 | 80.52 | glotblastn |
| LYD574_H15 | apple|11v1|CN864765_P1 | 1187 | 2952 | 412 | 80.5 | globlastp |
| LYD574_H16 | cacao|10v1|CA794423_P1 | 1188 | 2953 | 412 | 80.5 | globlastp |
| LYD574_H17 | castorbean|11v1|GE632527_P1 | 1189 | 2954 | 412 | 80.5 | globlastp |
| LYD574_H26 | gossypium_raimondii|12v1|AI728125_T1 | 1190 | 2955 | 412 | 80.34 | glotblastn |
| LYD574_H27 | cotton|11v1|AI728125_P1 | 1191 | 2956 | 412 | 80.3 | globlastp |
| LYD574_H18 | grape|11v1|GSVIVT01020041001_P1 | 1192 | 2957 | 412 | 80.3 | globlastp |
| LYD574_H19 | strawberry|11v1|CO817255 | 1193 | 2958 | 412 | 80.1 | globlastp |
| LYD578_H146 | chickpea|11v1|FL512454_P1 | 1194 | 2959 | 416 | 95.4 | globlastp |
| LYD578_H2 | soybean|11v1|GLYMA16G34500 | 1195 | 2960 | 416 | 92 | globlastp |
| LYD578_H147 | pigeonpea|11v1|SRR054580X10565_P1 | 1196 | 2961 | 416 | 91.9 | globlastp |
| LYD578_H3 | prunus|10v1|BU047195 | 1197 | 2962 | 416 | 91.2 | globlastp |
| LYD578_H148 | bean|12v1|CA910341_P1 | 1198 | 2963 | 416 | 90.4 | globlastp |
| LYD578_H4 | flax|11v1|CA482751_P1 | 1199 | 2964 | 416 | 90.2 | globlastp |
| LYD578_H5 | eucalyptus|11v2|CT982512_P1 | 1200 | 2965 | 416 | 90 | globlastp |
| LYD578_H6 | apple|11v1|CN489546_P1 | 1201 | 2966 | 416 | 89.8 | globlastp |
| LYD578_H7 | melon|10v1|AM726472_P1 | 1202 | 2967 | 416 | 89.8 | globlastp |
| LYD578_H8 | watermelon|11v1|AM726472 | 1203 | 2968 | 416 | 89.7 | globlastp |
| LYD578_H9 | cucumber|09v1|DN910557_P1 | 1204 | 2969 | 416 | 89.5 | globlastp |
| LYD578_H10 | apple|11v1|CN996236_P1 | 1205 | 2970 | 416 | 89.4 | globlastp |
| LYD578_H11 | strawberry|11v1|CO380109 | 1206 | 2971 | 416 | 88.5 | globlastp |
| LYD578_H12 | cacao|10v1|CF974101_P1 | 1207 | 2972 | 416 | 88.4 | globlastp |
| LYD578_H13 | euonymus|11v1|SRR070038X118639_P1 | 1208 | 2973 | 416 | 88.3 | globlastp |

TABLE 54-continued

Homologous polynucleotides and polypeptides which can increase plant yield, seed yield, oil yield,
oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD578_H15 | euonymus\|11v1\|SRR070038X138821_P1 | 1209 | 2974 | 416 | 88.2 | globlastp |
| LYD578_H16 | chestnut\|gb170\|SRR006295S0032584_P1 | 1210 | 2975 | 416 | 88 | globlastp |
| LYD578_H17 | silene\|11v1\|SRR096785X101977 | 1211 | 2976 | 416 | 88 | globlastp |
| LYD578_H18 | tripterygium\|11v1\|SRR098677X118762 | 1212 | 2977 | 416 | 88 | globlastp |
| LYD578_H19 | oak\|10v1\|FP033276_P1 | 1213 | 2978 | 416 | 87.8 | globlastp |
| LYD578_H21 | peanut\|10v1\|ES712396_T1 | 1214 | 2979 | 416 | 87.59 | glotblastn |
| LYD578_H23 | grape\|11v1\|GSVIVT01011574001_P1 | 1215 | 2980 | 416 | 87.3 | globlastp |
| LYD578_H26 | euphorbia\|11v1\|DV112988_P1 | 1216 | 2981 | 416 | 87.1 | globlastp |
| LYD578_H149 | poppy\|11v1\|SRR030259.373171_P1 | 1217 | 2982 | 416 | 86.8 | globlastp |
| LYD578_H29 | tomato\|11v1\|BG131155 | 1218 | 2983 | 416 | 86.8 | globlastp |
| LYD578_H150 | poppy\|11v1\|SRR030259.105041_P1 | 1219 | 2984 | 416 | 86.7 | globlastp |
| LYD578_H30 | canola\|11v1\|EE564982_T1 | 1220 | 2985 | 416 | 86.61 | glotblastn |
| LYD578_H151 | oil_palm\|11v1\|EL687687_P1 | 1221 | 2986 | 416 | 86.5 | globlastp |
| LYD578_H31 | arabidopsis_lyrata\|09v1\|JGIAL016352_P1 | 1222 | 2987 | 416 | 86.5 | globlastp |
| LYD578_H32 | cassava\|09v1\|DV443394_P1 | 1223 | 2988 | 416 | 86.5 | globlastp |
| LYD578_H152 | medicago\|12v1\|AW684124_P1 | 1224 | 2989 | 416 | 86.3 | globlastp |
| LYD578_H36 | arabidopsis\|10v1\|AT2G01970_P1 | 1225 | 2990 | 416 | 86.3 | globlastp |
| LYD578_H37 | medicago\|09v1\|LLAW684124 | 1226 | 2989 | 416 | 86.3 | globlastp |
| LYD578_H39 | thellungiella_parvulum\|11v1\|DN778102 | 1227 | 2991 | 416 | 86.3 | globlastp |
| LYD578_H40 | canola\|11v1\|EE549996_P1 | 1228 | 2992 | 416 | 86.2 | globlastp |
| LYD578_H42 | canola\|11v1\|EE454097_T1 | 1229 | 2993 | 416 | 86.13 | glotblastn |
| LYD578_H43 | canola\|11v1\|DY006061_P1 | 1230 | 2994 | 416 | 86.1 | globlastp |
| LYD578_H44 | canola\|11v1\|DY020128_P1 | 1231 | 2995 | 416 | 86.1 | globlastp |
| LYD578_H45 | humulus\|11v1\|EX520208_P1 | 1232 | 2996 | 416 | 86.1 | globlastp |
| LYD578_H46 | thellungiella_halophilum\|11v1\|DN778102 | 1233 | 2997 | 416 | 86.1 | globlastp |
| LYD578_H153 | b_rapa\|11v1\|CD825207_P1 | 1234 | 2998 | 416 | 86 | globlastp |
| LYD578_H154 | oil_palm\|11v1\|EL691164_P1 | 1235 | 2999 | 416 | 85.8 | globlastp |
| LYD578_H47 | lotus\|09v1\|AI967723_P1 | 1236 | 3000 | 416 | 85.8 | globlastp |
| LYD578_H48 | watermelon\|11v1\|AM739846 | 1237 | 3001 | 416 | 85.8 | globlastp |
| LYD578_H155 | eschscholzia\|11v1\|CD477858_P1 | 1238 | 3002 | 416 | 85.7 | globlastp |
| LYD578_H156 | b_rapa\|11v1\|H74789_P1 | 1239 | 3003 | 416 | 85.6 | globlastp |
| LYD578_H49 | phyla\|11v2\|SRR099035X100102_P1 | 1240 | 3004 | 416 | 85.6 | globlastp |
| LYD578_H50 | thellungiella_parvulum\|11v1\|BY807072 | 1241 | 3005 | 416 | 85.6 | globlastp |
| LYD578_H51 | apple\|11v1\|CX024719_P1 | 1242 | 3006 | 416 | 85.5 | globlastp |
| LYD578_H52 | arabidopsis\|10v1\|AT1G14670_P1 | 1243 | 3007 | 416 | 85.5 | globlastp |
| LYD578_H54 | prunus\|10v1\|CN492032 | 1244 | 3008 | 416 | 85.4 | globlastp |
| LYD578_H55 | tabernaemontana\|11v1\|SRR098689X101380 | 1245 | 3009 | 416 | 85.4 | globlastp |
| LYD578_H56 | thellungiella_halophilum\|11v1\|BY809962 | 1246 | 3010 | 416 | 85.4 | globlastp |
| LYD578_H58 | solanum_phureja\|09v1\|SPHBG131155 | 1247 | 3011 | 416 | 85.3 | globlastp |
| LYD578_H59 | triphysaria\|10v1\|DR175111 | 1248 | 3012 | 416 | 85.3 | globlastp |
| LYD578_H60 | artemisia\|10v1\|EY072332_P1 | 1249 | 3013 | 416 | 85.2 | globlastp |
| LYD578_H157 | sunflower\|12v1\|DY905094_P1 | 1250 | 3014 | 416 | 85.1 | globlastp |
| LYD578_H158 | oil_palm\|11v1\|SRR190698.107991_T1 | 1251 | 3015 | 416 | 85.06 | glotblastn |
| LYD578_H63 | apple\|11v1\|CN492032_P1 | 1252 | 3016 | 416 | 85 | globlastp |
| LYD578_H65 | solanum_phureja\|09v1\|SPHDB721762 | 1253 | 3017 | 416 | 85 | globlastp |
| LYD578_H66 | strawberry\|11v1\|DY674763 | 1254 | 3018 | 416 | 85 | globlastp |
| LYD578_H68 | solanum_phureja\|09v1\|SPHBG134887 | 1255 | 3019 | 416 | 84.9 | globlastp |
| LYD578_H69 | tomato\|11v1\|BG134887 | 1256 | 3020 | 416 | 84.9 | globlastp |
| LYD578_H159 | banana\|12v1\|FF557959_P1 | 1257 | 3021 | 416 | 84.7 | globlastp |
| LYD578_H160 | banana\|12v1\|FL660505_P1 | 1258 | 3022 | 416 | 84.7 | globlastp |
| LYD578_H74 | artemisia\|10v1\|EY043221_P1 | 1259 | 3023 | 416 | 84.6 | globlastp |
| LYD578_H75 | vinca\|11v1\|SRR098690X121789 | 1260 | 3024 | 416 | 84.6 | globlastp |
| LYD578_H76 | cacao\|10v1\|CU588720_T1 | 1261 | 3025 | 416 | 84.55 | glotblastn |
| LYD578_H77 | catharanthus\|11v1\|EG557449_T1 | 1262 | 3026 | 416 | 84.55 | glotblastn |
| LYD578_H78 | amsonia\|11v1\|SRR098688X111096_P1 | 1263 | 3027 | 416 | 84.5 | globlastp |
| LYD578_H80 | flaveria\|11v1\|SRR149229.114845_P1 | 1264 | 3028 | 416 | 84.5 | globlastp |
| LYD578_H82 | sunflower\|10v1\|DY903830 | 1265 | 3029 | 416 | 84.5 | globlastp |
| LYD578_H161 | banana\|12v1\|MAGEN2012035391_P1 | 1266 | 3030 | 416 | 84.4 | globlastp |
| LYD578_H162 | sunflower\|12v1\|DY903830_P1 | 1267 | 3031 | 416 | 84.4 | globlastp |
| LYD578_H163 | sunflower\|12v1\|DY913973_P1 | 1268 | 3032 | 416 | 84.4 | globlastp |
| LYD578_H84 | sunflower\|10v1\|DY907361 | 1269 | 3032 | 416 | 84.4 | globlastp |
| LYD578_H85 | tobacco\|gb162\|DW003003 | 1270 | 3033 | 416 | 84.4 | globlastp |
| LYD578_H86 | vinca\|11v1\|SRR098690X103710 | 1271 | 3034 | 416 | 84.4 | globlastp |
| LYD578_H87 | tripterygium\|11v1\|SRR098677X117684 | 1272 | 3035 | 416 | 84.38 | glotblastn |
| LYD578_H88 | cucumber\|09v1\|AM739846_P1 | 1273 | 3036 | 416 | 84.3 | globlastp |
| LYD578_H90 | ambrosia\|11v1\|SRR346935.3835_T1 | 1274 | 3037 | 416 | 84.21 | glotblastn |
| LYD578_H164 | banana\|12v1\|BBS1314T3_P1 | 1275 | 3038 | 416 | 84.1 | globlastp |
| LYD578_H91 | chestnut\|gb170\|SRR006295S0045171_P1 | 1276 | 3039 | 416 | 84.1 | globlastp |
| LYD578_H92 | euonymus\|11v1\|SRR070038X113826_P1 | 1277 | 3040 | 416 | 84.1 | globlastp |
| LYD578_H93 | catharanthus\|11v1\|SRR098691X104034_T1 | 1278 | 3041 | 416 | 84.03 | glotblastn |
| LYD578_H165 | sunflower\|12v1\|DY907361_P1 | 1279 | 3042 | 416 | 84 | globlastp |
| LYD578_H94 | arnica\|11v1\|SRR099034X111318_P1 | 1280 | 3043 | 416 | 84 | globlastp |
| LYD578_H95 | lettuce\|10v1\|DW111094 | 1281 | 3044 | 416 | 84 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD578_H96 | poplar\|10v1\|AI166075_P1 | 1282 | 3045 | 416 | 84 | globlastp |
| LYD578_H97 | poplar\|10v1\|BI128092_P1 | 1283 | 3046 | 416 | 84 | globlastp |
| LYD578_H166 | plantago\|11v2\|SRR066373X102361_P1 | 1284 | 3047 | 416 | 83.9 | globlastp |
| LYD578_H98 | plantago\|11v1\|SRR066373X102361 | 1285 | 3047 | 416 | 83.9 | globlastp |
| LYD578_H99 | tabernaemontana\|11v1\|SRR098689X100108 | 1286 | 3048 | 416 | 83.9 | globlastp |
| LYD578_H101 | vinca\|11v1\|SRR098690X110217 | 1287 | 3049 | 416 | 83.9 | glotblastn |
| LYD578_H103 | canola\|11v1\|EE485698_T1 | 1288 | 3050 | 416 | 83.87 | glotblastn |
| LYD578_H167 | nasturtium\|11v1\|SRR032558.117106_P1 | 1289 | 3051 | 416 | 83.8 | globlastp |
| LYD578_H104 | cassava\|09v1\|JGICASSAVA18083VALIDM1_P1 | 1290 | 3052 | 416 | 83.8 | globlastp |
| LYD578_H105 | tomato\|11v1\|DB721762 | 1291 | 3053 | 416 | 83.8 | globlastp |
| LYD578_H168 | banana\|12v1\|ES436693_P1 | 1292 | 3054 | 416 | 83.6 | globlastp |
| LYD578_H110 | ambrosia\|11v1\|SRR346935.101384_P1 | 1293 | 3055 | 416 | 83.4 | globlastp |
| LYD578_H111 | oak\|10v1\|FN730940_P1 | 1294 | 3056 | 416 | 83.4 | globlastp |
| LYD578_H112 | ambrosia\|11v1\|SRR346935.101406_T1 | 1295 | 3057 | 416 | 83.33 | glotblastn |
| LYD578_H169 | b_juncea\|12v1\|E6ANDIZ01AHJJJ_T1 | 1296 | 3058 | 416 | 83.31 | glotblastn |
| LYD578_H113 | centaurea\|gb166\|EH717543_P1 | 1297 | 3059 | 416 | 83.3 | globlastp |
| LYD578_H114 | arnica\|11v1\|SRR099034X103662_T1 | 1298 | 3060 | 416 | 83.28 | glotblastn |
| LYD578_H115 | rice\|11v1\|AA751885_P1 | 1299 | 3061 | 416 | 83.2 | globlastp |
| LYD578_H115 | rice\|gb170\|OS03G13380 | 1300 | 3061 | 416 | 83.2 | globlastp |
| LYD578_H170 | brachypodium\|12v1\|BRADI1G68750_P1 | 1301 | 3062 | 416 | 82.9 | globlastp |
| LYD578_H116 | phalaenopsis\|11v1\|SRR125771.1004728_P1 | 1302 | 3063 | 416 | 82.9 | globlastp |
| LYD578_H117 | silene\|11v1\|SRR096785X115898 | 1303 | 3064 | 416 | 82.9 | globlastp |
| LYD578_H171 | sunflower\|12v1\|DY903937_P1 | 1304 | 3065 | 416 | 82.7 | globlastp |
| LYD578_H118 | sunflower\|10v1\|DY903937 | 1305 | 3066 | 416 | 82.7 | globlastp |
| LYD578_H119 | oat\|11v1\|AA231831_P1 | 1306 | 3067 | 416 | 82.5 | globlastp |
| LYD578_H121 | poplar\|10v1\|AI164784_P1 | 1307 | 3068 | 416 | 82.4 | globlastp |
| LYD578_H124 | flaveria\|11v1\|SRR149229.25937_P1 | 1308 | 3069 | 416 | 82.1 | globlastp |
| LYD578_H126 | arabidopsis_lyrata\|09v1\|JGIAL027304_P1 | 1309 | 3070 | 416 | 82 | globlastp |
| LYD578_H127 | ambrosia\|11v1\|SRR346935.566463_P1 | 1310 | 3071 | 416 | 81.8 | globlastp |
| LYD578_H128 | arnica\|11v1\|SRR099034X115318_P1 | 1311 | 3072 | 416 | 81.8 | globlastp |
| LYD578_H130, LGP44 | arabidopsis\|10v1\|AT5G37310_P1 | 1312 | 3073 | 416 | 81.6 | globlastp |
| LYD578_H172 | oil_palm\|11v1\|EL692338_P1 | 1313 | 3074 | 416 | 81.5 | globlastp |
| LYD578_H132 | phalaenopsis\|11v1\|SRR125771.1010602_P1 | 1314 | 3075 | 416 | 81.5 | globlastp |
| LYD578_H133 | flaveria\|11v1\|SRR149229.122528_T1 | 1315 | 3076 | 416 | 81.46 | glotblastn |
| LYD578_H135 | canola\|11v1\|EE543932_P1 | 1316 | 3077 | 416 | 81.2 | globlastp |
| LYD578_H137 | flaveria\|11v1\|SRR149229.125055_T1 | 1317 | 3078 | 416 | 80.95 | glotblastn |
| LYD578_H173 | b_rapa\|11v1\|CD825294_P1 | 1318 | 3079 | 416 | 80.9 | globlastp |
| LYD578_H138 | cannabis\|12v1\|SOLX00055372_P1 | 1319 | 3080 | 416 | 80.6 | globlastp |
| LYD578_H174 | eschscholzia\|11v1\|CD480510XX1_P1 | 1320 | 3081 | 416 | 80.5 | globlastp |
| LYD578_H139 | maritime_pine\|10v1\|AL750688_P1 | 1321 | 3082 | 416 | 80.5 | globlastp |
| LYD578_H140 | amorphophallus\|11v2\|SRR089351X125537_P1 | 1322 | 3083 | 416 | 80.4 | globlastp |
| LYD578_H142 | vinca\|11v1\|SRR098690X112534 | 1323 | 3084 | 416 | 80.3 | globlastp |
| LYD578_H143 | abies\|11v2\|SRR098676X100567_P1 | 1324 | 3085 | 416 | 80.1 | globlastp |
| LYD578_H144 | sequoia\|10v1\|SRR065044S0014146 | 1325 | 3086 | 416 | 80.1 | globlastp |
| LYD578_H145 | brachypodium\|09v1\|DV486133 | 1326 | 3087 | 416 | 80.07 | glotblastn |
| LYD579_H7 | chickpea\|11v1\|FE670056_P1 | 1327 | 3088 | 417 | 87.7 | globlastp |
| LYD579_H8 | pigeonpea\|11v1\|SRR054580X447982_P1 | 1328 | 3089 | 417 | 84.3 | globlastp |
| LYD579_H1 | lotus\|09v1\|AV410218_P1 | 1329 | 3090 | 417 | 84 | globlastp |
| LYD579_H2 | cowpea\|12v1\|FC461356_P1 | 1330 | 3091 | 417 | 83.6 | globlastp |
| LYD579_H2 | cowpea\|gb166\|FC461356 | 1331 | 3091 | 417 | 83.6 | globlastp |
| LYD579_H9 | bean\|12v1\|SRR001336.56224_P1 | 1332 | 3092 | 417 | 83 | globlastp |
| LYD579_H3 | bean\|gb167\|CV530490 | 1333 | 3092 | 417 | 83 | globlastp |
| LYD579_H4 | soybean\|11v1\|GLYMA05G38570 | 1334 | 3093 | 417 | 82.7 | globlastp |
| LYD579_H5 | soybean\|11v1\|GLYMA08G01060 | 1335 | 3094 | 417 | 82.5 | globlastp |
| LYD579_H6 | peanut\|10v1\|CD037669_P1 | 1336 | 3095 | 417 | 80.7 | globlastp |
| LYD580_H3 | medicago\|12v1\|XM_003597757_P1 | 1337 | 3096 | 418 | 95 | globlastp |
| LYD580_H4 | chickpea\|11v1\|GR911819_P1 | 1338 | 3097 | 418 | 86.7 | globlastp |
| LYD585_H1 | medicago\|09v1\|LLBE942833 | 1339 | 3098 | 422 | 98.2 | globlastp |
| LYD585_H2 | trigonella\|11v1\|SRR066194X116540 | 1340 | 3099 | 422 | 90 | globlastp |
| LYD585_H3 | chickpea\|11v1\|SRR133517.103317_P1 | 1341 | 3100 | 422 | 80.3 | globlastp |
| LYD586_H2 | chickpea\|11v1\|SRR133518.12586_P1 | 1342 | 3101 | 423 | 81.5 | globlastp |
| LYD586_H1 | lotus\|09v1\|AW719808_P1 | 1343 | 3102 | 423 | 80.6 | globlastp |
| LYD588_H1 | medicago\|09v1\|CRPMT003032 | 1344 | 3103 | 425 | 87.08 | glotblastn |
| LYD588_H3 | medicago\|12v1\|XM_003615634_P1 | 1345 | 3104 | 425 | 80.6 | globlastp |
| LYD590_H1 | chickpea\|11v1\|SRR133517.134494_T1 | 1346 | 3105 | 427 | 88.06 | glotblastn |
| LYD591_H1 | chickpea\|11v1\|SRR133517.166672_P1 | 1347 | 3106 | 428 | 83.9 | globlastp |
| LYD592_H2 | soybean\|11v1\|GLYMA19G37270_P1 | 1348 | 3107 | 429 | 81.6 | globlastp |
| LYD592_H3 | soybean\|11v1\|GLYMA03G34580_P1 | 1349 | 3108 | 429 | 80.6 | globlastp |
| LYD594_H1 | medicago\|09v1\|LLBF633538 | 1350 | 3109 | 431 | 97 | globlastp |
| LYD598_H1 | wheat\|10v2\|BE400730XX2 | 1351 | 3110 | 435 | 85.4 | globlastp |
| LYD598_H1 | wheat\|12v3\|BT009540_P1 | 1352 | 3110 | 435 | 85.4 | globlastp |
| LYD598_H6 | rye\|12v1\|DRR001012.100407_P1 | 1353 | 3111 | 435 | 85.1 | globlastp |

TABLE 54-continued

Homologous polynucleotides and polypeptides which can increase plant yield, seed yield, oil yield,
oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD598_H7 | sorghum\|12v1\|SB01G042010_P1 | 1354 | 3112 | 435 | 84.9 | globlastp |
| LYD598_H2 | sorghum\|11v1\|SB01G042010 | 1355 | 3112 | 435 | 84.9 | globlastp |
| LYD598_H3 | maize\|10v1\|AI586617_T1 | 1356 | 3113 | 435 | 81.84 | glotblastn |
| LYD598_H4 | foxtail_millet\|11v31PHY7SI035780M_P1 | 1357 | 3114 | 435 | 81.4 | globlastp |
| LYD598_H5 | switchgrass\|gb167\|FL903075 | 1358 | 3115 | 435 | 80.7 | globlastp |
| LYD601 | rice\|11v1\|BI306238_P1 | 1359 | 3116 | 438 | 98.9 | globlastp |
| LYD601 | rice\|11v1\|CK007248_P1 | 1360 | 3116 | 438 | 98.9 | globlastp |
| LYD601_H1 | wheat\|10v2\|BE400601 | 1361 | 3117 | 438 | 83.1 | globlastp |
| LYD601_H8 | sorghum\|12v1\|SB10G002190_P1 | 1362 | 3118 | 438 | 82.5 | globlastp |
| LYD601_H2 | sorghum\|11v1\|SB10G002190 | 1363 | 3118 | 438 | 82.5 | globlastp |
| LYD601_H1 | wheat\|12v3\|CD931110_P1 | 1364 | 3119 | 438 | 82.2 | globlastp |
| LYD601_H3 | foxtail_millet\|11v3\|PHY7SI006804M_P1 | 1365 | 3120 | 438 | 81.1 | globlastp |
| LYD601_H4 | switchgrass\|gb167\|FL690669 | 1366 | 3121 | 438 | 81.1 | globlastp |
| LYD601_H5 | sugarcane\|10v1\|CA084453 | 1367 | 3122 | 438 | 80.8 | globlastp |
| LYD601_H9 | brachypodium\|12v1\|BRADI1G50140_T1 | 1368 | 3123 | 438 | 80.29 | glotblastn |
| LYD601_H6 | barley\|10v2\|AW982216 | 1369 | 3124 | 438 | 80.29 | glotblastn |
| LYD601_H7 | brachypodium\|09v1\|SRR031798S0051694 | 1370 | 3123 | 438 | 80.29 | glotblastn |
| LYD603_H1 | wheat\|10v2\|BG906907 | 1371 | 3125 | 440 | 80.05 | glotblastn |
| LYD603_H1 | wheat\|12v3\|BE591745_T1 | 1372 | 3125 | 440 | 80.05 | glotblastn |
| LYD604_H1 | maize\|10v1\|BM896111_P1 | 1373 | 3126 | 441 | 90.4 | globlastp |
| LYD604_H2 | sugarcane\|10v1\|BQ533093 | 1374 | 3127 | 441 | 90.34 | glotblastn |
| LYD604_H3 | foxtail_millet\|11v3\|PHY7SI014187M_P1 | 1375 | 3128 | 441 | 84.9 | globlastp |
| LYD604_H4 | switchgrass\|gb167\|FL751571 | 1376 | 3129 | 441 | 82.61 | glotblastn |
| LYD604_H5 | foxtail_millet\|11v3\|PHY7SI014332M_P1 | 1377 | 3130 | 441 | 82.2 | globlastp |
| LYD605_H1 | maize\|10v1\|AI395969_P1 | 1378 | 3131 | 442 | 90.2 | globlastp |
| LYD605_H3 | foxtail_millet\|11v3\|PHY7SI032402M_P1 | 1379 | 3132 | 442 | 85.4 | globlastp |
| LYD606_H1 | maize\|10v1\|CD998192_P1 | 1380 | 3133 | 443 | 88.9 | globlastp |
| LYD606_H2 | foxtail_millet\|11v3\|PHY7SI003355M_P1 | 1381 | 3134 | 443 | 85.9 | globlastp |
| LYD606_H3 | switchgrass\|gb167\|FE620000 | 1382 | 3135 | 443 | 82 | globlastp |
| LYD607_H1 | sugarcane\|10v1\|CA090822 | 1383 | 3136 | 444 | 98.3 | globlastp |
| LYD607_H2 | maize\|10v1\|AI461578_P1 | 1384 | 3137 | 444 | 97 | globlastp |
| LYD607_H3 | foxtail_millet\|11v3\|EC613899_P1 | 1385 | 3138 | 444 | 88.4 | globlastp |
| LYD607_H4 | millet\|10v1\|EVO454PM019085_P1 | 1386 | 3139 | 444 | 87.9 | globlastp |
| LYD607_H5 | switchgrass\|gb167\|FL736062 | 1387 | 3140 | 444 | 87.9 | globlastp |
| LYD607_H6 | rice\|11v1\|CA756435_P1 | 1388 | 3141 | 444 | 84.5 | globlastp |
| LYD607_H6 | rice\|gb170\|OS01G59500 | 1389 | 3141 | 444 | 84.5 | globlastp |
| LYD607_H10 | brachypodium\|12v1\|BRADI2G52910_P1 | 1390 | 3142 | 444 | 81.9 | globlastp |
| LYD607_H7 | brachypodium\|09v1\|DV477071 | 1391 | 3142 | 444 | 81.9 | globlastp |
| LYD607_H8 | cynodon\|10v1\|ES293393_T1 | 1392 | 3143 | 444 | 81.9 | glotblastn |
| LYD607_H9 | oat\|11v1\|CN815678_P1 | 1393 | 3144 | 444 | 81 | globlastp |
| LYD608_H1 | foxtail_millet\|11v3\|PHY7SI009630M_P1 | 1394 | 3145 | 445 | 91.6 | globlastp |
| LYD608_H2 | maize\|10v1\|BM498393_P1 | 1395 | 3146 | 445 | 91.3 | globlastp |
| LYD608_H3 | rice\|11v1\|CB629440_P1 | 1396 | 3147 | 445 | 82.1 | globlastp |
| LYD608_H3 | rice\|gb170\|OS09G32840 | 1397 | 3147 | 445 | 82.1 | globlastp |
| LYD608_H4 | millet\|10v1\|EVO454PM008964_P1 | 1398 | 3148 | 445 | 80.7 | globlastp |
| LYD609_H1 | maize\|10v1\|AW091479_P1 | 1399 | 3149 | 446 | 90.8 | globlastp |
| LYD609_H2 | foxtail_millet\|11v3\|PHY7SI021503M_P1 | 1400 | 3150 | 446 | 87.8 | globlastp |
| LYD609_H3 | maize\|10v1\|AW066176_P1 | 1401 | 3151 | 446 | 84.3 | globlastp |
| LYD610_H1 | maize\|10v1\|AW313273_P1 | 1402 | 3152 | 447 | 93.4 | globlastp |
| LYD610_H2 | maize\|10v1\|CD941624_P1 | 1403 | 3153 | 447 | 93.2 | globlastp |
| LYD610_H3 | foxtail_millet\|11v3\|PHY7SI034180M_P1 | 1404 | 3154 | 447 | 91.2 | globlastp |
| LYD610_H4 | millet\|10v1\|EVO454PM000391_T1 | 1405 | 3155 | 447 | 89.61 | glotblastn |
| LYD610_H8 | rice\|11v1\|OSCRP015914_P1 | 1406 | 3156 | 447 | 84.8 | globlastp |
| LYD610_H5 | rice\|11v1\|CA767059_P1 | 1407 | 3157 | 447 | 84.8 | globlastp |
| LYD610_H5 | rice\|gb170\|OS01G56330 | 1408 | 3157 | 447 | 84.8 | globlastp |
| LYD610_H9 | brachypodium\|12v1\|BRADI1G63320_P1 | 1409 | 3158 | 447 | 83.8 | globlastp |
| LYD610_H6 | brachypodium\|09v1\|GT772226 | 1410 | 3158 | 447 | 83.8 | globlastp |
| LYD610_H10 | rye\|12v1\|DRR001012.101001_P1 | 1411 | 3159 | 447 | 82.8 | globlastp |
| LYD610_H11 | rye\|12v1\|DRR001012.103223_P1 | 1412 | 3160 | 447 | 82.6 | globlastp |
| LYD610_H12 | rice\|11v1\|OSCRP079749_P1 | 1413 | 3161 | 447 | 81.3 | globlastp |
| LYD610_H7 | rice\|11v1\|C22581_P1 | 1414 | 3161 | 447 | 81.3 | globlastp |
| LYD610_H7 | rice\|gb170\|OS03G21540 | 1415 | 3161 | 447 | 81.3 | globlastp |
| LYD610_H13 | wheat\|12v3\|BE637867_P1 | 1416 | 3162 | 447 | 80.4 | globlastp |
| LYD610_H14 | wheat\|12v3\|BI751671_T1 | 1417 | 3163 | 447 | 80.36 | glotblastn |
| LYD611_H1 | soybean\|11v1\|GLYMA09G33700 | 1418 | 3164 | 448 | 92.8 | globlastp |
| LYD611_H2 | cowpea\|12v1\|FG852821_P1 | 1419 | 3165 | 448 | 87.8 | globlastp |
| LYD611_H2 | cowpea\|gb166\|FG852821 | 1420 | 3165 | 448 | 87.8 | globlastp |
| LYD611_H3 | bean\|12v1\|SRR001335.371744_P1 | 1421 | 3166 | 448 | 87.3 | globlastp |
| LYD611_H4 | pigeonpea\|11v1\|CCIIPG11007623_P1 | 1422 | 3167 | 448 | 86.5 | globlastp |
| LYD612_H1 | soybean\|11v1\|GLYMA10G02210 | 1423 | 3168 | 449 | 91.9 | globlastp |
| LYD612_H6 | pigeonpea\|11v1\|GR466527_P1 | 1424 | 3169 | 449 | 90.8 | globlastp |
| LYD612_H2 | pigeonpea\|10v1\|GW351945 | 1425 | 3169 | 449 | 90.8 | globlastp |
| LYD612_H7 | bean\|12v1\|CA910393_P1 | 1426 | 3170 | 449 | 84 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD612_H3 | cowpea\|12v1\|FF384755_P1 | 1427 | 3171 | 449 | 82.8 | globlastp |
| LYD612_H3 | cowpea\|gb166\|VIRARG2 | 1428 | 3171 | 449 | 82.8 | globlastp |
| LYD612_H4 | bean\|gb167\|CA910393 | 1429 | 3172 | 449 | 82 | globlastp |
| LYD612_H5 | bean\|gb167\|CB540659 | 1430 | 3173 | 449 | 82 | glotblastn |
| LYD613_H1 | pigeonpea\|11v1\|SRR054580X110249_P1 | 1431 | 3174 | 450 | 82.9 | globlastp |
| LYD613_H2 | bean\|12v1\|SRR090491.1230988_P1 | 1432 | 3175 | 450 | 80.2 | globlastp |
| LYD614_H1 | soybean\|11v1\|GLYMA14G06640 | 1433 | 3176 | 451 | 86 | globlastp |
| LYD615_H1 | soybean\|11v1\|GLYMA19G30660 | 1434 | 3177 | 452 | 94.4 | globlastp |
| LYD615_H4 | bean\|12v1\|CB543286_P1 | 1435 | 3178 | 452 | 88.9 | globlastp |
| LYD615_H5 | pigeonpea\|11v1\|SRR054580X163954_P1 | 1436 | 3179 | 452 | 88.5 | globlastp |
| LYD615_H2 | lotus\|09v1\|BP070765_P1 | 1437 | 3180 | 452 | 81.5 | globlastp |
| LYD615_H6 | medicago\|12v1\|AW684979_P1 | 1438 | 3181 | 452 | 81.4 | globlastp |
| LYD615_H3 | medicago\|09v1\|AW684979 | 1439 | 3181 | 452 | 81.4 | globlastp |
| LYD616_H4 | bean\|12v1\|SRR001334.260126_T1 | 1440 | 3182 | 453 | 88.4 | glotblastn |
| LYD616_H5 | pigeonpea\|11v1\|SRR054580X112099_T1 | 1441 | 3183 | 453 | 87.88 | glotblastn |
| LYD616_H6 | chickpea\|11v1\|FE671275_T1 | 1442 | 3184 | 453 | 84.37 | glotblastn |
| LYD616_H1 | lotus\|09v1\|CRPLJ028046_T1 | 1443 | 3185 | 453 | 82.69 | glotblastn |
| LYD616_H7 | medicago\|12v1\|BG450022_P1 | 1444 | 3186 | 453 | 82.5 | globlastp |
| LYD616_H2 | medicago\|09v1\|BG450022 | 1445 | 3186 | 453 | 82.5 | globlastp |
| LYD616_H3 | soybean\|11v1\|GLYMA19G39560 | 1446 | 3187 | 453 | 80.8 | globlastp |
| LYD617_H1 | cyamopsis\|10v1\|EG979147_P1 | 1447 | 3188 | 454 | 93.3 | globlastp |
| LYD617_H2 | liquorice\|gb171\|FS251251_P1 | 1448 | 3189 | 454 | 93.3 | globlastp |
| LYD617_H3 | cowpea\|12v1\|FF382757_P1 | 1449 | 3190 | 454 | 91.3 | globlastp |
| LYD617_H19 | chickpea\|11v1\|SRR133517.118502_P1 | 1450 | 3191 | 454 | 91 | globlastp |
| LYD617_H3 | cowpea\|gb166\|FF382757 | 1451 | 3192 | 454 | 90.2 | globlastp |
| LYD617_H20 | pigeonpea\|11v1\|GR470046_P1 | 1452 | 3193 | 454 | 88.8 | globlastp |
| LYD617_H4 | pigeonpea\|10v1\|GR470046 | 1453 | 3193 | 454 | 88.8 | globlastp |
| LYD617_H21 | medicago\|12v1\|AW329294_P1 | 1454 | 3194 | 454 | 87.6 | globlastp |
| LYD617_H5 | medicago\|09v1\|AW329294 | 1455 | 3194 | 454 | 87.6 | globlastp |
| LYD617_H22 | medicago\|12v1\|BF632685_P1 | 1456 | 3195 | 454 | 85.4 | globlastp |
| LYD617_H6 | trigonella\|11v1\|SRR066194X345953 | 1457 | 3196 | 454 | 85.4 | globlastp |
| LYD617_H23 | medicago\|12v1\|AL381382_P1 | 1458 | 3197 | 454 | 84.3 | globlastp |
| LYD617_H7 | lotus\|09v1\|AW428820_P1 | 1459 | 3198 | 454 | 84.3 | globlastp |
| LYD617_H8 | medicago\|09v1\|AL381382 | 1460 | 3197 | 454 | 84.3 | globlastp |
| LYD617_H24 | chickpea\|11v1\|GR394427_P1 | 1461 | 3199 | 454 | 83.1 | globlastp |
| LYD617_H9 | soybean\|11v1\|GLYMA10G02430 | 1462 | 3200 | 454 | 83.1 | globlastp |
| LYD617_H25 | bean\|12v1\|CA898865_P1 | 1463 | 3201 | 454 | 82 | globlastp |
| LYD617_H26 | pigeonpea\|11v1\|SRR054580X13373_P1 | 1464 | 3202 | 454 | 82 | globlastp |
| LYD617_H10 | bean\|gb167\|CA898865 | 1465 | 3201 | 454 | 82 | globlastp |
| LYD617_H11 | clover\|gb162\|BB921888_P1 | 1466 | 3203 | 454 | 82 | globlastp |
| LYD617_H12 | pigeonpea\|10v1\|SRR054580S0013374 | 1467 | 3202 | 454 | 82 | globlastp |
| LYD617_H13 | soybean\|11v1\|GLYMA02G17370 | 1468 | 3204 | 454 | 82 | globlastp |
| LYD617_H14 | cassava\|09v1\|DV442613_P1 | 1469 | 3205 | 454 | 80.9 | globlastp |
| LYD617_H15 | cowpea\|12v1\|FF385220_P1 | 1470 | 3206 | 454 | 80.9 | globlastp |
| LYD617_H16 | cucurbita\|11v1\|SRR091276X10451_T1 | 1471 | 3207 | 454 | 80.9 | glotblastn |
| LYD617_H17 | oak\|10v1\|FP034480_P1 | 1472 | 3208 | 454 | 80.9 | globlastp |
| LYD617_H18 | trigonella\|11v1\|SRR066194X186437 | 1473 | 3209 | 454 | 80.9 | globlastp |
| LYD620_H1 | soybean\|11v1\|GLYMA17G08660 | 1474 | 3210 | 457 | 92.9 | globlastp |
| LYD620_H2 | bean\|12v1\|CA902170_P1 | 1475 | 3211 | 457 | 84.2 | globlastp |
| LYD620_H3 | pigeonpea\|11v1\|SRR054580X100276_P1 | 1476 | 3212 | 457 | 82.4 | globlastp |
| LYD621_H1 | soybean\|11v1\|GLYMA08G05040 | 1477 | 3213 | 458 | 96 | globlastp |
| LYD621_H5 | bean\|12v1\|CB542975_P1 | 1478 | 3214 | 458 | 92.1 | globlastp |
| LYD621_H6 | pigeonpea\|11v1\|SRR054580X105242_P1 | 1479 | 3215 | 458 | 91.4 | globlastp |
| LYD621_H2 | pigeonpea\|10v1\|SRR054580S0018657 | 1480 | 3216 | 458 | 91.35 | glotblastn |
| LYD621_H3 | lotus\|09v1\|GO024264_P1 | 1481 | 3217 | 458 | 86 | globlastp |
| LYD621_H7 | chickpea\|11v1\|SRR133517.133212_T1 | 1482 | 3218 | 458 | 85.77 | glotblastn |
| LYD621_H8 | medicago\|12v1\|AI974296_P1 | 1483 | 3219 | 458 | 84.3 | globlastp |
| LYD621_H4 | medicago\|09v1\|AI974296 | 1484 | 3219 | 458 | 84.3 | globlastp |
| LYD622_H1 | soybean\|11v1\|GLYMA04G03680 | 1485 | 3220 | 459 | 97.8 | globlastp |
| LYD622_H12 | pigeonpea\|11v1\|SRR054580X103966_P1 | 1486 | 3221 | 459 | 91.4 | globlastp |
| LYD622_H2 | cowpea\|12v1\|FF543494_P1 | 1487 | 3222 | 459 | 90 | globlastp |
| LYD622_H2 | cowpea\|gb166\|FF543494 | 1488 | 3222 | 459 | 90 | globlastp |
| LYD622_H3 | pigeonpea\|10v1\|SRR054580S0037538 | 1489 | 3223 | 459 | 87.5 | globlastp |
| LYD622_H13 | bean\|12v1\|FE899993_P1 | 1490 | 3224 | 459 | 87.1 | globlastp |
| LYD622_H4 | lotus\|09v1\|CB828440_P1 | 1491 | 3225 | 459 | 84 | globlastp |
| LYD622_H14 | chickpea\|11v1\|GR396021_P1 | 1492 | 3226 | 459 | 83.5 | globlastp |
| LYD622_H5 | peanut\|10v1\|GO338761_P1 | 1493 | 3227 | 459 | 82.4 | globlastp |
| LYD622_H6 | liquorice\|gb171\|FS241834_P1 | 1494 | 3228 | 459 | 81.9 | globlastp |
| LYD622_H7 | cassava\|09v1\|DV454935_P1 | 1495 | 3229 | 459 | 81.4 | globlastp |
| LYD622_H8 | clover\|gb162\|BB911490_P1 | 1496 | 3230 | 459 | 81.4 | globlastp |
| LYD622_H9 | bean\|gb167\|FE899993 | 1497 | 3231 | 459 | 81.03 | glotblastn |
| LYD622_H10 | medicago\|09v1\|LLBF646969 | 1498 | 3232 | 459 | 80.8 | globlastp |
| LYD622_H15 | medicago\|12v1\|BF646969_T1 | 1499 | 3233 | 459 | 80.34 | glotblastn |

TABLE 54-continued

Homologous polynucleotides and polypeptides which can increase plant yield, seed yield, oil yield,
oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD622_H11 | trigonella\|11v1\|SRR066194X120913 | 1500 | 3234 | 459 | 80.3 | globlastp |
| LYD623_H1 | soybean\|11v1\|GLYMA04G05890 | 1501 | 3235 | 460 | 85 | globlastp |
| LYD624_H3 | bean\|12v1\|GFXX53603X1_P1 | 1502 | 3236 | 461 | 83.6 | globlastp |
| LYD624_H1 | bean\|gb167\|GFXX53603X1 | 1503 | 3236 | 461 | 83.6 | globlastp |
| LYD624_H2 | soybean\|11v1\|GLYMA13G02510 | 1504 | 3237 | 461 | 80.4 | globlastp |
| LYD625_H1 | pigeonpea\|11v1\|SRR054580X387827_P1 | 1505 | 3238 | 462 | 84.8 | globlastp |
| LYD625_H2 | bean\|12v1\|FE703801_P1 | 1506 | 3239 | 462 | 81.5 | globlastp |
| LYD626_H5 | pigeonpea\|11v1\|SRR054580X120385_P1 | 1507 | 3240 | 463 | 90 | globlastp |
| LYD626_H1 | pigeonpea\|10v1\|SRR054580S0079586 | 1508 | 3240 | 463 | 90 | globlastp |
| LYD626_H2 | cowpea\|12v1\|FF384015_P1 | 1509 | 3241 | 463 | 84 | globlastp |
| LYD626_H2 | cowpea\|gb166\|FF384015 | 1510 | 3241 | 463 | 84 | globlastp |
| LYD626_H6 | bean\|12v1\|FE683652_P1 | 1511 | 3242 | 463 | 82.7 | globlastp |
| LYD626_H3 | bean\|gb167\|CV530073 | 1512 | 3242 | 463 | 82.7 | globlastp |
| LYD626_H7 | medicago\|12v1\|AW776098_P1 | 1513 | 3243 | 463 | 80.8 | globlastp |
| LYD626_H4 | medicago\|09v1\|AW776098 | 1514 | 3243 | 463 | 80.8 | globlastp |
| LYD627_H1 | soybean\|11v1\|GLYMA18G19050 | 1515 | 3244 | 464 | 94.46 | glotblastn |
| LYD627_H8 | pigeonpea\|11v1\|SRR054580X103254_T1 | 1516 | 3245 | 464 | 88.69 | glotblastn |
| LYD627_H9 | bean\|12v1\|CK901542_T1 | 1517 | 3246 | 464 | 88.53 | glotblastn |
| LYD627_H2 | bean\|gb167\|CK901542 | 1518 | 3246 | 464 | 88.53 | glotblastn |
| LYD627_H3 | pigeonpea\|10v1\|SRR054580S0002136 | 1519 | 3247 | 464 | 87.69 | glotblastn |
| LYD627_H4 | cowpea\|12v1\|FC461147_T1 | 1520 | 3248 | 464 | 86.65 | glotblastn |
| LYD627_H4 | cowpea\|gb166\|FC461147 | 1521 | 3248 | 464 | 86.65 | glotblastn |
| LYD627_H5 | lotus\|09v1\|AV775154_T1 | 1522 | 3249 | 464 | 85.93 | glotblastn |
| LYD627_H10 | chickpea\|11v1\|SRR133517.106923_T1 | 1523 | 3250 | 464 | 84.54 | glotblastn |
| LYD627_H6 | peanut\|10v1\|GO263794_T1 | 1524 | 3251 | 464 | 83.29 | glotblastn |
| LYD627_H7 | clover\|gb162\|BB914886_T1 | 1525 | 3252 | 464 | 81.86 | glotblastn |
| LYD628_H2 | pigeonpea\|11v1\|CCIIPG11026354_T1 | 1526 | 3253 | 465 | 88.95 | glotblastn |
| LYD628_H1 | soybean\|11v1\|GLYMA16G32600 | 1527 | 3254 | 465 | 88 | globlastp |
| LYD628_H3 | bean\|12v1\|CV534892_P1 | 1528 | 3255 | 465 | 86.6 | globlastp |
| LYD629_H1 | soybean\|11v1\|GLYMA07G12030 | 1529 | 3256 | 466 | 96.8 | globlastp |
| LYD629_H12 | pigeonpea\|11v1\|SRR054580X119400_P1 | 1530 | 3257 | 466 | 90.5 | globlastp |
| LYD629_H2 | pigeonpea\|10v1\|SRR054580S0000470 | 1531 | 3257 | 466 | 90.5 | globlastp |
| LYD629_H3 | cowpea\|12v1\|EG594224_P1 | 1532 | 3258 | 466 | 89.3 | globlastp |
| LYD629_H3 | cowpea\|gb166\|EG594224 | 1533 | 3258 | 466 | 89.3 | globlastp |
| LYD629_H4 | bean\|gb167\|CV543026 | 1534 | 3259 | 466 | 88.4 | globlastp |
| LYD629_H13 | bean\|12v1\|SRR001334.139650_P1 | 1535 | 3260 | 466 | 88.1 | globlastp |
| LYD629_H14 | chickpea\|11v1\|GR393168_P1 | 1536 | 3261 | 466 | 86.4 | globlastp |
| LYD629_H5 | lotus\|09v1\|BF177689_P1 | 1537 | 3262 | 466 | 85.2 | globlastp |
| LYD629_H6 | trigonella\|11v1\|SRR066194X308576 | 1538 | 3263 | 466 | 84.2 | globlastp |
| LYD629_H15 | medicago\|12v1\|AW256951_P1 | 1539 | 3264 | 466 | 83.3 | globlastp |
| LYD629_H7 | medicago\|09v1\|LLAW256951 | 1540 | 3264 | 466 | 83.3 | globlastp |
| LYD629_H16 | medicago\|12v1\|BI311156_P1 | 1541 | 3265 | 466 | 83 | globlastp |
| LYD629_H8 | medicago\|09v1\|LLBI311156 | 1542 | 3265 | 466 | 83 | globlastp |
| LYD629_H9 | trigonella\|11v1\|SRR066194X184937 | 1543 | 3266 | 466 | 83 | globlastp |
| LYD629_H10 | peanut\|10v1\|SRR042413S0011977_P1 | 1544 | 3267 | 466 | 81.4 | globlastp |
| LYD629_H11 | soybean\|11v1\|GLYMA08G06100 | 1545 | 3268 | 466 | 81.4 | globlastp |
| LYD630_H1 | soybean\|11v1\|GLYMA12G01600 | 1546 | 3269 | 467 | 96.6 | globlastp |
| LYD630_H5 | pigeonpea\|11v1\|SRR054580X116473_P1 | 1547 | 3270 | 467 | 90.2 | globlastp |
| LYD630_H6 | bean\|12v1\|CB280685_P1 | 1548 | 3271 | 467 | 87.5 | globlastp |
| LYD630_H2 | bean\|gb167\|CB280685 | 1549 | 3272 | 467 | 87.3 | globlastp |
| LYD630_H3 | lotus\|09v1\|BP040921_P1 | 1550 | 3273 | 467 | 84.5 | globlastp |
| LYD630_H7 | medicago\|12v1\|AW256804_T1 | 1551 | 3274 | 467 | 80.59 | glotblastn |
| LYD630_H4 | medicago\|09v1\|LLAW776894 | 1552 | 3275 | 467 | 80.4 | glotblastn |
| LYD631_H1 | soybean\|11v1\|GLYMA12G00640 | 1553 | 3276 | 468 | 94 | globlastp |
| LYD631_H2 | cowpea\|12v1\|FG816078_P1 | 1554 | 3277 | 468 | 92 | globlastp |
| LYD631_H8 | bean\|12v1\|EG562963_P1 | 1555 | 3278 | 468 | 91.1 | globlastp |
| LYD631_H2 | cowpea\|gb166\|FG816078 | 1556 | 3279 | 468 | 87.7 | globlastp |
| LYD631_H9 | pigeonpea\|11v1\|CCIIPG11021826_P1 | 1557 | 3280 | 468 | 87.4 | globlastp |
| LYD631_H10 | pigeonpea\|11v1\|SRR054580X555062_P1 | 1558 | 3280 | 468 | 87.4 | globlastp |
| LYD631_H3 | peanut\|10v1\|ES712405_P1 | 1559 | 3281 | 468 | 85.8 | globlastp |
| LYD631_H4 | bean\|gb167\|CV530804 | 1560 | 3282 | 468 | 84.2 | globlastp |
| LYD631_H5 | lotus\|09v1\|LLAW720068_P1 | 1561 | 3283 | 468 | 83 | globlastp |
| LYD631_H6 | medicago\|09v1\|BE239557 | 1562 | 3284 | 468 | 81.9 | glotblastn |
| LYD631_H11 | chickpea\|11v1\|SRR133517.10769_P1 | 1563 | 3285 | 468 | 81.8 | globlastp |
| LYD631_H12 | medicago\|12v1\|BE239557_T1 | 1564 | 3286 | 468 | 81.61 | glotblastn |
| LYD631_H7 | trigonella\|11v1\|SRR066194X150691 | 1565 | 3287 | 468 | 81.38 | glotblastn |
| LYD632_H3 | soybean\|11v1\|GLYMA03G36100 | 1566 | 3288 | 469 | 95 | globlastp |
| LYD632_H6 | pigeonpea\|11v1\|GR464470_P1 | 1567 | 3289 | 469 | 90.1 | globlastp |
| LYD632_H7 | bean\|12v1\|FE693882_P1 | 1568 | 3290 | 469 | 89.1 | globlastp |
| LYD632_H4 | bean\|gb167\|CV541137 | 1569 | 3291 | 469 | 88.8 | globlastp |
| LYD632_H5 | cowpea\|12v1\|FF390940_P1 | 1570 | 3292 | 469 | 88.4 | globlastp |
| LYD632_H5 | cowpea\|gb166\|FF390940 | 1571 | 3292 | 469 | 88.4 | globlastp |
| LYD634_H1 | soybean\|11v1\|GLYMA11G18460 | 1572 | 3293 | 471 | 89.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD634_H2 | cowpea\|12v1\|FF384860_P1 | 1573 | 3294 | 471 | 87.6 | globlastp |
| LYD634_H2 | cowpea\|gb166\|FF384860 | 1574 | 3294 | 471 | 87.6 | globlastp |
| LYD634_H6 | bean\|12v1\|FE899187_P1 | 1575 | 3295 | 471 | 86.6 | globlastp |
| LYD634_H3 | bean\|gb167\|CV532868 | 1576 | 3295 | 471 | 86.6 | globlastp |
| LYD634_H7 | pigeonpea\|11v1\|EE605085_P1 | 1577 | 3296 | 471 | 83.7 | globlastp |
| LYD634_H4 | pigeonpea\|10v1\|EE605085 | 1578 | 3296 | 471 | 83.7 | globlastp |
| LYD634_H5 | soybean\|11v1\|GLYMA13G39040 | 1579 | 3297 | 471 | 80.71 | globlastn |
| LYD635_H1 | soybean\|11v1\|GLYMA19G01910 | 1580 | 3298 | 472 | 95 | globlastp |
| LYD635_H4 | bean\|12v1\|SRR001334.123668_P1 | 1581 | 3299 | 472 | 84.1 | globlastp |
| LYD635_H5 | pigeonpea\|11v1\|SRR054580X104907_P1 | 1582 | 3300 | 472 | 83.6 | globlastp |
| LYD635_H2 | bean\|gb167\|FE680073 | 1583 | 3301 | 472 | 83.55 | glotblastn |
| LYD635_H3 | cowpea\|12v1\|FF391308_P1 | 1584 | 3302 | 472 | 81.8 | globlastp |
| LYD635_H3 | cowpea\|gb166\|FF391308 | 1585 | 3303 | 472 | 81.2 | globlastp |
| LYD636_H3 | bean\|12v1\|CA908996_P1 | 1586 | 3304 | 473 | 92.5 | globlastp |
| LYD636_H1 | soybean\|11v1\|GLYMA10G04660 | 1587 | 3305 | 473 | 91.6 | globlastp |
| LYD636_H4 | pigeonpea\|11v1\|SRR054580X16507_P1 | 1588 | 3306 | 473 | 89.8 | globlastp |
| LYD636_H2 | pigeonpea\|10v1\|SRR054580S0016508 | 1589 | 3307 | 473 | 87 | globlastp |
| LYD636_H5 | chickpea\|11v1\|SRR133517.131366_P1 | 1590 | 3308 | 473 | 84.2 | globlastp |
| LYD636_H6 | medicago\|12v1\|AW256943_P1 | 1591 | 3309 | 473 | 81.2 | globlastp |
| LYD638_H1 | soybean\|11v1\|GLYMA15G03820 | 1592 | 3310 | 475 | 98.9 | globlastp |
| LYD638_H2 | cowpea\|12v1\|FF394689_P1 | 1593 | 3311 | 475 | 97.1 | globlastp |
| LYD638_H2 | cowpea\|gb166\|FF394689 | 1594 | 3311 | 475 | 97.1 | globlastp |
| LYD638_H81 | pigeonpea\|11v1\|SRR054580X102130_P1 | 1595 | 3312 | 475 | 96.4 | globlastp |
| LYD638_H82 | bean\|12v1\|FG229632_P1 | 1596 | 3313 | 475 | 95.7 | globlastp |
| LYD638_H3 | bean\|gb167\|CV530755 | 1597 | 3313 | 475 | 95.7 | globlastp |
| LYD638_H83 | chickpea\|11v1\|SRR133517.112219_P1 | 1598 | 3314 | 475 | 93.8 | globlastp |
| LYD638_H4 | trigonella\|11v1\|SRR066194X12107 | 1599 | 3315 | 475 | 91.7 | globlastp |
| LYD638_H5 | medicago\|09v1\|DY618321 | 1600 | 3316 | 475 | 91.3 | globlastp |
| LYD638_H6 | castorbean\|11v1\|GE635823_P1 | 1601 | 3317 | 475 | 89.9 | globlastp |
| LYD638_H7 | monkeyflower\|10v1\|GO987981_P1 | 1602 | 3318 | 475 | 89.9 | globlastp |
| LYD638_H84 | beech\|11v1\|SRR006293.6452_T1 | 1603 | 3319 | 475 | 89.13 | glotblastn |
| LYD638_H8 | orobanche\|10v1\|SRR023189S0002399_P1 | 1604 | 3320 | 475 | 89.1 | globlastp |
| LYD638_H9 | cacao\|10v1\|CF974571_P1 | 1605 | 3321 | 475 | 88.8 | globlastp |
| LYD638_H10 | grape\|11v1\|GSVIVT01025302001_P1 | 1606 | 3322 | 475 | 88.8 | globlastp |
| LYD638_H11 | watermelon\|11v1\|CV004917 | 1607 | 3323 | 475 | 88.8 | globlastp |
| LYD638_H12 | cotton\|10v2\|DV849102 | 1608 | 3324 | 475 | 88.41 | glotblastn |
| LYD638_H13 | cotton\|10v2\|SRR032878S0082451 | 1609 | 3325 | 475 | 88.41 | glotblastn |
| LYD638_H14 | fagopyrum\|11v1\|SRR063689X125403_T1 | 1610 | 3326 | 475 | 88.41 | glotblastn |
| LYD638_H15 | cotton\|10v2\|CO088742 | 1611 | 3327 | 475 | 88.4 | globlastp |
| LYD638_H16 | cotton\|10v2\|DT053039 | 1612 | 3327 | 475 | 88.4 | globlastp |
| LYD638_H17 | cotton\|10v2\|SRR032878S0001106 | 1613 | 3328 | 475 | 88.4 | globlastp |
| LYD638_H18 | cassava\|09v1\|JGICASSAVA30684VALIDM1_P1 | 1614 | 3329 | 475 | 88 | globlastp |
| LYD638_H19 | oak\|10v1\|FP073589_P1 | 1615 | 3330 | 475 | 88 | globlastp |
| LYD638_H20 | cucumber\|09v1\|CV004917_P1 | 1616 | 3331 | 475 | 87.7 | globlastp |
| LYD638_H21 | flaveria\|11v1\|SRR149229.153655_P1 | 1617 | 3332 | 475 | 87.7 | globlastp |
| LYD638_H22 | fagopyrum\|11v1\|SRR063689X115245_T1 | 1618 | 3333 | 475 | 87.32 | glotblastn |
| LYD638_H85 | lettuce\|12v1\|DY981698_P1 | 1619 | 3334 | 475 | 87.3 | globlastp |
| LYD638_H23 | artemisia\|10v1\|EY093426_P1 | 1620 | 3335 | 475 | 87.3 | globlastp |
| LYD638_H24 | citrus\|gb166\|CB290538 | 1621 | 3336 | 475 | 87.3 | globlastp |
| LYD638_H25 | orange\|11v1\|CB290538_P1 | 1622 | 3336 | 475 | 87.3 | globlastp |
| LYD638_H26 | strawberry\|11v1\|CO381546 | 1623 | 3337 | 475 | 87.3 | globlastp |
| LYD638_H27 | valeriana\|11v1\|SRR099039X104058 | 1624 | 3338 | 475 | 87.3 | globlastp |
| LYD638_H86 | nasturtium\|11v1\|SRR032558.128316_P1 | 1625 | 3339 | 475 | 87 | globlastp |
| LYD638_H28 | aquilegia\|10v2\|DR946895_P1 | 1626 | 3340 | 475 | 87 | globlastp |
| LYD638_H29 | cannabis\|12v1\|JK501697_P1 | 1627 | 3341 | 475 | 87 | globlastp |
| LYD638_H30 | clementine\|11v1\|CB290538_P1 | 1628 | 3342 | 475 | 87 | globlastp |
| LYD638_H31 | flaveria\|11v1\|SRR149229.229217_P1 | 1629 | 3343 | 475 | 87 | globlastp |
| LYD638_H32 | poplar\|10v1\|BU869270_P1 | 1630 | 3344 | 475 | 87 | globlastp |
| LYD638_H33 | potato\|10v1\|BQ118035_P1 | 1631 | 3345 | 475 | 87 | globlastp |
| LYD638_H34 | primula\|11v1\|SRR098679X102565_P1 | 1632 | 3346 | 475 | 87 | globlastp |
| LYD638_H35 | solanum_phureja\|09v1\|SPHBG126806 | 1633 | 3345 | 475 | 87 | globlastp |
| LYD638_H36 | tragopogon\|10v1\|SRR020205S0000931 | 1634 | 3347 | 475 | 87 | globlastp |
| LYD638_H37 | cirsium\|11v1\|SRR346952.102669_P1 | 1635 | 3348 | 475 | 86.6 | globlastp |
| LYD638_H38 | sunflower\|10v1\|EE615497 | 1636 | 3349 | 475 | 86.6 | globlastp |
| LYD638_H39 | eucalyptus\|11v2\|ES588617_P1 | 1637 | 3350 | 475 | 86.2 | globlastp |
| LYD638_H40 | euphorbia\|11v1\|DV126968_P1 | 1638 | 3351 | 475 | 86.2 | globlastp |
| LYD638_H41 | tomato\|11v1\|BG126806 | 1639 | 3352 | 475 | 86.2 | globlastp |
| LYD638_H87 | sunflower\|12v1\|EE615497_P1 | 1640 | 3353 | 475 | 85.9 | globlastp |
| LYD638_H42 | apple\|11v1\|CV129099_P1 | 1641 | 3354 | 475 | 85.9 | globlastp |
| LYD638_H43 | centaurea\|gb166\|EH713237_P1 | 1642 | 3355 | 475 | 85.9 | globlastp |
| LYD638_H44 | cirsium\|11v1\|SRR346952.1023775_P1 | 1643 | 3355 | 475 | 85.9 | globlastp |
| LYD638_H45 | prunus\|10v1\|BU039771 | 1644 | 3356 | 475 | 85.9 | globlastp |
| LYD638_H46 | silene\|11v1\|SRR096785X108818 | 1645 | 3357 | 475 | 85.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD638_H47 | ambrosia\|11v1\|SRR346935.354746_T1 | 1646 | 3358 | 475 | 85.87 | glotblastn |
| LYD638_H48 | aristolochia\|10v1\|SRR039082S0002743_P1 | 1647 | 3359 | 475 | 85.6 | globlastp |
| LYD638_H88 | oil_palm\|11v1\|EL687196_P1 | 1648 | 3360 | 475 | 85.5 | globlastp |
| LYD638_H49 | ambrosia\|11v1\|SRR346935.108772_T1 | 1649 | 3361 | 475 | 85.14 | glotblastn |
| LYD638_H50 | flaveria\|11v1\|SRR149232.113890_T1 | 1650 | 3362 | 475 | 85.14 | glotblastn |
| LYD638_H89 | poppy\|11v1\|SRR030259.114169_P1 | 1651 | 3363 | 475 | 85.1 | globlastp |
| LYD638_H90 | amborella\|12v3\|SRR038634.23330_P1 | 1652 | 3364 | 475 | 84.8 | globlastp |
| LYD638_H51 | poplar\|10v1\|XM002303855_P1 | 1653 | 3365 | 475 | 84.8 | globlastp |
| LYD638_H52 | rice\|11v1\|AU031876_P1 | 1654 | 3366 | 475 | 84.8 | globlastp |
| LYD638_H52 | rice\|gb170\|OS02G10230 | 1655 | 3366 | 475 | 84.8 | globlastp |
| LYD638_H53 | thellungiella_parvulum\|11v1\|BY812134 | 1656 | 3367 | 475 | 84.8 | globlastp |
| LYD638_H91 | onion\|12v1\|CF441304_T1 | 1657 | 3368 | 475 | 84.78 | glotblastn |
| LYD638_H54 | monkeyflower\|10v1\|SRR037227S0052581_P1 | 1658 | 3369 | 475 | 84.6 | globlastp |
| LYD638_H92 | beet\|12v1\|BQ593198_P1 | 1659 | 3370 | 475 | 84.5 | globlastp |
| LYD638_H93 | poppy\|11v1\|SRR030259.110127_T1 | 1660 | 3371 | 475 | 84.42 | glotblastn |
| LYD638_H55 | cirsium\|11v1\|SRR346952.1012572_T1 | 1661 | 3372 | 475 | 84.42 | glotblastn |
| LYD638_H56 | tripterygium\|11v1\|SRR098677X170048 | 1662 | 3373 | 475 | 84.4 | globlastp |
| LYD638_H94 | bean\|12v1\|SRR090491.1076536_P1 | 1663 | 3374 | 475 | 84.1 | globlastp |
| LYD638_H95 | poppy\|11v1\|SRR033668.365155_P1 | 1664 | 3375 | 475 | 84.1 | globlastp |
| LYD638_H57 | soybean\|11v1\|GLYMA11G14090 | 1665 | 3376 | 475 | 84.1 | globlastp |
| LYD638_H58 | cucurbita\|11v1\|SRR091276X112061_T1 | 1666 | 3377 | 475 | 84.06 | glotblastn |
| LYD638_H96 | b_juncea\|12v1\|E6ANDIZ01A97YX_P1 | 1667 | 3378 | 475 | 83.7 | globlastp |
| LYD638_H59 | b_juncea\|10v2\|E6ANDIZ01A97YX | 1668 | 3378 | 475 | 83.7 | globlastp |
| LYD638_H60 | canola\|11v1\|EE439609_P1 | 1669 | 3378 | 475 | 83.7 | globlastp |
| LYD638_H61 | canola\|11v1\|EE473348_P1 | 1670 | 3378 | 475 | 83.7 | globlastp |
| LYD638_H62 | canola\|11v1\|SRR019557.21478_P1 | 1671 | 3378 | 475 | 83.7 | globlastp |
| LYD638_H63 | phalaenopsis\|11v1\|SRR125771.1013801_P1 | 1672 | 3379 | 475 | 83.7 | globlastp |
| LYD638_H64 | b_rapa\|gb162\|EE519713 | 1673 | 3380 | 475 | 83.33 | glotblastn |
| LYD638_H65 | radish\|gb164\|EV530173 | 1674 | 3381 | 475 | 83.3 | globlastp |
| LYD638_H97 | b_rapa\|11v1\|CD813392_P1 | 1675 | 3382 | 475 | 83.1 | globlastp |
| LYD638_H98 | gossypium_raimondii\|12v1\|DV849102_P1 | 1676 | 3383 | 475 | 83 | globlastp |
| LYD638_H66 | thellungiella_halophilum\|11v1\|BY812134 | 1677 | 3384 | 475 | 82.7 | globlastp |
| LYD638_H67 | amorphophallus\|11v2\|SRR089351X167144_T1 | 1678 | 3385 | 475 | 82.61 | glotblastn |
| LYD638_H68 | phyla\|11v2\|SRR099037X109540_T1 | 1679 | 3386 | 475 | 82.61 | glotblastn |
| LYD638_H99 | chickpea\|11v1\|SRR133517.214658_T1 | 1680 | 3387 | 475 | 82.25 | glotblastn |
| LYD638_H69 | ambrosia\|11v1\|SRR346935.23488_P1 | 1681 | 3388 | 475 | 82.2 | globlastp |
| LYD638_H70 | arabidopsis_lyrata\|09v1\|JGIAL010678_P1 | 1682 | 3389 | 475 | 82.2 | globlastp |
| LYD638_H71 | triphysaria\|10v1\|EY128050 | 1683 | 3390 | 475 | 82.2 | globlastp |
| LYD638_H100 | b_juncea\|12v1\|E6ANDIZ01EK3W2_P1 | 1684 | 3391 | 475 | 81.5 | globlastp |
| LYD638_H101 | medicago\|12v1\|BE324303_P1 | 1685 | 3392 | 475 | 81.5 | globlastp |
| LYD638_H72 | arabidopsis\|10v1\|AT3G20870_P1 | 1686 | 3393 | 475 | 81.5 | globlastp |
| LYD638_H73 | lotus\|09v1\|BP048291_P1 | 1687 | 3394 | 475 | 81.5 | globlastp |
| LYD638_H74 | podocarpus\|10v1\|SRR065014S0046390_T1 | 1688 | 3395 | 475 | 80.94 | glotblastn |
| LYD638_H102 | pigeonpea\|11v1\|CCIIPG11000248_P1 | 1689 | 3396 | 475 | 80.9 | globlastp |
| LYD638_H75 | dandelion\|10v1\|DY818839_P1 | 1690 | 3397 | 475 | 80.9 | globlastp |
| LYD638_H103 | spruce\|11v1\|EX419926_P1 | 1691 | 3398 | 475 | 80.8 | globlastp |
| LYD638_H76 | spruce\|gb162\|CO487657 | 1692 | 3398 | 475 | 80.8 | globlastp |
| LYD638_H104 | brachypodium\|12v1\|BRADI3G07080T2_P1 | 1693 | 3399 | 475 | 80.5 | globlastp |
| LYD638_H77 | brachypodium\|09v1\|DV486023 | 1694 | 3399 | 475 | 80.5 | globlastp |
| LYD638_H78 | peanut\|10v1\|SRR042413S0014432_P1 | 1695 | 3400 | 475 | 80.4 | globlastp |
| LYD638_H105 | rye\|12v1\|DRR001012.1356_P1 | 1696 | 3401 | 475 | 80.1 | globlastp |
| LYD638_H79 | barley\|10v2\|BG417171 | 1697 | 3402 | 475 | 80.1 | globlastp |
| LYD638_H80 | wheat\|10v2\|BE213609 | 1698 | 3403 | 475 | 80.1 | globlastp |
| LYD639_H1 | soybean\|11v1\|GLYMA19G11770 | 1699 | 3404 | 476 | 88.6 | globlastp |
| LYD639_H3 | pigeonpea\|11v1\|SRR054580X152862_P1 | 1700 | 3405 | 476 | 81.8 | globlastp |
| LYD639_H2 | cowpea\|12v1\|FF389274_T1 | 1701 | 3406 | 476 | 81.38 | glotblastn |
| LYD639_H2 | cowpea\|gb166\|FF389274 | 1702 | 3407 | 476 | 80.87 | glotblastn |
| LYD640_H1 | soybean\|11v1\|GLYMA02G37400 | 1703 | 3408 | 477 | 93.4 | globlastp |
| LYD640_H4 | pigeonpea\|11v1\|SRR054580X16367_P1 | 1704 | 3409 | 477 | 87.1 | globlastp |
| LYD640_H2 | cowpea\|12v1\|VIRPSAS_T1 | 1705 | 3410 | 477 | 87.07 | glotblastn |
| LYD640_H2 | cowpea\|gb166\|VIRPSAS | 1706 | 3410 | 477 | 87.07 | glotblastn |
| LYD640_H5 | bean\|12v1\|SRR001334.200990_P1 | 1707 | 3411 | 477 | 86.8 | globlastp |
| LYD640_H3 | bean\|gb167\|CV535087 | 1708 | 3412 | 477 | 86.34 | glotblastn |
| LYD642_H9 | pigeonpea\|11v1\|EE604557_P1 | 1709 | 3413 | 479 | 91.1 | globlastp |
| LYD642_H1 | bean\|gb167\|FD785160 | 1710 | 3414 | 479 | 91.1 | globlastp |
| LYD642_H2 | cowpea\|12v1\|FF540232_P1 | 1711 | 3415 | 479 | 91.1 | globlastp |
| LYD642_H2 | cowpea\|gb166\|FF540232 | 1712 | 3415 | 479 | 91.1 | globlastp |
| LYD642_H3 | pigeonpea\|10v1\|EE604557 | 1713 | 3413 | 479 | 91.1 | globlastp |
| LYD642_H4 | soybean\|11v1\|GLYMA09G04350 | 1714 | 3416 | 479 | 90.3 | globlastp |
| LYD642_H10 | bean\|12v1\|SRR001335.120177_P1 | 1715 | 3417 | 479 | 90 | globlastp |
| LYD642_H5 | lotus\|09v1\|LLGO008153_P1 | 1716 | 3418 | 479 | 87.9 | globlastp |
| LYD642_H6 | liquorice\|gb171\|FS239800_P1 | 1717 | 3419 | 479 | 87 | globlastp |
| LYD642_H11 | medicago\|12v1\|AL377555_T1 | 1718 | 3420 | 479 | 83.52 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD642_H7 | medicago\|09v1\|AL377555 | 1719 | 3421 | 479 | 83.5 | globlastp |
| LYD642_H12 | chickpea\|11v1\|SRR133517.117851_P1 | 1720 | 3422 | 479 | 81.3 | globlastp |
| LYD642_H8 | prunus\|10v1\|CO416682 | 1721 | 3423 | 479 | 80.43 | glotblastn |
| LYD643_H1 | soybean\|11v1\|GLYMA07G06550 | 1722 | 3424 | 480 | 93.1 | globlastp |
| LYD643_H8 | pigeonpea\|11v1\|GR470036_P1 | 1723 | 3425 | 480 | 91.6 | globlastp |
| LYD643_H2 | pigeonpea\|10v1\|GR470036 | 1724 | 3425 | 480 | 91.6 | globlastp |
| LYD643_H3 | cowpea\|gb166\|FF540040 | 1725 | 3426 | 480 | 89.3 | globlastp |
| LYD643_H9 | bean\|12v1\|CB542964_P1 | 1726 | 3427 | 480 | 88.4 | globlastp |
| LYD643_H4 | bean\|gb167\|CB542736 | 1727 | 3428 | 480 | 88 | globlastp |
| LYD643_H10 | cowpea\|12v1\|FF540040_P1 | 1728 | 3429 | 480 | 87.9 | globlastp |
| LYD643_H11 | medicago\|12v1\|BG452896_P1 | 1729 | 3430 | 480 | 85.6 | globlastp |
| LYD643_H5 | medicago\|09v1\|BG452896 | 1730 | 3430 | 480 | 85.6 | globlastp |
| LYD643_H6 | lotus\|09v1\|LLGO012566_T1 | 1731 | 3431 | 480 | 85.05 | glotblastn |
| LYD643_H12 | chickpea\|11v1\|SRR133517.113264_P1 | 1732 | 3432 | 480 | 83.2 | globlastp |
| LYD643_H7 | clover\|gb162\|BB918052_P1 | 1733 | 3433 | 480 | 82.7 | globlastp |
| LYD644_H1 | soybean\|11v1\|GLYMA07G39320 | 1734 | 3434 | 481 | 98.2 | globlastp |
| LYD644_H6 | bean\|12v1\|SRR001334.118891_P1 | 1735 | 3435 | 481 | 91.4 | globlastp |
| LYD644_H2 | trigonella\|11v1\|SRR066194X104241 | 1736 | 3436 | 481 | 87.4 | globlastp |
| LYD644_H7 | medicago\|12v1\|BE204178_P1 | 1737 | 3437 | 481 | 86.6 | globlastp |
| LYD644_H8 | medicago\|12v1\|BF641611_P1 | 1738 | 3437 | 481 | 86.6 | globlastp |
| LYD644_H4 | soybean\|11v1\|GLYMA13G10490 | 1739 | 3438 | 481 | 85.7 | globlastp |
| LYD644_H5 | soybean\|11v1\|GLYMA20G16230 | 1740 | 3439 | 481 | 85.5 | globlastp |
| LYD644_H9 | pigeonpea\|11v1\|SRR054580X124197_P1 | 1741 | 3440 | 481 | 84.3 | globlastp |
| LYD644_H10 | bean\|12v1\|SRR001334.288940_P1 | 1742 | 3441 | 481 | 83.5 | globlastp |
| LYD645_H1 | soybean\|11v1\|GLYMA07G38340 | 1743 | 3442 | 482 | 92.2 | globlastp |
| LYD645_H6 | bean\|12v1\|CB542096_P1 | 1744 | 3443 | 482 | 87.4 | globlastp |
| LYD645_H2 | bean\|gb167\|CB542096 | 1745 | 3443 | 482 | 87.4 | globlastp |
| LYD645_H3 | cowpea\|12v1\|FF383417_P1 | 1746 | 3444 | 482 | 86.6 | globlastp |
| LYD645_H3 | cowpea\|gb166\|FF383417 | 1747 | 3444 | 482 | 86.6 | globlastp |
| LYD645_H7 | pigeonpea\|11v1\|SRR054580X16291_P1 | 1748 | 3445 | 482 | 86 | globlastp |
| LYD645_H4 | pigeonpea\|10v1\|SRR054580S0016292 | 1749 | 3445 | 482 | 86 | globlastp |
| LYD645_H5 | lotus\|09v1\|CB827458_P1 | 1750 | 3446 | 482 | 80.5 | globlastp |
| LYD647_H1 | soybean\|11v1\|GLYMA08G41040 | 1751 | 3447 | 484 | 83.9 | globlastp |
| LYD648_H1 | potato\|10v1\|BF153552_P1 | 1752 | 3448 | 485 | 95.4 | globlastp |
| LYD648_H2 | solanum_phureja\|09v1\|SPHAI780847 | 1753 | 3449 | 485 | 95.1 | globlastp |
| LYD648_H7 | pepper\|12v1\|GD067902_P1 | 1754 | 3450 | 485 | 92.2 | globlastp |
| LYD648_H3 | eggplant\|10v1\|FS007304_P1 | 1755 | 3451 | 485 | 91.9 | globlastp |
| LYD648_H4 | tobacco\|gb162\|EB443178 | 1756 | 3452 | 485 | 83.7 | globlastp |
| LYD648_H5 | nicotiana_benthamiana\|gb162\|CK281577_P1 | 1757 | 3453 | 485 | 82.9 | globlastp |
| LYD648_H6 | nicotiana_benthamiana\|gb162\|CK282667_P1 | 1758 | 3454 | 485 | 82.2 | globlastp |
| LYD650_H1 | solanum_phureja\|09v1\|SPHAF204783 | 1759 | 3455 | 486 | 95.5 | globlastp |
| LYD650_H2 | potato\|10v1\|CV494921_T1 | 1760 | 3456 | 486 | 93.33 | glotblastn |
| LYD650_H4 | eggplant\|10v1\|FS037047_P1 | 1761 | 3457 | 486 | 85.8 | globlastp |
| LYD650_H5 | pepper\|12v1\|BM066147_P1 | 1762 | 3458 | 486 | 84.9 | globlastp |
| LYD650_H5 | pepper\|gb171\|BM066147 | 1763 | 3458 | 486 | 84.9 | globlastp |
| LYD651_H2 | tobacco\|gb162\|AF211738 | 1764 | 3459 | 487 | 80.7 | globlastp |
| LYD653_H1 | tomato\|11v1\|BG123578 | 1765 | 3460 | 489 | 85.33 | glotblastn |
| LYD653_H2 | petunia\|gb171\|CV294459_P1 | 1766 | 3461 | 489 | 83.1 | globlastp |
| LYD653_H3 | potato\|10v1\|BQ516821_T1 | 1767 | 3462 | 489 | 81.33 | glotblastn |
| LYD653_H4 | solanum_phureja\|09v1\|SPHBG123578 | 1768 | 3463 | 489 | 81.33 | glotblastn |
| LYD654_H1 | solanum_phureja\|09v1\|SPHAI782247 | 1769 | 3464 | 490 | 98 | globlastp |
| LYD654_H2 | pepper\|12v1\|BM063093_P1 | 1770 | 3465 | 490 | 95 | globlastp |
| LYD655_H1 | solanum_phureja\|09v1\|SPHAI896168 | 1771 | 3466 | 491 | 95.6 | globlastp |
| LYD655_H2 | pepper\|12v1\|CO909199_P1 | 1772 | 3467 | 491 | 88.4 | globlastp |
| LYD655_H2 | pepper\|gb171\|CO909199 | 1773 | 3467 | 491 | 88.4 | globlastp |
| LYD655_H3 | potato\|10v1\|BF460284_P1 | 1774 | 3468 | 491 | 85.9 | globlastp |
| LYD655_H4 | tobacco\|gb162\|CV019561 | 1775 | 3469 | 491 | 85.58 | glotblastn |
| LYD655_H5 | petunia\|gb171\|CV295783_P1 | 1776 | 3470 | 491 | 81.3 | globlastp |
| LYD657_H1 | solanum_phureja\|09v1\|SPHAW030194 | 1777 | 3471 | 492 | 96.9 | globlastp |
| LYD658_H1 | solanum_phureja\|09v1\|SPHAW094631 | 1778 | 3472 | 493 | 94.6 | globlastp |
| LYD658_H2 | potato\|10v1\|BF187607_P1 | 1779 | 3473 | 493 | 81.7 | globlastp |
| LYD658_H3 | nicotiana_benthamiana\|gb162\|CK280675_T1 | 1780 | 3474 | 493 | 80.46 | glotblastn |
| LYD658_H4 | nicotiana_benthamiana\|gb162\|CK288269_P1 | 1781 | 3475 | 493 | 80.2 | globlastp |
| LYD659_H1 | solanum_phureja\|09v1\|SPHAW217526 | 1782 | 3476 | 494 | 97 | globlastp |
| LYD659_H2 | amsonia\|11v1\|SRR098688X140968_T1 | 1783 | 3477 | 494 | 80.71 | glotblastn |
| LYD660_H1 | solanum_phureja\|09v1\|SPHAW616260 | 1784 | 3478 | 495 | 97.4 | globlastp |
| LYD661_H1 | solanum_phureja\|09v1\|SPHAW616620 | 1785 | 3479 | 496 | 98.3 | globlastp |
| LYD661_H2 | cacao\|10v1\|CU538010_P1 | 1786 | 3480 | 496 | 82 | globlastp |
| LYD661_H3 | cassava\|09v1\|DB937952_P1 | 1787 | 3481 | 496 | 81.9 | globlastp |
| LYD661_H4 | poplar\|10v1\|BI069117_P1 | 1788 | 3482 | 496 | 81.3 | globlastp |
| LYD661_H5 | eucalyptus\|11v2\|ES591203_P1 | 1789 | 3483 | 496 | 81 | globlastp |
| LYD661_H6 | grape\|11v1\|GSVIVT01033168001_P1 | 1790 | 3484 | 496 | 80.9 | globlastp |
| LYD661_H10 | cotton\|11v1\|DW488153_P1 | 1791 | 3485 | 496 | 80.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD661_H11 | gossypium_raimondii\|12v1\|DR454811_P1 | 1792 | 3486 | 496 | 80.7 | globlastp |
| LYD661_H7 | castorbean\|11v1\|XM_002515320_P1 | 1793 | 3487 | 496 | 80.7 | globlastp |
| LYD661_H8 | cotton\|10v2\|DR454811 | 1794 | 3488 | 496 | 80.6 | globlastp |
| LYD661_H12 | cotton\|11v1\|AI727236_T1 | 1795 | 3489 | 496 | 80.43 | globlastn |
| LYD661_H13 | cotton\|11v1\|BE054582_T1 | 1796 | 3490 | 496 | 80.43 | globlastn |
| LYD661_H14 | cotton\|11v1\|DR454811_P1 | 1797 | 3491 | 496 | 80.4 | globlastp |
| LYD661_H15 | gossypium_raimondii\|12v1\|AI727236_P1 | 1798 | 3492 | 496 | 80.4 | globlastp |
| LYD661_H9 | cotton\|10v2\|AI727236 | 1799 | 3493 | 496 | 80.3 | globlastp |
| LYD662_H1 | solanum_phureja\|09v1\|SPHAW618546 | 1800 | 3494 | 497 | 96.5 | globlastp |
| LYD662_H2 | eggplant\|10v1\|FS033651_P1 | 1801 | 3495 | 497 | 89 | globlastp |
| LYD663_H1 | solanum_phureja\|09v1\|SPHAY376851 | 1802 | 3496 | 498 | 90.5 | globlastp |
| LYD663_H2 | potato\|10v1\|CV502621_T1 | 1803 | 3497 | 498 | 88.51 | globlastn |
| LYD664_H1 | solanum_phureja\|09v1\|SPHBE460507 | 1804 | 3498 | 499 | 90 | globlastp |
| LYD666_H2 | pepper\|12v2\|BM061649_P1 | 1805 | 3499 | 501 | 91.6 | globlastp |
| LYD666_H3 | pepper\|gb171\|BM061649 | 1806 | 3499 | 501 | 91.6 | globlastp |
| LYD666_H4 | tobacco\|gb162\|AY639146 | 1807 | 3500 | 501 | 87.5 | globlastp |
| LYD667_H1 | solanum_phureja\|09v1\|SPHBG123287 | 1808 | 3501 | 502 | 98.2 | globlastp |
| LYD667_H2 | pepper\|12v1\|CA522829_P1 | 1809 | 3502 | 502 | 86.6 | globlastp |
| LYD667_H2 | pepper\|gb171\|CA522829 | 1810 | 3502 | 502 | 86.6 | globlastp |
| LYD667_H3 | potato\|10v1\|BG350145_P1 | 1811 | 3503 | 502 | 85.7 | globlastp |
| LYD667_H4 | solanum_phureja\|09v1\|SPHBG126102 | 1812 | 3503 | 502 | 85.7 | globlastp |
| LYD667_H5 | tomato\|11v1\|BG126102 | 1813 | 3504 | 502 | 85.7 | globlastp |
| LYD669_H1 | solanum_phureja\|09v1\|SPHBG127852 | 1814 | 3505 | 504 | 99.1 | globlastp |
| LYD669_H2 | pepper\|12v1\|BM063343_P1 | 1815 | 3506 | 504 | 96.2 | globlastp |
| LYD669_H3 | catharanthus\|11v1\|EG555968_P1 | 1816 | 3507 | 504 | 86.8 | globlastp |
| LYD669_H4 | vinca\|11v1\|SRR098690X137330 | 1817 | 3508 | 504 | 86.55 | globlastn |
| LYD669_H5 | tabernaemontana\|11v1\|SRR098689X113952 | 1818 | 3509 | 504 | 86.5 | globlastp |
| LYD669_H6 | amsonia\|11v1\|SRR098688X123659_P1 | 1819 | 3510 | 504 | 86.1 | globlastp |
| LYD669_H7 | vinca\|11v1\|SRR098690X130330 | 1820 | 3511 | 504 | 85.23 | globlastn |
| LYD669_H8 | valeriana\|11v1\|SRR099039X100383 | 1821 | 3512 | 504 | 85 | globlastp |
| LYD669_H9 | kiwi\|gb166\|FG397105_P1 | 1822 | 3513 | 504 | 84.1 | globlastp |
| LYD669_H10 | potato\|10v1\|BF459943_P1 | 1823 | 3514 | 504 | 84.1 | globlastp |
| LYD669_H33 | beech\|11v1\|SRR006293.14617_T1 | 1824 | 3515 | 504 | 83.18 | globlastn |
| LYD669_H11 | chestnut\|gb170\|SRR006295S0021602_P1 | 1825 | 3516 | 504 | 83 | globlastp |
| LYD669_H12 | citrus\|gb166\|BE205717 | 1826 | 3517 | 504 | 83 | globlastp |
| LYD669_H13 | clementine\|11v1\|BE205717_P1 | 1827 | 3518 | 504 | 83 | globlastp |
| LYD669_H14 | orange\|11v1\|BE205717_P1 | 1828 | 3519 | 504 | 82.7 | globlastp |
| LYD669_H15 | watermelon\|11v1\|VMEL00070338543255 | 1829 | 3520 | 504 | 82.1 | globlastp |
| LYD669_H34 | beech\|11v1\|FR603623_T1 | 1830 | 3521 | 504 | 81.84 | globlastn |
| LYD669_H16 | oak\|10v1\|DN950840_P1 | 1831 | 3522 | 504 | 81.8 | globlastp |
| LYD669_H17 | phyla\|11v2\|SRR099035X111901_P1 | 1832 | 3523 | 504 | 81.8 | globlastp |
| LYD669_H35 | gossypium_raimondii\|12v1\|CA993556_P1 | 1833 | 3524 | 504 | 81.4 | globlastp |
| LYD669_H18 | apple\|11v1\|CN578861_P1 | 1834 | 3525 | 504 | 81.4 | globlastp |
| LYD669_H36 | gossypium_raimondii\|12v1\|DR452577_P1 | 1835 | 3526 | 504 | 81.2 | globlastp |
| LYD669_H19 | cotton\|10v2\|CO116252 | 1836 | 3527 | 504 | 81.2 | globlastp |
| LYD669_H20 | prunus\|10v1\|BU047497 | 1837 | 3528 | 504 | 81.2 | globlastp |
| LYD669_H21 | strawberry\|11v1\|CO380648 | 1838 | 3529 | 504 | 81.2 | globlastp |
| LYD669_H37 | lettuce\|12v1\|LS12v1CRP084179_P1 | 1839 | 3530 | 504 | 81 | globlastp |
| LYD669_H38 | cotton\|11v1\|CA993556_P1 | 1840 | 3531 | 504 | 80.9 | globlastp |
| LYD669_H22 | cacao\|10v1\|CU483136_P1 | 1841 | 3532 | 504 | 80.9 | globlastp |
| LYD669_H23 | cucumber\|09v1\|BGI454G0169927_P1 | 1842 | 3533 | 504 | 80.9 | globlastp |
| LYD669_H24 | poplar\|10v1\|BU879857_P1 | 1843 | 3534 | 504 | 80.9 | globlastp |
| LYD669_H39 | cotton\|11v1\|DR452577XX1_T1 | 1844 | 3535 | 504 | 80.72 | globlastn |
| LYD669_H25 | cotton\|10v2\|CA993556 | 1845 | 3536 | 504 | 80.7 | globlastp |
| LYD669_H26 | euonymus\|11v1\|SRR070038X104702_P1 | 1846 | 3537 | 504 | 80.7 | globlastp |
| LYD669_H27 | melon\|10v1\|VMEL00070338543255_P1 | 1847 | 3538 | 504 | 80.7 | globlastp |
| LYD669_H28 | aristolochia\|10v1\|FD752757_P1 | 1848 | 3539 | 504 | 80.5 | globlastp |
| LYD669_H29 | euonymus\|11v1\|SRR070038X151093_P1 | 1849 | 3540 | 504 | 80.5 | globlastp |
| LYD669_H30 | tripterygium\|11v1\|SRR098677X123156 | 1850 | 3541 | 504 | 80.5 | globlastp |
| LYD669_H31 | poplar\|10v1\|BU820108_P1 | 1851 | 3542 | 504 | 80.3 | globlastp |
| LYD669_H32 | apple\|11v1\|CN496454_P1 | 1852 | 3543 | 504 | 80 | globlastp |
| LYD670_H1 | solanum_phureja\|09v1\|SPHBG126384 | 1853 | 3544 | 505 | 93.7 | globlastp |
| LYD670_H2 | potato\|10v1\|BE922534_T1 | 1854 | 3545 | 505 | 90.66 | globlastn |
| LYD672_H1 | solanum_phureja\|09v1\|SPHBG134039 | 1855 | 3546 | 507 | 95.3 | globlastp |
| LYD672_H2 | pepper\|12v1\|CA519411_P1 | 1856 | 3547 | 507 | 88.3 | globlastp |
| LYD672_H2 | pepper\|gb171\|CA519411 | 1857 | 3547 | 507 | 88.3 | globlastp |
| LYD672_H3 | tobacco\|gb162\|DW004996 | 1858 | 3548 | 507 | 82.57 | globlastn |
| LYD674_H1 | potato\|10v1\|BE921584_P1 | 1859 | 3549 | 509 | 93 | globlastp |
| LYD674_H2 | solanum_phureja\|09v1\|SPHBG133722 | 1860 | 3550 | 509 | 93 | globlastp |
| LYD674_H3 | eggplant\|10v1\|FS004197_P1 | 1861 | 3551 | 509 | 87.3 | globlastp |
| LYD674_H4 | nicotiana_benthamiana\|gb162\|CK293409_P1 | 1862 | 3552 | 509 | 81.8 | globlastp |
| LYD677_H1 | solanum_phureja\|09v1\|SPHBG592613 | 1863 | 3553 | 512 | 96 | globlastp |
| LYD678_H1 | potato\|10v1\|BG598437_P1 | 1864 | 3554 | 513 | 97.5 | globlastp |

TABLE 54-continued

Homologous polynucleotides and polypeptides which can increase plant yield, seed yield, oil yield,
oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD678_H2 | solanum_phureja|09v1|SPHBG626546 | 1865 | 3555 | 513 | 96.8 | globlastp |
| LYD680_H2 | tabernaemontana|11v1|SRR098689X116012 | 1866 | 3556 | 515 | 80.77 | glotblastn |
| LYD681_H1 | solanum_phureja|09v1|SPHBG630045 | 1867 | 3557 | 516 | 98.6 | globlastp |
| LYD681_H2 | potato|10v1|BF053994_P1 | 1868 | 3558 | 516 | 98.4 | globlastp |
| LYD681_H3 | amsonia|11v1|SRR098688X101055_P1 | 1869 | 3559 | 516 | 89.7 | globlastp |
| LYD681_H4 | catharanthus|11v1|SRR098691X104148_P1 | 1870 | 3560 | 516 | 89.7 | globlastp |
| LYD681_H5 | tabernaemontana|11v1|SRR098689X106474 | 1871 | 3561 | 516 | 89.1 | globlastp |
| LYD681_H6 | vinca|11v1|SRR098690X10387 | 1872 | 3562 | 516 | 87.7 | globlastp |
| LYD681_H7 | phyla|11v2|SRR099035X141015_T1 | 1873 | 3563 | 516 | 87.3 | glotblastn |
| LYD681_H8 | orobanche|10v1|SRR023189S0004460_P1 | 1874 | 3564 | 516 | 86.3 | globlastp |
| LYD681_H9 | monkeyflower|10v1|DV211803_P1 | 1875 | 3565 | 516 | 85.7 | globlastp |
| LYD681_H10 | arnica|11v1|SRR099034X102089_P1 | 1876 | 3566 | 516 | 85.5 | globlastp |
| LYD681_H58 | sunflower|12v1|DY921230_P1 | 1877 | 3567 | 516 | 85.1 | globlastp |
| LYD681_H11 | arabidopsis_lyrata|09v1|JGIAL027489_P1 | 1878 | 3568 | 516 | 85.1 | globlastp |
| LYD681_H12 | sunflower|10v1|DY921230 | 1879 | 3567 | 516 | 85.1 | globlastp |
| LYD681_H13 | arabidopsis_lyrata|09v1|JGIAL005462_P1 | 1880 | 3569 | 516 | 84.9 | globlastp |
| LYD681_H14 | arabidopsis|10v1|AT1G64190_P1 | 1881 | 3570 | 516 | 84.9 | globlastp |
| LYD681_H15 | thellungiella_halophilum|11v1|BY804243 | 1882 | 3571 | 516 | 84.9 | globlastp |
| LYD681_H16 | canola|11v1|EE413371_T1 | 1883 | 3572 | 516 | 84.88 | glotblastn |
| LYD681_H17 | canola|11v1|EE415072_T1 | 1884 | 3573 | 516 | 84.88 | glotblastn |
| LYD681_H59 | b_rapa|11v1|BG543930_P1 | 1885 | 3574 | 516 | 84.7 | globlastp |
| LYD681_H60 | b_rapa|11v1|CV433796_P1 | 1886 | 3575 | 516 | 84.7 | globlastp |
| LYD681_H18 | b_rapa|gb162|CV433796 | 1887 | 3575 | 516 | 84.7 | globlastp |
| LYD681_H19 | canola|11v1|EE417941_P1 | 1888 | 3575 | 516 | 84.7 | globlastp |
| LYD681_H20 | canola|11v1|ES911843_P1 | 1889 | 3575 | 516 | 84.7 | globlastp |
| LYD681_H61 | b_rapa|11v1|CD814820_T1 | 1890 | 3576 | 516 | 84.68 | glotblastn |
| LYD681_H21 | arabidopsis|10v1|AT5G41670_P1 | 1891 | 3577 | 516 | 84.5 | globlastp |
| LYD681_H22 | lettuce|10v1|DW169046 | 1892 | 3578 | 516 | 84.5 | globlastp |
| LYD681_H23 | ambrosia|11v1|SRR346935.204066_T1 | 1893 | 3579 | 516 | 84.48 | glotblastn |
| LYD681_H24 | ambrosia|11v1|SRR346935.404337_T1 | 1894 | 3580 | 516 | 84.48 | glotblastn |
| LYD681_H22 | lettuce|12v1|DW166137_P1 | 1895 | 3581 | 516 | 84.1 | globlastp |
| LYD681_H25 | cirsium|11v1|SRR346952.13802_T1 | 1896 | 3582 | 516 | 84.07 | glotblastn |
| LYD681_H26 | vinca|11v1|SRR098690X113839 | 1897 | 3583 | 516 | 84.07 | glotblastn |
| LYD681_H62 | nasturtium|11v1|SRR032558.171608_P1 | 1898 | 3584 | 516 | 83.5 | globlastp |
| LYD681_H27 | cacao|10v1|CU508968_P1 | 1899 | 3585 | 516 | 83.1 | globlastp |
| LYD681_H28 | citrus|gb166|CN190890 | 1900 | 3586 | 516 | 83.06 | glotblastn |
| LYD681_H29 | ambrosia|11v1|SRR346935.402152_T1 | 1901 | 3587 | 516 | 82.9 | glotblastn |
| LYD681_H30 | cucumber|09v1|EB716020_P1 | 1902 | 3588 | 516 | 82.9 | globlastp |
| LYD681_H31 | cynara|gb167|GE577931_T1 | 1903 | 3589 | 516 | 82.86 | glotblastn |
| LYD681_H63 | pigeonpea|11v1|GW359493_P1 | 1904 | 3590 | 516 | 82.8 | globlastp |
| LYD681_H32 | castorbean|11v1|GE634479_P1 | 1905 | 3591 | 516 | 82.7 | globlastp |
| LYD681_H33 | soybean|11v1|GLYMA08G02410 | 1906 | 3592 | 516 | 82.7 | globlastp |
| LYD681_H64 | cotton|11v1|BQ410946_P1 | 1907 | 3593 | 516 | 82.5 | globlastp |
| LYD681_H34 | castorbean|11v1|XM_002509856_P1 | 1908 | 3594 | 516 | 82.5 | globlastp |
| LYD681_H35 | euonymus|11v1|SRR070038X108968_P1 | 1909 | 3595 | 516 | 82.5 | globlastp |
| LYD681_H36 | grape|11v1|GSVIVT01019467001_P1 | 1910 | 3596 | 516 | 82.5 | globlastp |
| LYD681_H37 | tripterygium|11v1|SRR098677X111190 | 1911 | 3597 | 516 | 82.5 | globlastp |
| LYD681_H65 | gossypium_raimondii|12v1|AI730491_P1 | 1912 | 3598 | 516 | 82.3 | globlastp |
| LYD681_H38 | cotton|10v2|CO076294 | 1913 | 3599 | 516 | 82.3 | globlastp |
| LYD681_H39 | watermelon|11v1|AM715537 | 1914 | 3600 | 516 | 82.3 | globlastp |
| LYD681_H40 | strawberry|11v1|EX672776 | 1915 | 3601 | 516 | 82.2 | globlastp |
| LYD681_H41 | soybean|11v1|GLYMA05G37170 | 1916 | 3602 | 516 | 82.1 | globlastp |
| LYD681_H42 | trigonella|11v1|SRR066194X112434 | 1917 | 3603 | 516 | 82.1 | globlastp |
| LYD681_H43 | medicago|09v1|LLAL384701 | 1918 | 3604 | 516 | 82.06 | glotblastn |
| LYD681_H44 | clementine|11v1|CN190890_P1 | 1919 | 3605 | 516 | 81.9 | globlastp |
| LYD681_H45 | prunus|10v1|CN863535 | 1920 | 3606 | 516 | 81.9 | globlastp |
| LYD681_H46 | thellungiella_halophilum|11v1|EHJGI11021359 | 1921 | 3607 | 516 | 81.9 | globlastp |
| LYD681_H47 | euonymus|11v1|SRR070038X107038_P1 | 1922 | 3608 | 516 | 81.8 | globlastp |
| LYD681_H48 | platanus|11v1|SRR096786X140780_P1 | 1923 | 3609 | 516 | 81.7 | globlastp |
| LYD681_H49 | lotus|09v1|LLAV410725_P1 | 1924 | 3610 | 516 | 81.5 | globlastp |
| LYD681_H50 | oak|10v1|FP025719_P1 | 1925 | 3611 | 516 | 81.5 | globlastp |
| LYD681_H66 | beech|11v1|SRR006293.12520_P1 | 1926 | 3612 | 516 | 81.4 | globlastp |
| LYD681_H67 | chickpea|11v1|GR912701_P1 | 1927 | 3613 | 516 | 81.3 | globlastp |
| LYD681_H68 | poppy|11v1|SRR030259.136321_P1 | 1928 | 3614 | 516 | 81.3 | globlastp |
| LYD681_H51 | aquilegia|10v2|DR920343_P1 | 1929 | 3615 | 516 | 81.3 | globlastp |
| LYD681_H52 | poplar|10v1|BU829466_P1 | 1930 | 3616 | 516 | 81.3 | globlastp |
| LYD681_H69 | poppy|11v1|FE965679_P1 | 1931 | 3617 | 516 | 81.1 | globlastp |
| LYD681_H53 | chestnut|gb170|SRR006295S0044488_P1 | 1932 | 3618 | 516 | 81.1 | globlastp |
| LYD681_H70 | poppy|11v1|SRR096789.181966_T1 | 1933 | 3619 | 516 | 81.05 | glotblastn |
| LYD681_H71 | poppy|11v1|SRR030259.353240_P1 | 1934 | 3620 | 516 | 80.9 | globlastp |
| LYD681_H54 | poplar|10v1|AI165699_P1 | 1935 | 3621 | 516 | 80.8 | globlastp |
| LYD681_H55 | aristolochia|10v1|FD755163_T1 | 1936 | 3622 | 516 | 80.65 | glotblastn |
| LYD681_H72 | bean|12v1|CA900025_T1 | 1937 | 3623 | 516 | 80.52 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD681_H73 | amborella\|12v3\|SRR038635.70340_P1 | 1938 | 3624 | 516 | 80.5 | globlastp |
| LYD681_H56 | orange\|11v1\|CN190890_P1 | 1939 | 3625 | 516 | 80.5 | globlastp |
| LYD681_H57 | silene\|11v1\|SRR096785X102909 | 1940 | 3626 | 516 | 80.24 | glotblastn |
| LYD682_H1 | solanum_phureja\|09v1\|SPHBG630298 | 1941 | 3627 | 517 | 95.9 | globlastp |
| LYD684_H1 | solanum_phureja\|09v1\|SPHBG734982 | 1942 | 3628 | 519 | 96.2 | globlastp |
| LYD684_H2 | pepper\|gb171\|CA524110 | 1943 | 3629 | 519 | 85.5 | globlastp |
| LYD685_H1 | solanum_phureja\|09v1\|SPHS70186 | 1944 | 3630 | 520 | 91.05 | glotblastn |
| LYD685_H2 | potato\|10v1\|S70186_P1 | 1945 | 3631 | 520 | 89.8 | globlastp |
| LYD686_H1 | solanum_phureja\|09v1\|SPHBI405665 | 1946 | 3632 | 521 | 96.4 | globlastp |
| LYD686_H2 | solanum_phureja\|09v1\|SPHBG130034 | 1947 | 3633 | 521 | 83.1 | globlastp |
| LYD686_H3 | tomato\|11v1\|BG130034 | 1948 | 3634 | 521 | 81.1 | globlastp |
| LYD686_H4 | amsonia\|11v1\|SRR098688X125511_P1 | 1949 | 3635 | 521 | 80.2 | globlastp |
| LYD687_H1 | solanum_phureja\|09v1\|SPHSRR015435S0022465 | 1950 | 3636 | 522 | 98.5 | globlastp |
| LYD689_H1 | solanum_phureja\|09v1\|SPHBQ512926 | 1951 | 3637 | 524 | 91.9 | globlastp |
| LYD689_H2 | potato\|10v1\|BQ512926_P1 | 1952 | 3638 | 524 | 91.4 | globlastp |
| LYD689_H3 | eggplant\|10v1\|FS050105_P1 | 1953 | 3639 | 524 | 82.7 | globlastp |
| LYD689_H4 | pepper\|12v1\|GD093486_P1 | 1954 | 3640 | 524 | 81.8 | globlastp |
| LYD689_H5 | tobacco\|gb162\|EB425168 | 1955 | 3641 | 524 | 80.8 | globlastp |
| LYD690_H1 | solanum_phureja\|09v1\|SPHDN978843 | 1956 | 3642 | 525 | 81.2 | globlastp |
| LYD538_H29 | b_juncea\|12v1\|E6ANDIZ01DI5V0_P1 | 1957 | 3643 | 528 | 85.4 | globlastp |
| LYD539_H5 | arabidopsis_lyrata\|09v1\|JGIAL032238_T1 | 1958 | 3644 | 529 | 94.23 | glotblastn |
| LYD539_H12 | b_oleracea\|gb161\|EH415045_P1 | 1959 | 3645 | 529 | 87.7 | globlastp |
| LYD539_H13 | cleome_spinosa\|10v1\|GR933964_T1 | 1960 | 3646 | 529 | 82.28 | glotblastn |
| LYD540_H2 | thellungiella_parvulum\|11v1\|BM986015 | 1961 | 3647 | 530 | 84.57 | glotblastn |
| LYD540_H3 | thellungiella_halophilum\|11v1\|BY819763 | 1962 | 3648 | 530 | 81.91 | glotblastn |
| LYD540_H4 | arabidopsis_lyrata\|09v1\|JGIAL006775_T1 | 1963 | 3649 | 530 | 81.38 | glotblastn |
| LYD548_H11 | euphorbia\|11v1\|DV124286_P1 | 1964 | 3650 | 533 | 82.5 | globlastp |
| LYD548_H12 | spurge\|gb161\|DV124286 | 1965 | 3651 | 533 | 82.1 | globlastp |
| LYD548_H19 | beech\|11v1\|SRR006293.7878_T1 | 1966 | 3652 | 533 | 80 | glotblastn |
| LYD548_H13 | papaya\|gb165\|EX247662_T1 | 1967 | 3653 | 533 | 80 | glotblastn |
| LYD548_H14 | prunus\|10v1\|BU039510 | 1968 | 3654 | 533 | 80 | glotblastn |
| LYD549_H1 | b_rapa\|gb162\|BG544752 | 1969 | 3655 | 534 | 98.89 | glotblastn |
| LYD550_H1 | canola\|11v1\|EV151262_T1 | 1970 | 3656 | 535 | 97.94 | glotblastn |
| LYD550_H4 | arabidopsis\|10v1\|AT3G16290_T1 | 1971 | 3657 | 535 | 95.46 | glotblastn |
| LYD550_H6 | radish\|gb164\|EV569321 | 1972 | 3658 | 535 | 92.4 | globlastp |
| LYD550_H7 | cacao\|10v1\|CU477476_T1 | 1973 | 3659 | 535 | 88.25 | glotblastn |
| LYD550_H8 | poplar\|10v1\|CA924970_T1 | 1974 | 3660 | 535 | 87.63 | glotblastn |
| LYD550_H9 | apple\|11v1\|CN496155_T1 | 1975 | 3661 | 535 | 86.8 | glotblastn |
| LYD550_H10 | castorbean\|11v1\|EE255437_T1 | 1976 | 3662 | 535 | 86.8 | glotblastn |
| LYD550_H11 | prunus\|10v1\|BU043895 | 1977 | 3663 | 535 | 86.8 | glotblastn |
| LYD550_H47 | gossypium_raimondii\|12v1\|AI725752_T1 | 1978 | 3664 | 535 | 86.39 | glotblastn |
| LYD550_H12 | cassava\|09v1\|CK643710_T1 | 1979 | 3665 | 535 | 86.39 | glotblastn |
| LYD550_H13 | eucalyptus\|11v2\|SRR001659X130634_T1 | 1980 | 3666 | 535 | 86.39 | glotblastn |
| LYD550_H14 | vinca\|11v1\|SRR098690X123915 | 1981 | 3667 | 535 | 86.39 | glotblastn |
| LYD550_H48 | cotton\|11v1\|AI725752_T1 | 1982 | 3668 | 535 | 86.19 | glotblastn |
| LYD550_H15 | grape\|11v1\|GSVIVT01017029001_T1 | 1983 | 3669 | 535 | 86.19 | glotblastn |
| LYD550_H16 | cotton\|10v2\|SRR032367S0109017 | 1984 | 3670 | 535 | 86.01 | glotblastn |
| LYD550_H49 | pigeonpea\|11v1\|SRR054580X104890_T1 | 1985 | 3671 | 535 | 85.77 | glotblastn |
| LYD550_H17 | clementine\|11v1\|CD574164_T1 | 1986 | 3672 | 535 | 85.77 | glotblastn |
| LYD550_H18 | orange\|11v1\|CD574164_T1 | 1987 | 3673 | 535 | 85.77 | glotblastn |
| LYD550_H19 | pigeonpea\|10v1\|SRR054580S0015969 | 1988 | 3674 | 535 | 85.77 | glotblastn |
| LYD550_H20 | prunus\|10v1\|CN934625 | 1989 | 3675 | 535 | 85.77 | glotblastn |
| LYD550_H21 | tripterygium\|11v1\|SRR098677X101640 | 1990 | 3676 | 535 | 85.77 | glotblastn |
| LYD550_H22 | oak\|10v1\|FP027246_T1 | 1991 | 3677 | 535 | 85.57 | glotblastn |
| LYD550_H23 | watermelon\|11v1\|AM733953 | 1992 | 3678 | 535 | 85.36 | glotblastn |
| LYD550_H50 | sesame\|12v1\|SESI12V1405091_T1 | 1993 | 3679 | 535 | 85.15 | glotblastn |
| LYD550_H24 | strawberry\|11v1\|DV439362 | 1994 | 3680 | 535 | 85.15 | glotblastn |
| LYD550_H25 | amsonia\|11v1\|SRR098688X115480_T1 | 1995 | 3681 | 535 | 84.95 | glotblastn |
| LYD550_H26 | monkeyflower\|10v1\|DV209912_T1 | 1996 | 3682 | 535 | 84.95 | glotblastn |
| LYD550_H27 | tabernaemontana\|11v1\|SRR098689X108650 | 1997 | 3683 | 535 | 84.95 | glotblastn |
| LYD550_H28 | artemisia\|10v1\|EY090642_T1 | 1998 | 3684 | 535 | 84.74 | glotblastn |
| LYD550_H51 | bean\|12v1\|CA902012_T1 | 1999 | 3685 | 535 | 84.33 | glotblastn |
| LYD550_H29 | soybean\|11v1\|GLYMA15G02170 | 2000 | 3686 | 535 | 84.33 | glotblastn |
| LYD550_H30 | soybean\|11v1\|GLYMA13G43180 | 2001 | 3687 | 535 | 83.92 | glotblastn |
| LYD550_H31 | cotton\|10v2\|SRR032367S1095891 | 2002 | 3688 | 535 | 83.8 | globlastp |
| LYD550_H32 | solanum_phureja\|09v1\|SPHAI781891 | 2003 | 3689 | 535 | 83.78 | glotblastn |
| LYD550_H33 | flaveria\|11v1\|SRR149229.156308_T1 | 2004 | 3690 | 535 | 83.71 | glotblastn |
| LYD550_H34 | cucumber\|09v1\|AM733953_T1 | 2005 | 3691 | 535 | 83.51 | glotblastn |
| LYD550_H35 | flaveria\|11v1\|SRR149229.187611_T1 | 2006 | 3692 | 535 | 83.51 | glotblastn |
| LYD550_H36 | tomato\|11v1\|AI781891 | 2007 | 3693 | 535 | 83.16 | glotblastn |
| LYD550_H37 | melon\|10v1\|AM733953_T1 | 2008 | 3694 | 535 | 82.79 | glotblastn |
| LYD550_H52 | beech\|11v1\|SRR006293.13266_P1 | 2009 | 3695 | 535 | 82.7 | globlastp |
| LYD550_H38 | sunflower\|10v1\|DY912854 | 2010 | 3696 | 535 | 82.68 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD550_H53 | oil_palm\|11v1\|EL930445_T1 | 2011 | 3697 | 535 | 82.47 | glotblastn |
| LYD550_H39 | ambrosia\|11v1\|SRR346935.130719_T1 | 2012 | 3698 | 535 | 82.47 | glotblastn |
| LYD550_H54 | banana\|12v1\|MAGEN2012034046_T1 | 2013 | 3699 | 535 | 82.27 | glotblastn |
| LYD550_H40 | ambrosia\|11v1\|SRR346935.123018_T1 | 2014 | 3700 | 535 | 82.27 | glotblastn |
| LYD550_H41 | silene\|11v1\|SRR096785X132229 | 2015 | 3701 | 535 | 81.44 | glotblastn |
| LYD550_H42 | aristolochia\|10v1\|FD762492_T1 | 2016 | 3702 | 535 | 81.03 | glotblastn |
| LYD550_H43 | cirsium\|11v1\|SRR346952.1061150_P1 | 2017 | 3703 | 535 | 81 | globlastp |
| LYD550_H44 | aquilegia\|10v2\|DR915316_T1 | 2018 | 3704 | 535 | 80.82 | glotblastn |
| LYD550_H55 | poppy\|11v1\|SRR030259.168193_T1 | 2019 | 3705 | 535 | 80.41 | glotblastn |
| LYD550_H45 | cirsium\|11v1\|SRR346952.1049224_T1 | 2020 | 3706 | 535 | 80.41 | glotblastn |
| LYD553_H3 | canola\|11v1\|SRR341920.517375_T1 | 2021 | 3707 | 536 | 92.8 | glotblastn |
| LYD553_H6 | canola\|11v1\|EE475615_P1 | 2022 | 3708 | 536 | 90.5 | globlastp |
| LYD584_H1 | trigonella\|11v1\|SRR066194X103417 | 2023 | 3709 | 537 | 92.46 | glotblastn |
| LYD584_H2 | soybean\|11v1\|GLYMA08G44490 | 2024 | 3710 | 537 | 81.26 | glotblastn |
| LYD584_H3 | pigeonpea\|11v1\|SRR054580X106211_T1 | 2025 | 3711 | 537 | 80.67 | glotblastn |
| LYD592_H1 | medicago\|09v1\|CRPMT037344 | 2026 | 3712 | 539 | 94.1 | globlastp |
| LYD619_H1 | soybean\|11v1\|GLYMA06G16290 | 2027 | 3713 | 540 | 80.6 | globlastp |
| LYD633_H1 | soybean\|11v1\|GLYMA11G10300 | 2028 | 3714 | 543 | 89 | globlastp |
| LYD633_H2 | bean\|12v1\|SRR001334.148755_P1 | 2029 | 3715 | 543 | 86 | globlastp |
| LYD633_H3 | pigeonpea\|11v1\|SRR054580X352353_P1 | 2030 | 3716 | 543 | 83.8 | globlastp |
| LYD537_H2 | radish\|gb164\|EV525517 | 2031 | 3717 | 550 | 98 | globlastp |
| LYD537_H5 | thellungiella_parvulum\|11v1\|DN774047 | 2032 | 3718 | 550 | 93.1 | globlastp |
| LYD537_H8 | arabidopsis\|10v1\|AT2G04039_P1 | 2033 | 3719 | 550 | 86.6 | globlastp |
| LYD548_H20 | pigeonpea\|11v1\|SRR054580X121566_P1 | 2034 | 3720 | 553 | 80.7 | globlastp |
| LYD549_H6 | b_rapa\|11v1\|BG544752_P1 | 2035 | 3721 | 554 | 99.1 | globlastp |
| LYD553_H9 | b_rapa\|11v1\|BQ704191_P1 | 2036 | 556 | 556 | 100 | globlastp |
| LYD553_H1 | b_rapa\|gb162\|EX029238 | 2037 | 3722 | 556 | 98.9 | glotblastn |
| LYD553_H2 | radish\|gb164\|EW723928 | 2038 | 3723 | 556 | 97.8 | globlastp |
| LYD553_H4 | thellungiella_parvulum\|11v1\|EPCRP010138 | 2039 | 3724 | 556 | 95.3 | globlastp |
| LYD553_H10 | b_rapa\|11v1\|E6ANDIZ01AZWQB_P1 | 2040 | 3725 | 556 | 93.1 | globlastp |
| LYD553_H7 | arabidopsis_lyrata\|09v1\|JGIAL010738_P1 | 2041 | 3726 | 556 | 92.3 | globlastp |
| LYD553_H8 | arabidopsis\|10v1\|AT3G21420_P1 | 2042 | 3727 | 556 | 92.3 | globlastp |
| LYD554_H4 | gossypium_raimondii\|12v1\|CO087573_P1 | 2043 | 3728 | 557 | 99.6 | globlastp |
| LYD554_H1 | cacao\|10v1\|CU507663_P1 | 2044 | 3729 | 557 | 88.3 | globlastp |
| LYD554_H2 | pteridium\|11v1\|SRR043594X132113 | 2045 | 3730 | 557 | 85.48 | glotblastn |
| LYD559_H1 | trigonella\|11v1\|SRR066194X140992 | 2046 | 3731 | 559 | 97.4 | globlastp |
| LYD559_H29 | chickpea\|11v1\|SRR133517.115958_P1 | 2047 | 3732 | 559 | 87.7 | globlastp |
| LYD559_H3 | soybean\|11v1\|GLYMA06G42080 | 2048 | 3733 | 559 | 84.2 | globlastp |
| LYD559_H30 | bean\|12v1\|CA896695_P1 | 2049 | 3734 | 559 | 82.8 | globlastp |
| LYD559_H7 | cacao\|10v1\|CA794256_P1 | 2050 | 3735 | 559 | 82.5 | globlastp |
| LYD559_H19 | kiwi\|gb166\|FG404235_T1 | 2051 | 3736 | 559 | 80.45 | glotblastn |
| LYD559_H31 | kiwi\|gb166\|FG396783_P1 | 2052 | 3737 | 559 | 80.2 | globlastp |
| LYD559_H32 | orange\|11v1\|Z82983_P1 | 2053 | 3738 | 559 | 80 | globlastp |
| LYD560_H164 | chickpea\|11v1\|FL518933_P1 | 2054 | 3739 | 560 | 93.3 | globlastp |
| LYD560_H2 | liquorice\|gb171\|FS249643_P1 | 2055 | 3740 | 560 | 93.3 | globlastp |
| LYD560_H4 | soybean\|11v1\|GLYMA13G36730 | 2056 | 3741 | 560 | 87.5 | globlastp |
| LYD560_H5 | trigonella\|11v1\|SRR066194X108453 | 2057 | 3742 | 560 | 87.4 | globlastp |
| LYD560_H165 | chickpea\|11v1\|GR395239_P1 | 2058 | 3743 | 560 | 87.2 | globlastp |
| LYD560_H6 | cowpea\|12v1\|FC458592_P1 | 2059 | 3744 | 560 | 87.2 | globlastp |
| LYD560_H6 | cowpea\|gb166\|CK151399 | 2060 | 3744 | 560 | 87.2 | globlastp |
| LYD560_H7 | soybean\|11v1\|GLYMA12G33760 | 2061 | 3745 | 560 | 87.2 | globlastp |
| LYD560_H166 | bean\|12v1\|CA896625_P1 | 2062 | 3746 | 560 | 86.3 | globlastp |
| LYD560_H8 | apple\|11v1\|CN491810_P1 | 2063 | 3747 | 560 | 86.2 | globlastp |
| LYD560_H9 | bean\|gb167\|CA896625 | 2064 | 3748 | 560 | 86.13 | glotblastn |
| LYD560_H11 | peanut\|10v1\|CD037768_P1 | 2065 | 3749 | 560 | 86.1 | globlastp |
| LYD560_H167 | pigeonpea\|11v1\|SRR054580X101487_P1 | 2066 | 3750 | 560 | 86 | globlastp |
| LYD560_H10 | humulus\|11v1\|CD527124_P1 | 2067 | 3751 | 560 | 86 | globlastp |
| LYD560_H168 | beech\|11v1\|DT317640_P1 | 2068 | 3752 | 560 | 85.9 | globlastp |
| LYD560_H12 | cannabis\|12v1\|GR220771_P1 | 2069 | 3753 | 560 | 85.9 | globlastp |
| LYD560_H13 | humulus\|11v1\|SRR098683X104055_T1 | 2070 | 3754 | 560 | 85.67 | glotblastn |
| LYD560_H169 | rose\|12v1\|BQ105339_P1 | 2071 | 3755 | 560 | 85.6 | globlastp |
| LYD560_H14 | grape\|11v1\|GSVIVT01020689001_P1 | 2072 | 3756 | 560 | 85.6 | globlastp |
| LYD560_H170 | cowpea\|12v1\|FC461925_P1 | 2073 | 3757 | 560 | 85.4 | globlastp |
| LYD560_H171 | sesame\|12v1\|JK065449_P1 | 2074 | 3758 | 560 | 85.4 | globlastp |
| LYD560_H16 | soybean\|11v1\|GLYMA12G14420 | 2075 | 3759 | 560 | 85.4 | globlastp |
| LYD560_H17 | prunus\|10v1\|BU039550 | 2076 | 3760 | 560 | 85.4 | globlastp |
| LYD560_H172 | bean\|12v1\|CB539455_P1 | 2077 | 3761 | 560 | 85.3 | globlastp |
| LYD560_H18 | platanus\|11v1\|AM260502_P1 | 2078 | 3762 | 560 | 85.3 | globlastp |
| LYD560_H19 | triphysaria\|10v1\|BE574775 | 2079 | 3763 | 560 | 85.2 | globlastp |
| LYD560_H20 | catharanthus\|11v1\|HM006896_P1 | 2080 | 3764 | 560 | 85.1 | globlastp |
| LYD560_H22 | eucalyptus\|11v2\|CD669407_P1 | 2081 | 3765 | 560 | 85 | globlastp |
| LYD560_H21 | amsonia\|11v1\|SRR098688X10135_P1 | 2082 | 3766 | 560 | 84.9 | globlastp |
| LYD560_H25 | flaveria\|11v1\|SRR149229.116025_T1 | 2083 | 3767 | 560 | 84.66 | glotblastn |

TABLE 54-continued

Homologous polynucleotides and polypeptides which can increase plant yield, seed yield, oil yield,
oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD560_H23 | cichorium\|gb171\|DT211113_P1 | 2084 | 3768 | 560 | 84.6 | globlastp |
| LYD560_H24 | poplar\|10v1\|BI068438_P1 | 2085 | 3769 | 560 | 84.6 | globlastp |
| LYD560_H26 | watermelon\|11v1\|AI563215 | 2086 | 3770 | 560 | 84.4 | globlastp |
| LYD560_H27 | triphysaria\|10v1\|BM356564 | 2087 | 3771 | 560 | 84.4 | globlastp |
| LYD560_H173 | b_juncea\|12v1\|E6ANDIZ01A2814_P1 | 2088 | 3772 | 560 | 84.3 | globlastp |
| LYD560_H30 | platanus\|11v1\|SRR096786X109671_P1 | 2089 | 3773 | 560 | 84.3 | globlastp |
| LYD560_H174 | sunflower\|12v1\|DY904533_P1 | 2090 | 3774 | 560 | 84.2 | globlastp |
| LYD560_H28 | euphorbia\|11v1\|BI946379_P1 | 2091 | 3775 | 560 | 84.2 | globlastp |
| LYD560_H32 | sunflower\|10v1\|DY905884 | 2092 | 3774 | 560 | 84.2 | globlastp |
| LYD560_H146 | lettuce\|12v1\|DW056546_P1 | 2093 | 3776 | 560 | 84.2 | globlastp |
| LYD560_H31 | monkeyflower\|10v1\|DV206354_P1 | 2094 | 3777 | 560 | 84.1 | globlastp |
| LYD560_H33 | oak\|10v1\|CN725669_P1 | 2095 | 3778 | 560 | 84.1 | globlastp |
| LYD560_H35 | melon\|10v1\|DV632098_P1 | 2096 | 3779 | 560 | 84 | globlastp |
| LYD560_H36 | sunflower\|10v1\|DY904533 | 2097 | 3780 | 560 | 84 | globlastp |
| LYD560_H39 | radish\|gb164\|EV525375 | 2098 | 3781 | 560 | 83.9 | globlastp |
| LYD560_H37 | chestnut\|gb170\|SRR006295S0002507_P1 | 2099 | 3782 | 560 | 83.8 | globlastp |
| LYD560_H40 | arnica\|11v1\|SRR099034X101317_P1 | 2100 | 3783 | 560 | 83.8 | globlastp |
| LYD560_H41 | flaveria\|11v1\|SRR149229.17385_P1 | 2101 | 3784 | 560 | 83.8 | globlastp |
| LYD560_H42 | tabernaemontana\|11v1\|SRR098689X103361 | 2102 | 3785 | 560 | 83.8 | globlastp |
| LYD560_H44 | aquilegia\|10v2\|DR912607_P1 | 2103 | 3786 | 560 | 83.7 | globlastp |
| LYD560_H45 | vinca\|11v1\|SRR098690X101887 | 2104 | 3787 | 560 | 83.6 | globlastp |
| LYD560_H46 | canola\|11v1\|CN831246_P1 | 2105 | 3788 | 560 | 83.6 | globlastp |
| LYD560_H49 | poplar\|10v1\|CA923778_P1 | 2106 | 3789 | 560 | 83.6 | globlastp |
| LYD560_H47 | chelidonium\|11v1\|SRR084752X101401_P1 | 2107 | 3790 | 560 | 83.5 | globlastp |
| LYD560_H50 | potato\|10v1\|BF153344_P1 | 2108 | 3791 | 560 | 83.5 | globlastp |
| LYD560_H51 | cleome_gynandra\|10v1\|SRR015532S0001111_T1 | 2109 | 3792 | 560 | 83.5 | globlastp |
| LYD560_H52 | ambrosia\|11v1\|SRR346935.128656_T1 | 2110 | 3793 | 560 | 83.48 | glotblastn |
| LYD560_H53 | ambrosia\|11v1\|SRR346943.17478_T1 | 2111 | 3794 | 560 | 83.48 | glotblastn |
| LYD560_H55 | flaveria\|11v1\|SRR149232.78867_T1 | 2112 | 3795 | 560 | 83.45 | glotblastn |
| LYD560_H175 | gossypium_raimondii\|12v1\|AI728816_P1 | 2113 | 3796 | 560 | 83.4 | globlastp |
| LYD560_H54 | castorbean\|11v1\|EG661185_P1 | 2114 | 3797 | 560 | 83.4 | globlastp |
| LYD560_H56 | arabidopsis\|10v1\|AT3G58610_P1 | 2115 | 3798 | 560 | 83.4 | globlastp |
| LYD560_H57 | canola\|11v1\|CN829948_P1 | 2116 | 3799 | 560 | 83.4 | globlastp |
| LYD560_H59 | cucumber\|09v1\|AI563215_P1 | 2117 | 3800 | 560 | 83.4 | globlastp |
| LYD560_H60 | plantago\|11v1\|SRR066373X112712 | 2118 | 3801 | 560 | 83.4 | globlastp |
| LYD560_H61 | potato\|10v1\|BF153566_P1 | 2119 | 3802 | 560 | 83.4 | globlastp |
| LYD560_H62 | switchgrass\|gb167\|FE598038 | 2120 | 3803 | 560 | 83.4 | globlastp |
| LYD560_H66 | foxtail_millet\|11v3\|PHY7SI021528M_P1 | 2121 | 3804 | 560 | 83.3 | globlastp |
| LYD560_H67 | switchgrass\|gb167\|DN146770 | 2122 | 3805 | 560 | 83.3 | globlastp |
| LYD560_H68 | flaveria\|11v1\|SRR149232.196243_T1 | 2123 | 3806 | 560 | 83.22 | glotblastn |
| LYD560_H176 | b_rapa\|11v1\|BG732247_P1 | 2124 | 3807 | 560 | 83.2 | globlastp |
| LYD560_H63 | cacao\|10v1\|CA796626_P1 | 2125 | 3808 | 560 | 83.2 | globlastp |
| LYD560_H64 | canola\|11v1\|CN726713_P1 | 2126 | 3809 | 560 | 83.2 | globlastp |
| LYD560_H65 | flaveria\|11v1\|SRR149229.101043_P1 | 2127 | 3810 | 560 | 83.2 | globlastp |
| LYD560_H69 | b_rapa\|gb162\|CA992458 | 2128 | 3807 | 560 | 83.2 | globlastp |
| LYD560_H72 | tragopogon\|10v1\|SRR020205S0020857 | 2129 | 3811 | 560 | 83.2 | globlastp |
| LYD560_H177 | cotton\|11v1\|AI728816_P1 | 2130 | 3812 | 560 | 83.1 | globlastp |
| LYD560_H178 | cotton\|11v1\|BE054370_P1 | 2131 | 3813 | 560 | 83.1 | globlastp |
| LYD560_H70 | canola\|11v1\|DY006367_P1 | 2132 | 3814 | 560 | 83.1 | globlastp |
| LYD560_H73 | canola\|11v1\|CX278693_T1 | 2133 | 3815 | 560 | 83.1 | glotblastn |
| LYD560_H74 | cotton\|10v2\|SRR032367S0201653 | 2134 | 3812 | 560 | 83.1 | globlastp |
| LYD560_H75 | flaveria\|11v1\|SRR149229.154246_P1 | 2135 | 3816 | 560 | 83.1 | globlastp |
| LYD560_H76 | b_rapa\|gb162\|L33635 | 2136 | 3817 | 560 | 83.05 | glotblastn |
| LYD560_H77 | switchgrass\|gb167\|DN140714 | 2137 | 3818 | 560 | 83.05 | glotblastn |
| LYD560_H179 | sunflower\|12v1\|CD852201_P1 | 2138 | 3819 | 560 | 83 | globlastp |
| LYD560_H180 | sunflower\|12v1\|CD858388_P1 | 2139 | 3820 | 560 | 83 | globlastp |
| LYD560_H78 | arabidopsis_lyrata\|09v1\|JGIAL019161_P1 | 2140 | 3821 | 560 | 83 | globlastp |
| LYD560_H79 | oil_palm\|gb166\|CN599790 | 2141 | 3822 | 560 | 83 | globlastp |
| LYD560_H80 | sunflower\|10v1\|CD852201 | 2142 | 3823 | 560 | 83 | globlastp |
| LYD560_H81 | tabernaemontana\|11v1\|SRR098689X102834 | 2143 | 3824 | 560 | 82.91 | glotblastn |
| LYD560_H82 | tabernaemontana\|11v1\|SRR098689X103761 | 2144 | 3825 | 560 | 82.91 | glotblastn |
| LYD560_H181 | b_rapa\|11v1\|L33635_P1 | 2145 | 3826 | 560 | 82.9 | globlastp |
| LYD560_H83 | aristolochia\|10v1\|FD748169_P1 | 2146 | 3827 | 560 | 82.9 | globlastp |
| LYD560_H84 | euphorbia\|11v1\|SRR098678X100620_P1 | 2147 | 3828 | 560 | 82.8 | globlastp |
| LYD560_H85 | maize\|10v1\|AI391790_P1 | 2148 | 3829 | 560 | 82.8 | globlastp |
| LYD560_H86 | wheat\|10v2\|CA605463 | 2149 | 3829 | 560 | 82.8 | globlastp |
| LYD560_H88 | aquilegia\|10v2\|DR937512_P1 | 2150 | 3830 | 560 | 82.7 | globlastp |
| LYD560_H89 | cirsium\|11v1\|SRR346952.104841_P1 | 2151 | 3831 | 560 | 82.7 | globlastp |
| LYD560_H90 | fescue\|gb161\|DT685772_P1 | 2152 | 3832 | 560 | 82.7 | globlastp |
| LYD560_H91 | peanut\|10v1\|EL966584_P1 | 2153 | 3833 | 560 | 82.7 | globlastp |
| LYD560_H97 | vinca\|11v1\|SRR098690X104754 | 2154 | 3834 | 560 | 82.7 | globlastp |
| LYD560_H87 | arnica\|11v1\|SRR099034X101454XX1_T1 | 2155 | 3835 | 560 | 82.69 | glotblastn |
| LYD560_H182 | oil_palm\|11v1\|SRR190698.12262_T1 | 2156 | 3836 | 560 | 82.68 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD560_H183 | b_rapa|11v1|BQ791335_P1 | 2157 | 3837 | 560 | 82.6 | globlastp |
| LYD560_H184 | sorghum|12v1|SB03G029720_P1 | 2158 | 3838 | 560 | 82.6 | globlastp |
| LYD560_H92 | pepper|gb171|BM063882 | 2159 | 3839 | 560 | 82.6 | globlastp |
| LYD560_H93 | rice|11v1|BE228654_P1 | 2160 | 3840 | 560 | 82.6 | globlastp |
| LYD560_H93 | rice|gb170|OS01G46380 | 2161 | 3840 | 560 | 82.6 | globlastp |
| LYD560_H95 | sorghum|11v1|SB03G029720 | 2162 | 3838 | 560 | 82.6 | globlastp |
| LYD560_H96 | thellungiella_parvulum|11v1|BM985551 | 2163 | 3841 | 560 | 82.6 | globlastp |
| LYD560_H185 | oil_palm|11v1|SRR190698.100020_T1 | 2164 | 3842 | 560 | 82.5 | glotblastn |
| LYD560_H186 | rye|12v1|DRR001012.115524_P1 | 2165 | 3843 | 560 | 82.5 | globlastp |
| LYD560_H98 | canola|11v1|SRR023610.26048_P1 | 2166 | 3844 | 560 | 82.5 | globlastp |
| LYD560_H102 | brachypodium|09v1|DV469933 | 2167 | 3845 | 560 | 82.5 | globlastp |
| LYD560_H187 | poppy|11v1|SRR030259.10325_P1 | 2168 | 3846 | 560 | 82.4 | globlastp |
| LYD560_H101 | b_rapa|gb162|BQ791335 | 2169 | 3847 | 560 | 82.4 | globlastp |
| LYD560_H103 | barley|10v2|BE413220 | 2170 | 3848 | 560 | 82.4 | globlastp |
| LYD560_H188 | eschscholzia|11v1|CD478497_P1 | 2171 | 3849 | 560 | 82.3 | globlastp |
| LYD560_H189 | onion|12v1|BI095623_P1 | 2172 | 3850 | 560 | 82.3 | globlastp |
| LYD560_H190 | rye|12v1|DRR001012.11842_P1 | 2173 | 3851 | 560 | 82.3 | globlastp |
| LYD560_H105 | sugarcane|10v1|CA069523 | 2174 | 3852 | 560 | 82.3 | globlastp |
| LYD560_H104 | flaveria|11v1|SRR149241.124510_T1 | 2175 | 3853 | 560 | 82.29 | glotblastn |
| LYD560_H191 | oil_palm|11v1|CN600787_P1 | 2176 | 3854 | 560 | 82.2 | globlastp |
| LYD560_H108 | thellungiella_halophilum|11v1|BM985551 | 2177 | 3855 | 560 | 82.2 | globlastp |
| LYD560_H109 | tomato|11v1|BG124037 | 2178 | 3856 | 560 | 82.2 | globlastp |
| LYD560_H110 | wheat|10v2|BE399048 | 2179 | 3857 | 560 | 82.2 | globlastp |
| LYD560_H110 | wheat|12v3|BE399048_P1 | 2180 | 3857 | 560 | 82.2 | globlastp |
| LYD560_H111 | foxtail_millet|11v3|EC612034_P1 | 2181 | 3858 | 560 | 82.1 | globlastp |
| LYD560_H112 | leymus|gb166|EG374815_P1 | 2182 | 3859 | 560 | 82.1 | globlastp |
| LYD560_H113 | wheat|10v2|BE413925 | 2183 | 3860 | 560 | 82.1 | globlastp |
| LYD560_H113 | wheat|12v3|BE413925_P1 | 2184 | 3860 | 560 | 82.1 | globlastp |
| LYD560_H192 | poppy|11v1|SRR030259.155979_T1 | 2185 | 3861 | 560 | 82.03 | glotblastn |
| LYD560_H193 | banana|12v1|FF557878_P1 | 2186 | 3862 | 560 | 82 | globlastp |
| LYD560_H114 | cassava|09v1|DV446011_P1 | 2187 | 3863 | 560 | 82 | globlastp |
| LYD560_H115 | artemisia|10v1|EY032298_P1 | 2188 | 3864 | 560 | 82 | globlastp |
| LYD560_H194 | banana|12v1|FL659215_P1 | 2189 | 3865 | 560 | 81.9 | globlastp |
| LYD560_H195 | plantago|11v2|SRR066373X112712_P1 | 2190 | 3866 | 560 | 81.9 | globlastp |
| LYD560_H196 | poppy|11v1|SRR030259.101863_P1 | 2191 | 3867 | 560 | 81.8 | globlastp |
| LYD560_H197 | sorghum|12v1|SB09G029170_P1 | 2192 | 3868 | 560 | 81.8 | globlastp |
| LYD560_H117 | flaveria|11v1|SRR149229.264618_P1 | 2193 | 3869 | 560 | 81.8 | globlastp |
| LYD560_H118 | solanum_phureja|09v1|SPHBG124037 | 2194 | 3870 | 560 | 81.8 | globlastp |
| LYD560_H119 | sugarcane|10v1|CA069008 | 2195 | 3871 | 560 | 81.8 | globlastp |
| LYD560_H120 | wheat|10v2|BE402709 | 2196 | 3872 | 560 | 81.8 | globlastp |
| LYD560_H120 | wheat|12v3|BE402709_P1 | 2197 | 3872 | 560 | 81.8 | globlastp |
| LYD560_H153 | sorghum|11v1|SB09G029170 | 2198 | 3868 | 560 | 81.8 | globlastp |
| LYD560_H116 | ambrosia|11v1|SRR346935.124709_T1 | 2199 | 3873 | 560 | 81.79 | glotblastn |
| LYD560_H121 | flaveria|11v1|SRR149232.69233_T1 | 2200 | 3874 | 560 | 81.76 | glotblastn |
| LYD560_H122 | millet|10v1|EVO454PM006129_P1 | 2201 | 3875 | 560 | 81.7 | globlastp |
| LYD560_H198 | hornbeam|12v1|SRR364455.102657_P1 | 2202 | 3876 | 560 | 81.6 | globlastp |
| LYD560_H124 | onion|gb162|BI095623 | 2203 | 3877 | 560 | 81.57 | glotblastn |
| LYD560_H125 | cassava|09v1|CK643930_T1 | 2204 | 3878 | 560 | 81.55 | glotblastn |
| LYD560_H199 | oil_palm|11v1|EY407536_P1 | 2205 | 3879 | 560 | 81.5 | globlastp |
| LYD560_H126 | castorbean|11v1|EE257398_P1 | 2206 | 3880 | 560 | 81.5 | globlastp |
| LYD560_H127 | cirsium|11v1|SRR346952.101419_P1 | 2207 | 3881 | 560 | 81.5 | globlastp |
| LYD560_H128 | oat|11v1|GO589350_P1 | 2208 | 3882 | 560 | 81.5 | globlastp |
| LYD560_H200 | brachypodium|12v1|BRADI2G15790_T1 | 2209 | — | 560 | 81.48 | glotblastn |
| LYD560_H130 | flaveria|11v1|SRR149229.44395_P1 | 2210 | 3883 | 560 | 81.4 | globlastp |
| LYD560_H129 | artemisia|10v1|EY057322_P1 | 2211 | 3884 | 560 | 81.3 | globlastp |
| LYD560_H201 | oil_palm|11v1|CN599858_P1 | 2212 | 3885 | 560 | 81.2 | globlastp |
| LYD560_H202 | gossypium_raimondii|12v1|DW233183_P1 | 2213 | 3886 | 560 | 81.1 | globlastp |
| LYD560_H203 | oil_palm|11v1|EL683104_T1 | 2214 | 3887 | 560 | 81.07 | glotblastn |
| LYD560_H204 | cotton|11v1|CO494385_T1 | 2215 | 3888 | 560 | 81.03 | glotblastn |
| LYD560_H205 | amborella|12v3|CK756678_P1 | 2216 | 3889 | 560 | 81 | globlastp |
| LYD560_H132 | potato|10v1|BF153113_P1 | 2217 | 3890 | 560 | 81 | globlastp |
| LYD560_H133 | solanum_phureja|09v1|SPHAA824938 | 2218 | 3890 | 560 | 81 | globlastp |
| LYD560_H206 | banana|12v1|ES435770_P1 | 2219 | 3891 | 560 | 80.9 | globlastp |
| LYD560_H134 | valeriana|11v1|SRR099039X100132 | 2220 | 3892 | 560 | 80.9 | globlastp |
| LYD560_H135 | cacao|10v1|CA794506_T1 | 2221 | 3893 | 560 | 80.88 | glotblastn |
| LYD560_H207 | brachypodium|12v1|BRADI2G45330_P1 | 2222 | 3894 | 560 | 80.8 | globlastp |
| LYD560_H137 | brachypodium|09v1|DV472499 | 2223 | 3894 | 560 | 80.8 | globlastp |
| LYD560_H138 | flaveria|11v1|SRR149229.115395_P1 | 2224 | 3895 | 560 | 80.8 | globlastp |
| LYD560_H140 | silene|11v1|SRR096785X101730 | 2225 | 3896 | 560 | 80.8 | globlastp |
| LYD560_H136 | tomato|11v1|AA824938 | 2226 | 3897 | 560 | 80.78 | glotblastn |
| LYD560_H141 | ambrosia|11v1|SRR346935.63652_T1 | 2227 | 3898 | 560 | 80.76 | glotblastn |
| LYD560_H139 | flaveria|11v1|SRR149229.1150942_P1 | 2228 | 3899 | 560 | 80.7 | globlastp |
| LYD560_H142 | cotton|10v2|BF268414 | 2229 | 3900 | 560 | 80.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD560_H208 | beet\|12v1\|BE590351_T1 | 2230 | 3901 | 560 | 80.61 | glotblastn |
| LYD560_H209 | cotton\|11v1\|CO107572_P1 | 2231 | 3902 | 560 | 80.6 | globlastp |
| LYD560_H143 | ambrosia\|11v1\|SRR346935.109161_P1 | 2232 | 3903 | 560 | 80.6 | globlastp |
| LYD560_H144 | ambrosia\|11v1\|SRR346935.395723XX2_P1 | 2233 | 3904 | 560 | 80.6 | globlastp |
| LYD560_H145 | flaveria\|11v1\|SRR149232.112827_P1 | 2234 | 3905 | 560 | 80.6 | globlastp |
| LYD560_H146 | lettuce\|10v1\|DW056546 | 2235 | 3906 | 560 | 80.6 | globlastp |
| LYD560_H147 | millet\|10v1\|EVO454PM014502_T1 | 2236 | 3907 | 560 | 80.52 | glotblastn |
| LYD560_H148 | canola\|11v1\|CN725975_P1 | 2237 | 3908 | 560 | 80.5 | globlastp |
| LYD560_H151 | chelidonium\|11v1\|SRR084752X100065_P1 | 2238 | 3909 | 560 | 80.4 | globlastp |
| LYD560_H152 | momordica\|10v1\|SRR071315S0002438_P1 | 2239 | 3910 | 560 | 80.4 | globlastp |
| LYD560_H150 | fagopyrum\|11v1\|SRR063689X104708_T1 | 2240 | 3911 | 560 | 80.38 | glotblastn |
| LYD560_H154 | flaveria\|11v1\|SRR149241.109217_T1 | 2241 | 3912 | 560 | 80.3 | glotblastn |
| LYD560_H210 | b_juncea\|12v1\|E6ANDIZ01A9Y9Z_P1 | 2242 | 3913 | 560 | 80.2 | globlastp |
| LYD560_H211 | nasturtium\|11v1\|GH167255_T1 | 2243 | 3914 | 560 | 80.2 | glotblastn |
| LYD560_H155 | amorphophallus\|11v2\|SRR089351X10005_P1 | 2244 | 3915 | 560 | 80.2 | globlastp |
| LYD560_H156 | fagopyrum\|11v1\|GO496319_T1 | 2245 | 3916 | 560 | 80.17 | glotblastn |
| LYD560_H157 | pseudoroegneria\|gb167\|FF349256 | 2246 | 3917 | 560 | 80.17 | glotblastn |
| LYD560_H212 | grape\|11v1\|GSVIVT01021204001_T1 | 2247 | 3918 | 560 | 80.03 | glotblastn |
| LYD560_H213 | humulus\|11v1\|SRR098683X109313_T1 | 2248 | 3919 | 560 | 80.03 | glotblastn |
| LYD560_H214 | flaveria\|11v1\|SRR149229.139497_P1 | 2249 | 3920 | 560 | 80 | globlastp |
| LYD571_H1 | trigonella\|11v1\|SRR066194X103623 | 2250 | 3921 | 563 | 97.04 | glotblastn |
| LYD571_H8 | chickpea\|11v1\|GR915346_P1 | 2251 | 3922 | 563 | 94.4 | globlastp |
| LYD571_H9 | pigeonpea\|11v1\|SRR054580X102540_P1 | 2252 | 3923 | 563 | 88.5 | globlastp |
| LYD571_H2 | lotus\|09v1\|AW720127_P1 | 2253 | 3924 | 563 | 87.2 | globlastp |
| LYD571_H3 | cowpea\|12v1\|FF390005_P1 | 2254 | 3925 | 563 | 86.8 | globlastp |
| LYD571_H3 | cowpea\|gb166\|FF390005 | 2255 | 3925 | 563 | 86.8 | globlastp |
| LYD571_H4 | soybean\|11v1\|GLYMA09G08190 | 2256 | 3926 | 563 | 86.33 | glotblastn |
| LYD571_H10 | bean\|12v1\|SRR001334.141366_P1 | 2257 | 3927 | 563 | 86.1 | globlastp |
| LYD571_H5 | citrus\|gb166\|CB250284 | 2258 | 3928 | 563 | 81 | globlastp |
| LYD571_H6 | clementine\|11v1\|CB250284_P1 | 2259 | 3928 | 563 | 81 | globlastp |
| LYD571_H7 | orange\|11v1\|CB250284_P1 | 2260 | 3928 | 563 | 81 | globlastp |
| LYD572_H2 | clover\|gb162\|BB915599_T1 | 2261 | 3929 | 564 | 80.35 | glotblastn |
| LYD575_H1 | trigonella\|11v1\|SRR066194X189015 | 2262 | 3930 | 565 | 81.2 | globlastp |
| LYD575_H2 | lotus\|09v1\|AV416874_P1 | 2263 | 3931 | 565 | 80.1 | globlastp |
| LYD577_H19 | chickpea\|11v1\|SRR133517.111644_P1 | 2264 | 3932 | 566 | 92.6 | globlastp |
| LYD577_H20 | pigeonpea\|11v1\|SRR054580X103980_P1 | 2265 | 3933 | 566 | 89.6 | globlastp |
| LYD577_H1 | soybean\|11v1\|GLYMA04G39980 | 2266 | 3934 | 566 | 89.3 | globlastp |
| LYD577_H2 | soybean\|11v1\|GLYMA06G14870 | 2267 | 3935 | 566 | 88.7 | globlastp |
| LYD577_H21 | bean\|12v1\|CA898729_P1 | 2268 | 3936 | 566 | 87.9 | globlastp |
| LYD577_H3 | oak\|10v1\|FP043216_P1 | 2269 | 3937 | 566 | 85.6 | globlastp |
| LYD577_H4 | grape\|11v1\|GSVIVT01022300001_P1 | 2270 | 3938 | 566 | 83.5 | globlastp |
| LYD577_H6 | prunus\|10v1\|CN862404 | 2271 | 3939 | 566 | 83.2 | globlastp |
| LYD577_H5 | apple\|11v1\|CN911043_P1 | 2272 | 3940 | 566 | 83.1 | globlastp |
| LYD577_H7 | eucalyptus\|11v2\|CD668107_P1 | 2273 | 3941 | 566 | 82.5 | globlastp |
| LYD577_H8 | castorbean\|11v1\|XM_002521692_P1 | 2274 | 3942 | 566 | 82.4 | globlastp |
| LAB627_H19 | beet\|12v1\|BQ584887_T1 | 2275 | 3943 | 566 | 82.12 | glotblastn |
| LYD577_H9 | watermelon\|11v1\|AM720533 | 2276 | 3944 | 566 | 82.1 | globlastp |
| LYD577_H10 | cassava\|09v1\|CK645412_P1 | 2277 | 3945 | 566 | 82 | globlastp |
| LYD577_H11 | aquilegia\|10v2\|DR932473_P1 | 2278 | 3946 | 566 | 81.6 | globlastp |
| LYD577_H13 | clementine\|11v1\|CK701542_T1 | 2279 | 3947 | 566 | 81.56 | glotblastn |
| LYD577_H12 | cucumber\|09v1\|DV737259_P1 | 2280 | 3948 | 566 | 81.5 | globlastp |
| LYD577_H14 | valeriana\|11v1\|SRR099039X110137 | 2281 | 3949 | 566 | 81.48 | glotblastn |
| LAB627_H26 | sunflower\|12v1\|DY906340_P1 | 2282 | 3950 | 566 | 81.2 | globlastp |
| LYD577_H15 | sunflower\|10v1\|DY906340 | 2283 | 3951 | 566 | 81 | globlastp |
| LYD577_H16 | thellungiella_halophilum\|11v1\|BY808300 | 2284 | 3952 | 566 | 80.7 | globlastp |
| LAB627_H11 | oil_palm\|11v1\|EY396859_P1 | 2285 | 3953 | 566 | 80.4 | globlastp |
| LYD577_H17 | arabidopsis_lyrata\|09v1\|JGIAL012212_P1 | 2286 | 3954 | 566 | 80.4 | globlastp |
| LYD577_H22 | b_rapa\|11v1\|DY009615_P1 | 2287 | 3955 | 566 | 80.3 | globlastp |
| LYD577_H18 | poplar\|10v1\|BI129795_P1 | 2288 | 3956 | 566 | 80.3 | globlastp |
| LYD577_H23 | monkeyflower\|10v1\|GR046028_P1 | 2289 | 3957 | 566 | 80.2 | globlastp |
| LYD577_H24 | canola\|11v1\|ES905120_T1 | 2290 | 3958 | 566 | 80.13 | glotblastn |
| LYD578_H1 | trigonella\|11v1\|SRR066194X120334 | 2291 | 3959 | 567 | 98.6 | globlastp |
| LYD578_H14 | aquilegia\|10v2\|DR913123_P1 | 2292 | 3960 | 567 | 88.6 | globlastp |
| LYD578_H175 | cotton\|11v1\|AI055621_P1 | 2293 | 3961 | 567 | 88.3 | globlastp |
| LYD578_H22 | cotton\|10v2\|AI055621 | 2294 | 3961 | 567 | 88.3 | globlastp |
| LYD578_H176 | gossypium_raimondii\|12v11\|AI055621_P1 | 2295 | 3962 | 567 | 88.1 | globlastp |
| LYD578_H177 | cotton\|11v1\|AI727988_P1 | 2296 | 3963 | 567 | 87.9 | globlastp |
| LYD578_H20 | cassava\|09v1\|DV444573_P1 | 2297 | 3964 | 567 | 87.9 | globlastp |
| LYD578_H25 | cotton\|10v2\|CO119212 | 2298 | 3963 | 567 | 87.9 | globlastp |
| LYD578_H24 | chelidonium\|11v1\|SRR084752X102130_T1 | 2299 | 3965 | 567 | 87.69 | glotblastn |
| LYD578_H178 | cotton\|11v1\|AI055263_P1 | 2300 | 3966 | 567 | 87.4 | globlastp |
| LYD578_H179 | gossypium_raimondii\|12v1\|AI055263_P1 | 2301 | 3967 | 567 | 87.2 | globlastp |
| LYD578_H27 | cassava\|09v1\|DV449138_P1 | 2302 | 3968 | 567 | 87.2 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD578_H28 | cotton\|10v2\|BG444918 | 2303 | 3969 | 567 | 87.2 | globlastp |
| LYD578_H35 | soybean\|11v1\|GLYMA08G09740 | 2304 | 3970 | 567 | 86.7 | globlastp |
| LYD578_H33 | citrus\|gb166\|CB250290 | 2305 | 3971 | 567 | 86.6 | globlastp |
| LYD578_H34 | clementine\|11v1\|CD574218_P1 | 2306 | 3972 | 567 | 86.6 | globlastp |
| LYD578_H38 | soybean\|11v1\|GLYMA05G26750 | 2307 | 3973 | 567 | 86.5 | globlastp |
| LYD578_H41 | clementine\|11v1\|CB250290_P1 | 2308 | 3974 | 567 | 86.5 | globlastp |
| LYD578_H67 | trigonella\|11v1\|SRR066194X119293 | 2309 | 3975 | 567 | 85.8 | globlastp |
| LYD578_H180 | pigeonpea\|11v1\|SRR054580X105689_P1 | 2310 | 3976 | 567 | 85.7 | globlastp |
| LYD578_H53 | canola\|11v1\|EG021317_P1 | 2311 | 3977 | 567 | 85.7 | globlastp |
| LYD578_H57 | monkeyflower\|10v1\|DV207594_P1 | 2312 | 3978 | 567 | 85.7 | globlastp |
| LYD578_H61 | monkeyflower\|10v1\|DV208027_P1 | 2313 | 3979 | 567 | 85.5 | globlastp |
| LYD578_H70 | castorbean\|11v1\|T23277_P1 | 2314 | 3980 | 567 | 85.5 | globlastp |
| LYD578_H62 | orobanche\|10v1\|SRR023189S0000345_P1 | 2315 | 3981 | 567 | 85.2 | globlastp |
| LYD578_H64 | euonymus\|11v1\|SRR070038X10094_P1 | 2316 | 3982 | 567 | 85.2 | globlastp |
| LYD578_H81 | oak\|10v1\|FP030675_P1 | 2317 | 3983 | 567 | 85.2 | globlastp |
| LYD578_H79 | eucalyptus\|11v2\|CT987127_P1 | 2318 | 3984 | 567 | 85.1 | globlastp |
| LYD578_H89 | eucalyptus\|11v2\|CT984993_P1 | 2319 | 3985 | 567 | 85.1 | globlastp |
| LYD578_H71 | valeriana\|11v1\|SRR099039X102744 | 2320 | 3986 | 567 | 85 | globlastp |
| LYD578_H72 | amsonia\|11v1\|SRR098688X103450_P1 | 2321 | 3987 | 567 | 84.9 | globlastp |
| LYD578_H73 | zostera\|10v1\|AM767776 | 2322 | 3988 | 567 | 84.8 | globlastp |
| LYD578_H181 | gossypium_raimondii\|12v1\|AI054718_P1 | 2323 | 3989 | 567 | 84.5 | globlastp |
| LYD578_H83 | euonymus\|11v1\|SRR070038X166372_T1 | 2324 | 3990 | 567 | 84.49 | glotblastn |
| LYD578_H182 | oil_palm\|11v1\|EL695363_P1 | 2325 | 3991 | 567 | 84.4 | globlastp |
| LYD578_H183 | nasturtium\|11v1\|SRR032558.101620_T1 | 2326 | 3992 | 567 | 84.15 | glotblastn |
| LYD578_H184 | cotton\|11v1\|AI054718_P1 | 2327 | 3993 | 567 | 84.1 | globlastp |
| LYD578_H102 | zostera\|10v1\|SRR057351S0005912 | 2328 | 3994 | 567 | 84.1 | globlastp |
| LYD578_H185 | barley\|12v1\|BI946608_P1 | 2329 | 3995 | 567 | 84 | globlastp |
| LYD578_H186 | rye\|12v1\|DRR001012.100198_P1 | 2330 | 3995 | 567 | 84 | globlastp |
| LYD578_H100 | valeriana\|11v1\|SRR099039X113494 | 2331 | 3996 | 567 | 84 | globlastp |
| LYD578_H107 | foxtail_millet\|11v3\|PHY7SI034806M_P1 | 2332 | 3997 | 567 | 84 | globlastp |
| LYD578_H108 | barley\|10v2\|BI946608 | 2333 | 3995 | 567 | 84 | globlastp |
| LYD578_H109 | wheat\|10v2\|BF291626 | 2334 | 3995 | 567 | 84 | globlastp |
| LYD578_H109 | wheat\|12v3\|BE444286_P1 | 2335 | 3995 | 567 | 84 | globlastp |
| LYD578_H187 | oil_palm\|11v1\|EL684249_P1 | 2336 | 3998 | 567 | 83.8 | globlastp |
| LYD578_H106 | centaurea\|gb166\|EH713185_P1 | 2337 | 3999 | 567 | 83.8 | globlastp |
| LYD578_H188 | lettuce\|12v1\|DW052763_P1 | 2338 | 4000 | 567 | 83.4 | globlastp |
| LYD578_H123 | maize\|10v1\|AI987493_P1 | 2339 | 4001 | 567 | 82.7 | globlastp |
| LYD578_H189 | amborella\|12v3\|FD429782_P1 | 2340 | 4002 | 567 | 82.6 | globlastp |
| LYD578_H120 | aristolochia\|10v1\|SRR039083S0092867_P1 | 2341 | 4003 | 567 | 82.6 | globlastp |
| LYD578_H122 | maize\|10v1\|AI601039_P1 | 2342 | 4004 | 567 | 82.5 | globlastp |
| LYD578_H125 | sugarcane\|10v1\|BQ533651 | 2343 | 4005 | 567 | 82.5 | globlastp |
| LYD578_H190 | sorghum\|12v1\|SB01G041650_P1 | 2344 | 4006 | 567 | 82.2 | globlastp |
| LYD578_H129 | sorghum\|11v1\|SB01G041650 | 2345 | 4006 | 567 | 82.2 | globlastp |
| LYD578_H131 | amorphophallus\|11v2\|SRR089351X155622_P1 | 2346 | 4007 | 567 | 81.7 | globlastp |
| LYD578_H134 | ambrosia\|11v1\|SRR346935.11798_P1 | 2347 | 4008 | 567 | 81.7 | globlastp |
| LYD578_H191 | amborella\|12v3\|CK743344_P1 | 2348 | 4009 | 567 | 81.4 | globlastp |
| LYD578_H136 | thellungiella_halophilum\|11v1\|BY807071 | 2349 | 4010 | 567 | 81.1 | globlastp |
| LYD578_H141 | pine\|10v2\|AI725121_P1 | 2350 | 4011 | 567 | 80.8 | globlastp |
| LYD578_H192 | podocarpus\|10v1\|SRR065014S0003582_P1 | 2351 | 4012 | 567 | 80.1 | globlastp |
| LYD580_H1 | clover\|gb162\|BB906292_P1 | 2352 | 4013 | 569 | 84.7 | globlastp |
| LYD580_H5 | pigeonpea\|11v1\|SRR054580X133160_P1 | 2353 | 4014 | 569 | 80.1 | globlastp |
| LYD580_H2 | pigeonpea\|10v1\|SRR054580S0027058 | 2354 | 4014 | 569 | 80.1 | globlastp |
| LYD583_H1 | pigeonpea\|11v1\|SRR054581X208104_P1 | 2355 | 4015 | 570 | 80.4 | globlastp |
| LYD587_H1 | chickpea\|11v1\|SRR133517.128822_P1 | 2356 | 4016 | 571 | 83.4 | globlastp |
| LYD588_H4 | medicago\|12v1\|BE322031_P1 | 2357 | 4017 | 572 | 86.3 | globlastp |
| LYD588_H2 | medicago\|09v1\|BE322031 | 2358 | 4018 | 572 | 84.7 | globlastp |
| LYD588_H5 | medicago\|12v1\|BI272020_P1 | 2359 | 4019 | 572 | 80.9 | globlastp |
| LYD589_H1 | soybean\|11v1\|GLYMA09G32750 | 2360 | 4020 | 573 | 83.7 | globlastp |
| LYD589_H2 | bean\|gb167\|EC911408 | 2361 | 4021 | 573 | 83 | globlastp |
| LYD589_H4 | pigeonpea\|11v1\|SRR054580X14159_P1 | 2362 | 4022 | 573 | 81.9 | globlastp |
| LYD589_H3 | soybean\|11v1\|GLYMA16G21310 | 2363 | 4023 | 573 | 81.5 | globlastp |
| LYD589_H5 | bean\|12v1\|EC911765_P1 | 2364 | 4024 | 573 | 81.2 | globlastp |
| LYD593_H1 | trigonella\|11v1\|SRR066194X116418 | 2365 | 4025 | 576 | 96.3 | globlastp |
| LYD593_H5 | chickpea\|11v1\|SRR133517.177493_P1 | 2366 | 4026 | 576 | 87.3 | globlastp |
| LYD593_H6 | pigeonpea\|11v1\|SRR054580X103481_P1 | 2367 | 4027 | 576 | 85.8 | globlastp |
| LYD593_H2 | soybean\|11v1\|GLYMA17G18500 | 2368 | 4028 | 576 | 85.2 | globlastp |
| LYD593_H7 | bean\|12v1\|SRR001334.191933_T1 | 2369 | 4029 | 576 | 83.08 | glotblastn |
| LYD593_H3 | peanut\|10v1\|GO330608_P1 | 2370 | 4030 | 576 | 82.2 | globlastp |
| LYD593_H4 | cowpea\|12v1\|FG826472_P1 | 2371 | 4031 | 576 | 80.4 | globlastp |
| LYD593_H4 | cowpea\|gb166\|FG826472 | 2372 | 4031 | 576 | 80.4 | globlastp |
| LYD605_H2 | foxtail_millet\|11v3\|PHY7SI029408M_P1 | 2373 | 4032 | 578 | 86.2 | globlastp |
| LYD618_H3 | bean\|12v1\|CB542893_P1 | 2374 | 4033 | 579 | 88.5 | globlastp |
| LYD618_H4 | pigeonpea\|11v1\|SRR054580X169953_P1 | 2375 | 4034 | 579 | 88 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Gene Name | Organism/Cluster tag | P.N. | P.P. | Hom. To SEQ ID NO: | % global identity | Algor. |
|---|---|---|---|---|---|---|
| LYD618_H1 | cowpea\|gb166\|FF547523 | 2376 | 4035 | 579 | 87.12 | glotblastn |
| LYD618_H2 | lotus\|09v1\|BW622754_P1 | 2377 | 4036 | 579 | 81.9 | globlastp |
| LYD632_H2 | soybean\|11v1\|GLYMA19G38740 | 2378 | 4037 | 581 | 99.8 | globlastp |
| LYD637_H1 | soybean\|11v1\|GLYMA0084S00210 | 2379 | 4038 | 582 | 96.2 | globlastp |
| LYD637_H4 | pigeonpea\|11v1\|SRR054580X528923_P1 | 2380 | 4039 | 582 | 88.2 | globlastp |
| LYD637_H2 | bean\|gb167\|CV530100 | 2381 | 4040 | 582 | 87.2 | globlastp |
| LYD637_H3 | cowpea\|12v1\|FF546955_T1 | 2382 | 4041 | 582 | 84.66 | glotblastn |
| LYD637_H3 | cowpea\|gb166\|FF546955 | 2383 | 4042 | 582 | 84.4 | globlastp |
| LYD637_H5 | bean\|12v1\|SRR001334.120242_P1 | 2384 | 4043 | 582 | 81.1 | globlastp |
| LYD641_H1 | soybean\|11v1\|GLYMA13G42740 | 2385 | 4044 | 583 | 95.2 | globlastp |
| LNU337_H33 | pigeonpea\|11v1\|SRR054580X108382_P1 | 2386 | 4045 | 583 | 86.1 | globlastp |
| LYD641_H2 | bean\|12v1\|CA902313_P1 | 2387 | 4046 | 583 | 85.5 | globlastp |
| LYD646_H1 | soybean\|11v1\|GLYMA05G01650 | 2388 | 4047 | 584 | 90.6 | globlastp |
| LYD646_H2 | pigeonpea\|11v1\|SRR054580X108829_P1 | 2389 | 4048 | 584 | 89.2 | globlastp |
| LYD646_H3 | bean\|12v1\|SRR001334.187433_P1 | 2390 | 4049 | 584 | 88.1 | globlastp |
| LYD650_H3 | tobacco\|gb162\|DV157531 | 2391 | 4050 | 585 | 87 | globlastp |
| LYD651_H1 | solanum_phureja\|09v1\|SPHAI485479 | 2392 | 4051 | 586 | 94 | globlastp |
| LYD652_H1 | solanum_phureja\|09v1\|SPHAI771255 | 2393 | 4052 | 587 | 98 | globlastp |
| LYD652_H2 | eggplant\|10v1\|FS071038_P1 | 2394 | 4053 | 587 | 81.6 | globlastp |
| LYD652_H3 | solanum_phureja\|09v1\|SPHBG130927_P1 | 2395 | 4054 | 587 | 80.1 | globlastp |
| LYD660_H2 | solanum_phureja\|09v1\|SPHCRPSP010629 | 2396 | 4055 | 588 | 82 | globlastp |
| LYD660_H3 | tomato\|11v1\|AW223948 | 2397 | 4056 | 588 | 81.65 | glotblastn |
| LYD665_H1 | solanum_phureja\|09v1\|SPHBF097728 | 2398 | 4057 | 589 | 91.27 | glotblastn |
| LYD665_H2 | solanum_phureja\|09v1\|SPHDN589048 | 2399 | 4058 | 589 | 85.28 | glotblastn |
| LYD665_H3 | eggplant\|10v1\|FS008366_T1 | 2400 | 4059 | 589 | 82.48 | glotblastn |
| LYD666_H1 | solanum_phureja\|09v1\|SPHBG123259 | 2401 | 4060 | 590 | 96 | globlastp |
| LYD666_H2 | potato\|10v1\|BF153474_P1 | 2402 | 4061 | 590 | 95.8 | globlastp |
| LYD668_H1 | solanum_phureja\|09v1\|SPHBG125390 | 2403 | 4062 | 592 | 97.4 | globlastp |
| LYD668_H2 | ipomoea_nil\|10v1\|BJ560832_P1 | 2404 | 4063 | 592 | 86.5 | globlastp |
| LYD668_H3 | amsonia\|11v1\|SRR098688X1058_P1 | 2405 | 4064 | 592 | 85.9 | globlastp |
| LYD668_H4 | tabernaemontana\|11v1\|SRR098689X118673 | 2406 | 4065 | 592 | 85.1 | globlastp |
| LYD668_H5 | phyla\|11v2\|SRR099035X102114_P1 | 2407 | 4066 | 592 | 84.7 | globlastp |
| LYD668_H11 | blueberry\|12v1\|SRR353282X100511D1_P1 | 2408 | 4067 | 592 | 83 | globlastp |
| LYD668_H6 | monkeyflower\|10v1\|GO963338_P1 | 2409 | 4068 | 592 | 83 | globlastp |
| LYD668_H7 | triphysaria\|10v1\|EY170500 | 2410 | 4069 | 592 | 81.8 | globlastp |
| LYD668_H8 | cacao\|10v1\|CU484627_P1 | 2411 | 4070 | 592 | 81 | globlastp |
| LYD668_H9 | cirsium\|11v1\|SRR346952.105209_P1 | 2412 | 4071 | 592 | 80.4 | globlastp |
| LYD668_H10 | phyla\|11v2\|SRR099035X106776_P1 | 2413 | 4072 | 592 | 80.4 | globlastp |
| LYD668_H12 | valeriana\|11v1\|SRR099039X108687_P1 | 2414 | 4073 | 592 | 80.2 | globlastp |
| LYD668_H13 | prunus\|10v1\|CN947564_T1 | 2415 | 4074 | 592 | 80.12 | glotblastn |
| LYD668_H14 | sarracenia\|11v1\|SRR192669.14959_T1 | 2416 | 4075 | 592 | 80.12 | glotblastn |
| LYD671_H1 | solanum_phureja\|09v1\|SPHBG129734 | 2417 | 4076 | 593 | 90.8 | globlastp |
| LYD671_H2 | potato\|10v1\|BG350219_P1 | 2418 | 4077 | 593 | 90 | globlastp |
| LYD673_H1 | solanum_phureja\|09v1\|SPHBG132287 | 2419 | 4078 | 594 | 94.7 | globlastp |
| LYD675_H1 | potato\|10v1\|BQ515816_P1 | 2420 | 4079 | 595 | 92.5 | globlastp |
| LYD675_H2 | solanum_phureja\|09v1\|SPHBG134175 | 2421 | 4080 | 595 | 91.9 | globlastp |
| LYD676_H1 | solanum_phureja\|09v1\|SPHBG135207 | 2422 | 4081 | 596 | 92.5 | globlastp |
| LYD679_H1 | solanum_phureja\|09v1\|SPHBG628242 | 2423 | 4082 | 597 | 92.4 | globlastp |
| LYD680_H1 | solanum_phureja\|09v1\|SPHBG628985 | 2424 | 4083 | 598 | 97.1 | globlastp |
| LYD680_H3 | ipomoea_nil\|10v1\|BJ560522_P1 | 2425 | 4084 | 598 | 80.7 | globlastp |
| LYD683_H1 | potato\|10v1\|CK248027_P1 | 2426 | 4085 | 599 | 92.3 | globlastp |
| LYD683_H2 | solanum_phureja\|09v1\|SPHBG643762 | 2427 | 4085 | 599 | 92.3 | globlastp |
| LYD688_H1 | solanum_phureja\|09v1\|SPHBG593254 | 2428 | 4086 | 601 | 98.2 | globlastp |

Table 54: Provided are polynucleotides (P.N.) and polypeptides (P.P.) which are homologous to the identified polynucleotides or polypeptides of Table 53.
Hom. = homologue;
Algor. = Algorithm;

Example 14

Gene Cloning and Generation of Binary Vectors for Plant Expression

To validate their role in improving plant yield, oil content, seed yield, biomass, growth rate, fiber yield, fiber quality, ABST, NUE and/or vigor, selected genes were over-expressed in plants, as follows.

Cloning Strategy

Selected genes from those listed in Examples 1-13 hereinabove were cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal and different treated conditions. Total RNA was extracted as described in "GENERAL EXPERIMENTAL AND BIOINFORMATICS METHODS" above. Production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.), which are well known to those skilled in the art. PCR products were purified using PCR purification kit (Qiagen). In case where the entire coding sequence was not found, RACE kit from Invitrogen (RACE=Rapid Amplification of cDNA Ends) was used to access the full cDNA transcript of the gene from the RNA samples described above. RACE products were cloned into high copy vector followed by sequencing or directly sequenced.

The information from the RACE procedure was used for cloning of the full length ORF of the corresponding genes.

In case genomic DNA was cloned, the genes are amplified by direct PCR on genomic DNA extracted from leaf tissue using the DNAeasy kit (Qiagen Cat. No. 69104).

Usually, 2 sets of primers were synthesized for the amplification of each gene from a cDNA or a genomic sequence; an external set of primers and an internal set (nested PCR primers). When needed (e.g., when the first PCR reaction does not result in a satisfactory product for sequencing), an additional primer (or two) of the nested PCR primers is used.

To facilitate cloning of the cDNAs/genomic sequences, an 8-12 bp extension was added to the 5' of each primer. The primer extension includes an endonuclease restriction site. The restriction sites were selected using two parameters: (a). The site does not exist in the cDNA sequence; and (b). The restriction sites in the forward and reverse primers were designed such that the digested cDNA was inserted in the sense formation into the binary vector utilized for transformation.

PCR products were digested with the restriction endonucleases (New England BioLabs Inc) according to the sites designed in the primers. Each digested PCR product was inserted into a high copy vector pUC19 (New England BioLabs Inc], or into plasmids originating from this vector or into CloneJet (Thermo Scientific). In some cases the undigested PCR product was inserted into pCR-Blunt II-TOPO (Invitrogen) or directly into the binary vector.

Sequencing of the amplified PCR products was performed, using ABI 377 sequencer (Amersham Biosciences Inc). In some cases, after confirming the sequences of the cloned genes, the cloned cDNA was introduced into a modified pGI binary vector containing the At6669 promoter via digestion with appropriate restriction endonucleases. The digested products and the linearized plasmid vector were ligated using T4 DNA ligase enzyme (Roche, Switzerland).

High copy plasmids containing the cloned genes were digested with the restriction endonucleases (New England BioLabs Inc) according to the sites designed in the primers and cloned into binary vectors.

Several DNA sequences of the selected genes were synthesized by a commercial supplier GeneArt (Life Technologies) [Hypertext Transfer Protocol://World Wide Web (dot) geneart (dot) com]. Synthetic DNA was designed in silico. Suitable restriction enzymes sites were added to the cloned sequences at the 5' end and at the 3' end to enable later cloning into the pQFNc or other required binary vector downstream of the At6669 promoter (SEQ ID NO: 4111).

Binary vectors used for cloning: The plasmid pPI was constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (pBXYN) was similar to pPI, but the original gene in the backbone, the GUS gene, was replaced by the GUS-Intron gene followed by the NOS terminator (SEQ ID NO: 4122) (Vancanneyt. G, et al MGG 220, 245-50, 1990). pGI was used in the past to clone the polynucleotide sequences, initially under the control of 35S promoter [Odell, J T, et al. Nature 313, 810-812 (28 Feb. 1985); SEQ ID NO:4109].

Figure 2:
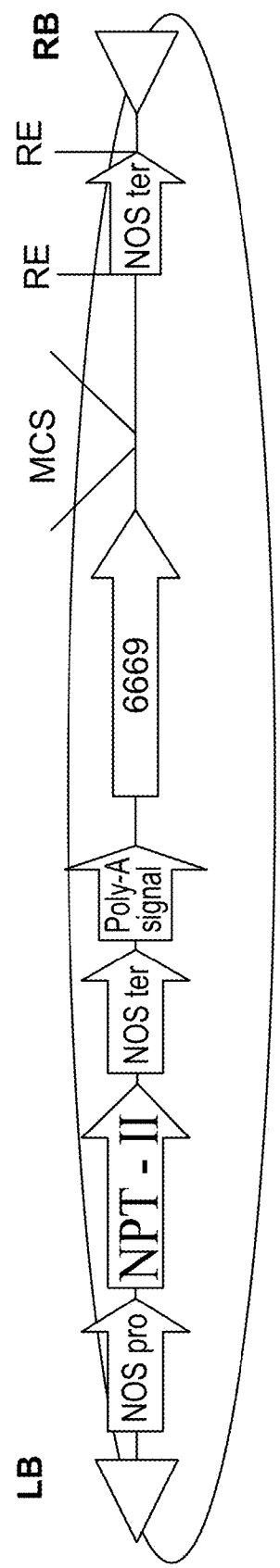
FIG. 2 is a schematic illustration of the modified pGI binary plasmid containing the new At6669 promoter (SEQ ID NO: 4111) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.
Figure 3A:
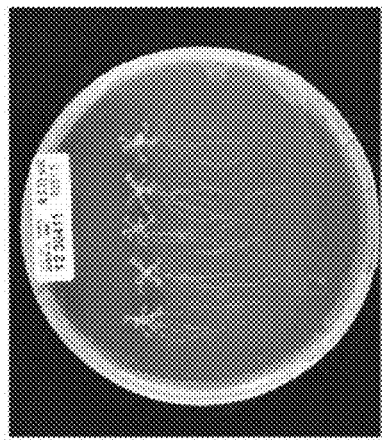
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3B:
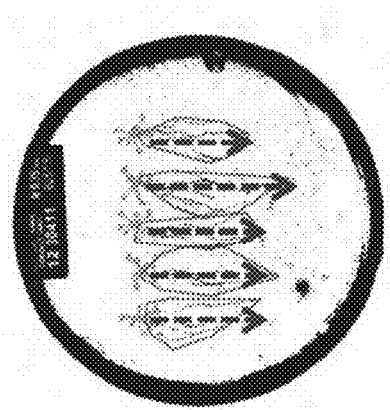
Figure 3C:
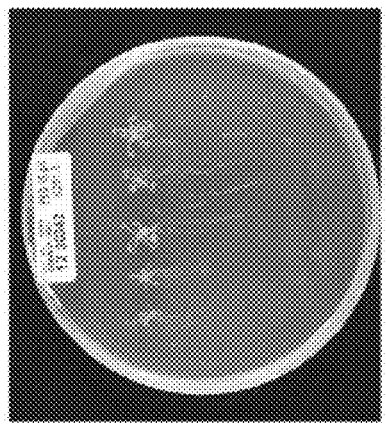
Figure 3D:
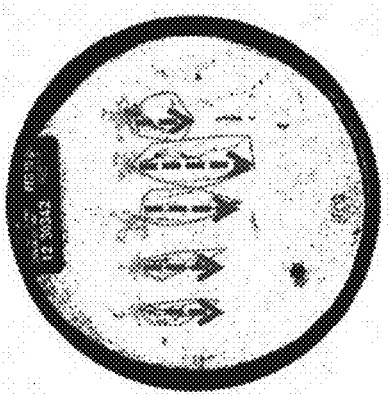
Figure 3E:
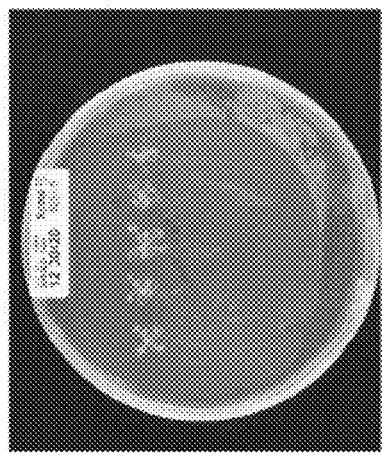
Figure 3F:
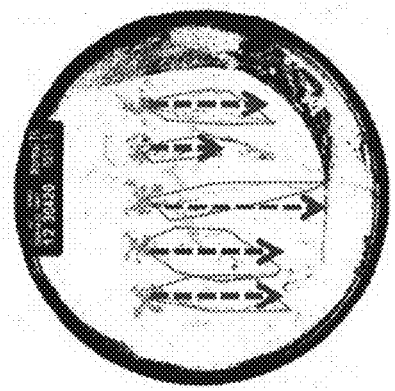
Figure 4:
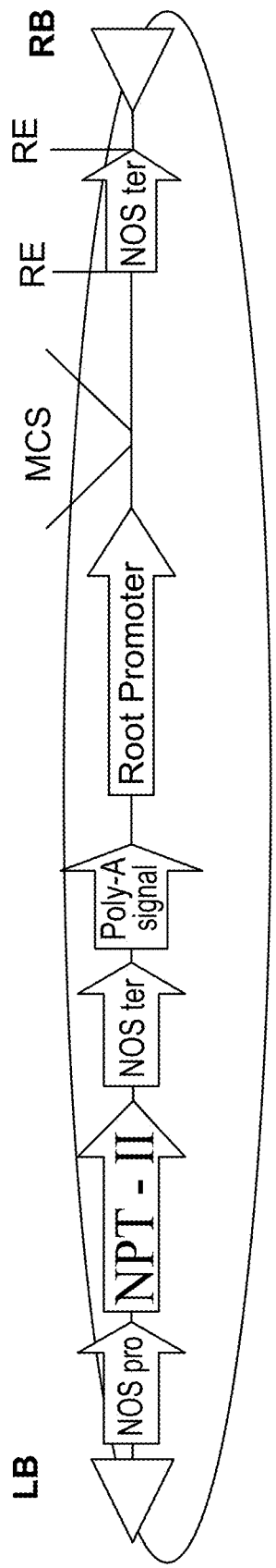
FIG. 4 is a schematic illustration of the modified pGI binary plasmid containing the Root Promoter (pQNa RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); the isolated polynucleotide sequences according to some embodiments of the invention were cloned into the MCS (Multiple cloning site) of the vector.
Figure 5:
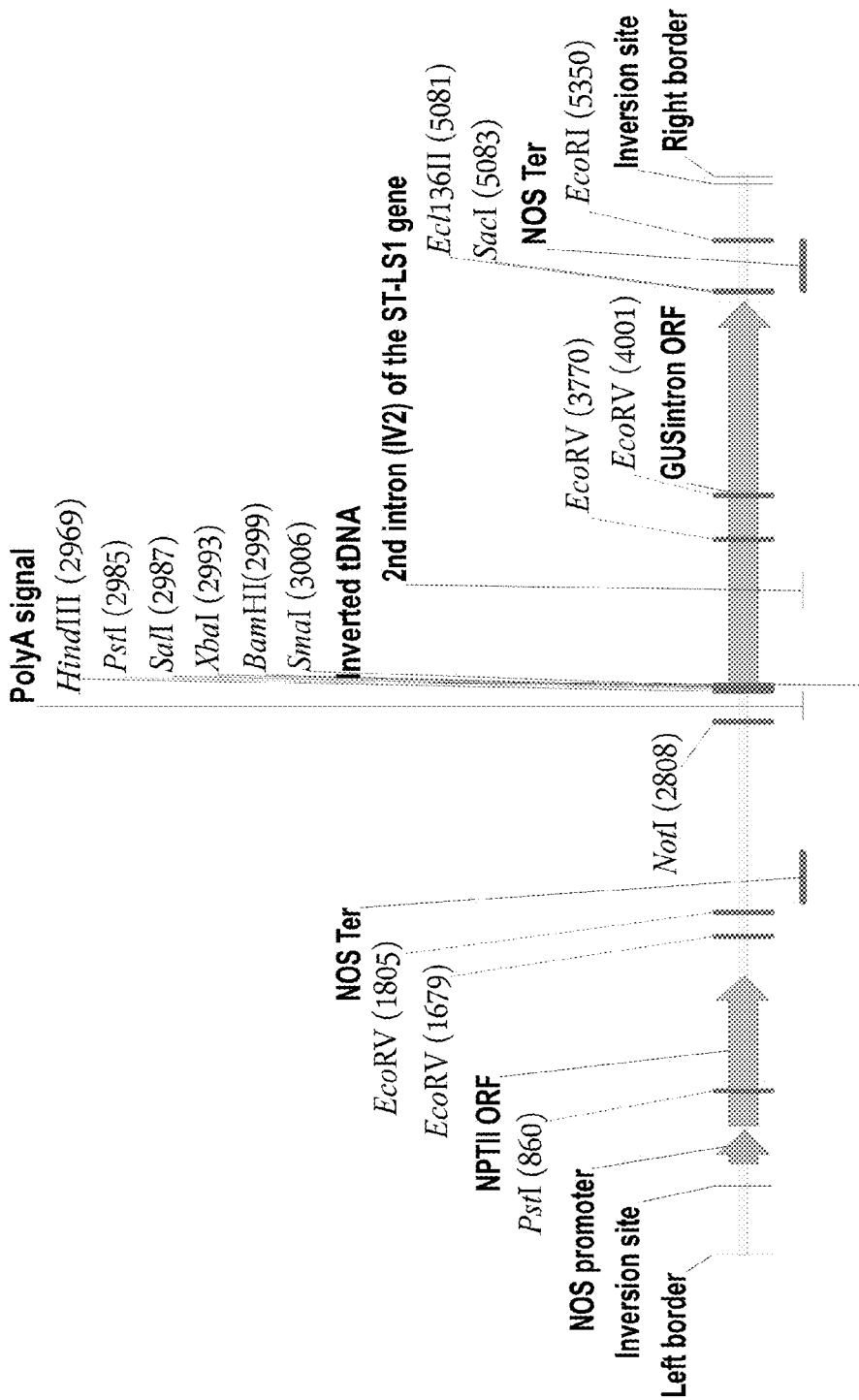
FIG. 5 is a schematic illustration of the pQYN plasmid.
Figure 6:
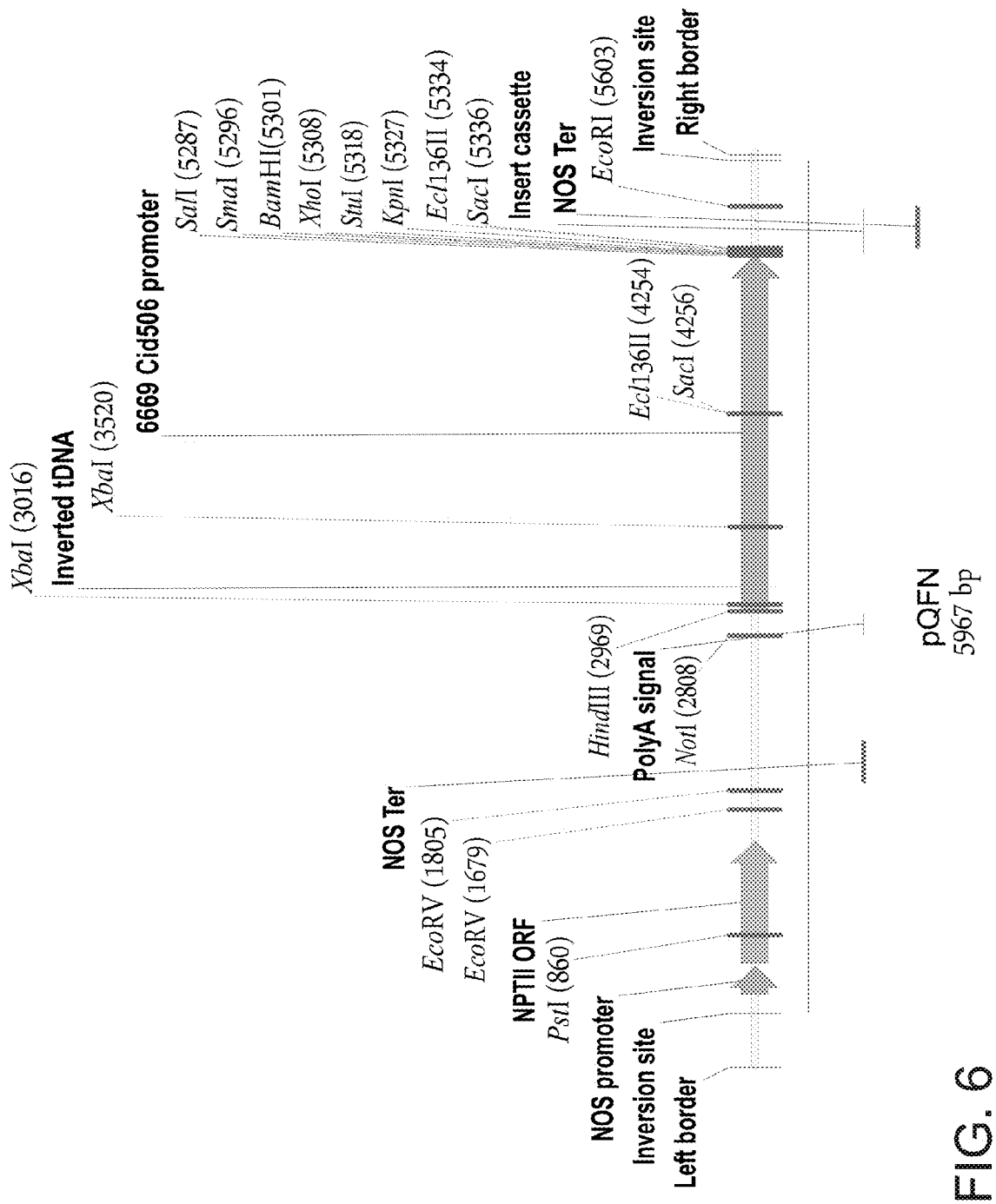
FIG. 6 is a schematic illustration of the pQFN plasmid.
Figure 7:
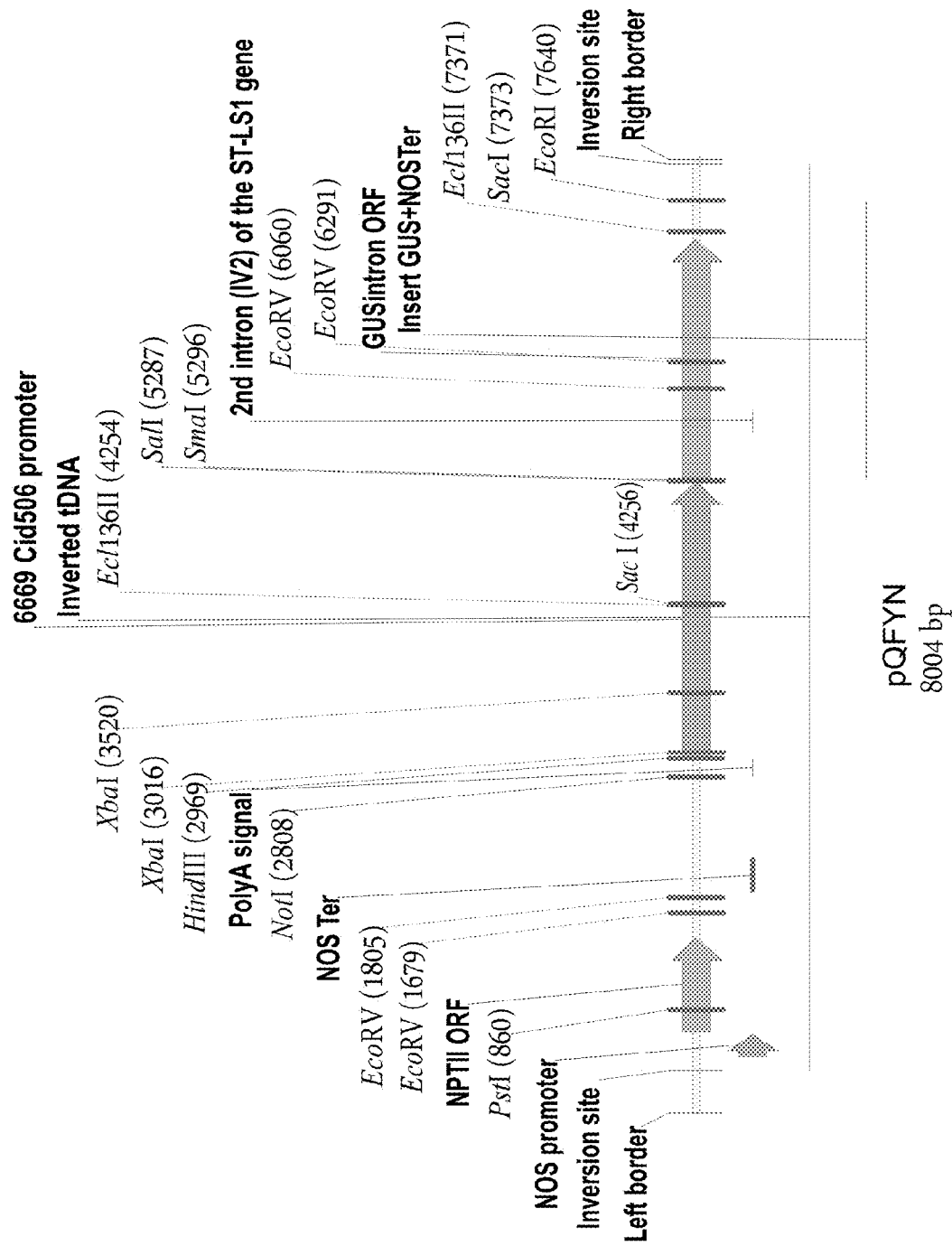
FIG. 7 is a schematic illustration of the pQFYN plasmid.
Figure 8:
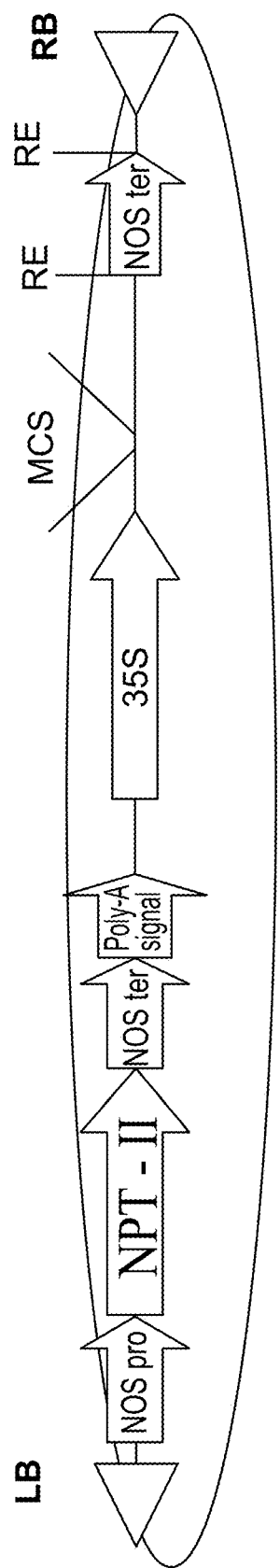
FIG. 8 is a schematic illustration of the modified pGI binary plasmid (pQXNc) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (pqfnc; SEQ ID NO: 4107). The isolated polynucleotide sequences of some embodiments of the invention were cloned into the MCS (Multiple cloning site) of the vector.

The modified pGI vectors [pQXNc (FIG. 8); or pQFN (FIG. 2), pQFNc (FIG. 2) or pQYN_6669 (FIG. 1)] were modified versions of the pGI vector in which the cassette was inverted between the left and right borders so the gene and its corresponding promoter were close to the right border and the NPTII gene was close to the left border.

At6669, the *Arabidopsis thaliana* promoter sequence (SEQ ID NO: 4111) was inserted in the modified pGI binary vector, upstream to the cloned genes, followed by DNA ligation and binary plasmid extraction from positive *E. coli* colonies, as described above.

Colonies were analyzed by PCR using the primers covering the insert which are designed to span the introduced promoter and gene. Positive plasmids were identified, isolated and sequenced.

Selected genes cloned by the present inventors are provided in Table 55 below.

TABLE 55

Genes cloned in high copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYD521 | pUC19c_LYD521 | Arabidopsis thaliana | 4123, 4267, 4411, 4508 | 202 | 362 |
| LYD522 | pUC19c_LYD522 | Arabidopsis thaliana | 4124, 4268, 4412, 4509 | 203 | 363 |
| LYD524 | pUC19c_LYD524 | Arabidopsis thaliana | 4125, 4269, 4413, 4510 | 204 | 364 |
| LYD525_GA | pMA-RQ_LYD525_GA | GENEART ® | | 205 | 365 |
| LYD526 | pUC19c_LYD526 | Arabidopsis thaliana | 4126, 4270, 4414, 4511 | 206 | 366 |
| LYD527 | pUC19c_LYD527 | Arabidopsis thaliana | 4127, 4271, 4127, 4271 | 207 | 547 |
| LYD528 | pUC19c_LYD528 | Arabidopsis thaliana | 4128, 4272, 4415, 4512 | 208 | 368 |
| LYD529 | TopoB_LYD529 | Arabidopsis thaliana | 4129, 4273, 4416, 4513 | 209 | 369 |
| LYD530 | TopoB_LYD530 | Arabidopsis thaliana | 4130, 4274, 4417, 4514 | 210 | 548 |
| LYD531 | pUC19c_LYD531 | Arabidopsis thaliana | 4131, 4275, 4418, 4515 | 211 | 371 |
| LYD532 | pUC19c_LYD532 | Arabidopsis thaliana | 4132, 4276, 4132, 4276 | 212 | 549 |
| LYD533 | pUC19c_LYD533 | Arabidopsis thaliana | 4133, 4277, 4419, 4516 | 213 | 373 |
| LYD534 | pQFNc_LYD534 | Arabidopsis thaliana | 4134, 4278, 4134, 4278 | 214 | 374 |
| LYD535 | pQFNc_LYD535 | Arabidopsis thaliana | 4135, 4279, 4420, 4517 | 215 | 375 |
| LYD536 | pUC19c_LYD536 | Arabidopsis thaliana | 4136, 4280, 4136, 4280 | 216 | 376 |
| LYD537 | pUC19c_LYD537 | Brassica juncea | 4137, 4281, 4137, 4281 | 217 | 550 |

TABLE 55-continued

Genes cloned in high copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYD538 | pQFNc_LYD538 | Brassica juncea | 4138, 4282, 4138, 4518 | 218 | 378 |
| LYD539_H11_GA | pMA_LYD539_H11_GA | GENEART ® | | 361 | 526 |
| LYD540 | pJET_LYD540 | Brassica juncea | 4139, 4283, 4421, 4519 | 219 | 551 |
| LYD541_GA | pMA_LYD541_GA | GENEART ® | | 220 | 381 |
| LYD542 | pUC19c_LYD542 | Brachypodium distachyon | 4140, 4284, 4422, 4520 | 221 | 382 |
| LYD543 | pQFNc_LYD543 | Brachypodium distachyon | 4141, 4285, 4423, 4521 | 222 | 552 |
| LYD545 | pQFNc_LYD545 | Brachypodium distachyon | 4142, 4286, 4424, 4522 | 223 | 385 |
| LYD546 | TopoB_LYD546 | Brachypodium distachyon | 4143, 4287, 4143, 4287 | 224 | 386 |
| LYD547 | pQFNc_LYD547 | CANOLA Brassica napus | 4144, 4288, 4425, 4523 | 225 | 387 |
| LYD548 | pQFNc_LYD548 | CANOLA Brassica napus | 4145, 4289, 4426, 4524 | 226 | 553 |
| LYD549 | pQFNc_LYD549 | CANOLA Brassica napus | 4146, 4290, 4146, 4290 | 227 | 554 |
| LYD550 | pUC19c_LYD550 | CANOLA Brassica napus | 4147, 4291, 4427, 4525 | 228 | 555 |
| LYD551 | pQFNc_LYD551 | CANOLA Brassica napus | 4148, 4292, 4428, 4526 | 229 | 391 |
| LYD552 | pQFNc_LYD552 | CANOLA Brassica napus | 4149, 4293, 4149, 4293 | 230 | 392 |
| LYD553 | pUC19c_LYD553 | CANOLA Brassica napus | 4150, 4294, 4429, 4527 | 231 | 556 |
| LYD554 | pUC19c_LYD554 | Gossypium barbadense | 4151, 4295, 4430, 4528 | 232 | 557 |
| LYD555 | pJET_LYD555 | Gossypium barbadense | 4152, 4296 | 233 | 558 |
| LYD556_GA | pMA-T_LYD556_GA | GENEART ® | | 234 | 396 |
| LYD558_GA | pMA_LYD558_GA | GENEART ® | | 235 | 397 |
| LYD559 | pQFNc_LYD559 | Medicago trancatula | 4153, 4297, 4153, 4297 | 236 | 559 |
| LYD560 | pUC19c_LYD560 | Medicago trancatula | 4154, 4298, 4431, 4529 | 237 | 560 |
| LYD561 | pUC19c_LYD561 | Medicago trancatula | 4155, 4299, 4432, 4530 | 238 | 400 |
| LYD562_GA | pMA-RQ_LYD562_GA | GENEART ® | | 239 | 401 |
| LYD563 | pUC19c_LYD563 | Medicago trancatula | 4156, 4300, 4433, 4531 | 240 | 402 |
| LYD564 | pUC19c_LYD564 | Medicago trancatula | 4157, 4301, 4157, 4301 | 241 | 403 |
| LYD565_GA | pMA_LYD565_GA | GENEART ® | | 242 | 404 |
| LYD566 | pQFNc_LYD566 | Medicago trancatula | 4158, 4302, 4158, 4302 | 243 | 561 |
| LYD567 | pQFNc_LYD567 | Medicago trancatula | 4159, 4303, 4159, 4303 | 244 | 406 |
| LYD568 | pUC19c_LYD568 | Medicago trancatula | 4160, 4304, 4434, 4532 | 245 | 407 |
| LYD570 | pUC19c_LYD570 | Medicago trancatula | 4161, 4305, 4435, 4533 | 246 | 562 |
| LYD571 | pUC19c_LYD571 | Medicago trancatula | 4162, 4306, 4162, 4306 | 247 | 563 |
| LYD572 | pQFNc_LYD572 | Medicago trancatula | 4163, 4307, 4436, 4534 | 248 | 564 |
| LYD573_GA | pMA-T_LYD573_GA | GENEART ® | | 249 | 411 |
| LYD574_GA | pMA-RQ_LYD574_GA | GENEART ® | | 250 | 412 |
| LYD575 | TopoB_LYD575 | Medicago trancatula | 4164, 4308, 4437, 4535 | 251 | 565 |
| LYD576_GA | pMA-T_LYD576_GA | GENEART ® | | 252 | 414 |
| LYD577 | pUC19c_LYD577 | Medicago trancatula | 4165, 4309, 4438, 4536 | 253 | 566 |
| LYD578 | pUC19c_LYD578 | Medicago trancatula | 4166, 4310, 4439, 4537 | 254 | 567 |
| LYD579 | pUC19c_LYD579 | Medicago trancatula | 4167, 4311, 4167, 4311 | 255 | 568 |
| LYD580 | pUC19c_LYD580 | Medicago trancatula | 4168, 4312, 4440, 4538 | 256 | 569 |
| LYD581_GA | pMA_LYD581_GA | GENEART ® | | 257 | 419 |
| LYD583 | pUC19c_LYD583 | Medicago trancatula | 4169, 4313, 4441, 4539 | 258 | 570 |
| LYD584 | pUC19c_LYD584 | Medicago trancatula | 4170, 4314, 4170, 4314 | 259 | 421 |
| LYD585_GA | pMA-T_LYD585_GA | GENEART ® | | 260 | 422 |
| LYD586 | pUC19c_LYD586 | Medicago trancatula | 4171, 4315, 4171, 4315 | 261 | 423 |
| LYD587 | pUC19c_LYD587 | Medicago trancatula | 4172, 4316, 4172, 4316 | 262 | 571 |
| LYD588 | pQFNc_LYD588 | Medicago trancatula | 4173, 4317, 4173, 4317 | 263 | 572 |
| LYD589 | pQFNc_LYD589 | Medicago trancatula | 4174, 4318, 4174, 4318 | 264 | 573 |
| LYD591 | pQFNc_LYD591 | Medicago trancatula | 4175, 4319, 4175, 4319 | 265 | 574 |
| LYD592 | TopoB_LYD592 | Medicago trancatula | 4176, 4320, 4176, 4320 | 266 | 575 |
| LYD593 | pUC19c_LYD593 | Medicago trancatula | 4177, 4321, 4442, 4540 | 267 | 576 |
| LYD594 | pQFNc_LYD594 | Medicago trancatula | 4178, 4322, 4178, 4322 | 268 | 577 |
| LYD595 | pUC19c_LYD595 | Oryza sativa L. | 4179, 4323, 4443, 4541 | 269 | 432 |
| LYD596 | pJET_LYD596 | Oryza sativa L. | 4180, 4324, 4444, 4542 | 270 | 433 |
| LYD597 | pQFNc_LYD597 | Oryza sativa L. | 4181, 4325, 4445, 4543 | 271 | 434 |
| LYD598 | pQFNc_LYD598 | Oryza sativa L. | 4182, 4326, 4446, 4544 | 272 | 435 |
| LYD599 | pQFNc_LYD599 | Oryza sativa L. | 4183, 4327, 4447, 4545 | 273 | 436 |
| LYD600_GA | pMA-RQ_LYD600_GA | GENEART ® | | 274 | 437 |
| LYD601 | pUC19c_LYD601 | Oryza sativa L. | 4184, 4328, 4448, 4546 | 275 | 438 |
| LYD602 | pUC19c_LYD602 | Oryza sativa L. | 4185, 4329, 4449, 4547 | 276 | 439 |
| LYD603 | pUC19c_LYD603 | Oryza sativa L. | 4186, 4330, 4186, 4330 | 277 | 440 |
| LYD604 | pQFNc_LYD604 | Sorghum bicolor | 4187, 4331, 4187, 4331 | 278 | 441 |
| LYD605 | pUC19c_LYD605 | Sorghum bicolor | 4188, 4332, 4188, 4332 | 279 | 578 |
| LYD606 | pQFNc_LYD606 | Sorghum bicolor | 4189, 4333, 4189, 4333 | 280 | 443 |
| LYD607 | pUC19c_LYD607 | Sorghum bicolor | 4190, 4334, 4450, 4548 | 281 | 444 |
| LYD608 | pUC19c_LYD608 | Sorghum bicolor | 4191, 4335, 4451, 4549 | 282 | 445 |
| LYD609 | pUC19c_LYD609 | Sorghum bicolor | 4192, 4336, 4192, 4336 | 283 | 446 |
| LYD610 | TopoB_LYD610 | Sorghum bicolor | 4193, 4337, 4193, 4337 | 284 | 447 |
| LYD611 | pQFNc_LYD611 | Glycine max | 4194, 4338, 4194, 4550 | 285 | 448 |
| LYD612 | pQFNc_LYD612 | Glycine max | 4195, 4339, 4452, 4551 | 286 | 449 |
| LYD613 | pQFNc_LYD613 | Glycine max | 4196, 4340, 4453, 4552 | 287 | 450 |
| LYD614_GA | pMA-RQ_LYD614_GA | GENEART ® | | 288 | 451 |
| LYD615 | pUC19c_LYD615 | Glycine max | 4197, 4341, 4454, 4553 | 289 | 452 |
| LYD616 | pUC19c_LYD616 | Glycine max | 4198, 4342, 4198, 4342 | 290 | 453 |

TABLE 55-continued

Genes cloned in high copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYD617 | pUC19c_LYD617 | *Glycine max* | 4199, 4343, 4455, 4554 | 291 | 454 |
| LYD618 | pUC19c_LYD618 | *Glycine max* | 4200, 4344, 4456, 4555 | 292 | 579 |
| LYD619 | pUC19c_LYD619 | *Glycine max* | 4201, 4345, 4457, 4556 | 293 | 580 |
| LYD620 | pUC19c_LYD620 | *Glycine max* | 4202, 4346, 4202, 4346 | 294 | 457 |
| LYD621 | pUC19c_LYD621 | *Glycine max* | 4203, 4347, 4458, 4557 | 295 | 458 |
| LYD622 | pUC19c_LYD622 | *Glycine max* | 4204, 4348, 4459, 4558 | 296 | 459 |
| LYD623 | pUC19c_LYD623 | *Glycine max* | 4205, 4349, 4205, 4349 | 297 | 460 |
| LYD624 | pQFNc_LYD624 | *Glycine max* | 4206, 4350, 4460, 4559 | 298 | 461 |
| LYD625 | pUC19c_LYD625 | *Glycine max* | 4207, 4351, 4461, 4560 | 299 | 462 |
| LYD626 | pUC19c_LYD626 | *Glycine max* | 4208, 4352, 4462, 4561 | 300 | 463 |
| LYD627 | pUC19c_LYD627 | *Glycine max* | 4209, 4353, 4463, 4562 | 301 | 464 |
| LYD628 | pQFNc_LYD628 | *Glycine max* | 4210, 4354, 4210, 4354 | 302 | 465 |
| LYD629 | pUC19c_LYD629 | *Glycine max* | 4211, 4355, 4464, 4563 | 303 | 466 |
| LYD630 | pUC19c_LYD630 | *Glycine max* | 4212, 4356, 4465, 4564 | 304 | 467 |
| LYD631 | pUC19c_LYD631 | *Glycine max* | 4213, 4357, 4213, 4357 | 305 | 468 |
| LYD632 | pUC19c_LYD632 | *Glycine max* | 4214, 4358, 4466, 4565 | 306 | 581 |
| LYD633p | pQFNc_LYD633p | *Glycine max* | 4215, 4359, 4215, 4359 | 307 | 470 |
| LYD634 | pQFNc_LYD634 | *Glycine max* | 4216, 4360, 4467, 4566 | 308 | 471 |
| LYD635 | pUC19c_LYD635 | *Glycine max* | 4217, 4361, 4468, 4567 | 309 | 472 |
| LYD636 | pUC19c_LYD636 | *Glycine max* | 4218, 4362, 4469, 4568 | 310 | 473 |
| LYD637 | pQFNc_LYD637 | *Glycine max* | 4219, 4363, 4219, 4363 | 311 | 582 |
| LYD638 | pQFNc_LYD638 | *Glycine max* | 4220, 4364, 4220, 4364 | 312 | 475 |
| LYD639 | pUC19c_LYD639 | *Glycine max* | 4221, 4365, 4470, 4569 | 313 | 476 |
| LYD640 | pUC19c_LYD640 | *Glycine max* | 4222, 4366, 4471, 4570 | 314 | 477 |
| LYD641 | pUC19c_LYD641 | *Glycine max* | 4223, 4367, 4472, 4571 | 315 | 583 |
| LYD642 | pQFNc_LYD642 | *Glycine max* | 4224, 4368, 4473, 4572 | 316 | 479 |
| LYD643 | pUC19c_LYD643 | *Glycine max* | 4225, 4369, 4474, 4573 | 317 | 480 |
| LYD644 | pUC19c_LYD644 | *Glycine max* | 4226, 4370, 4226, 4370 | 318 | 481 |
| LYD645 | pUC19c_LYD645 | *Glycine max* | 4227, 4371, 4475, 4574 | 319 | 482 |
| LYD646 | pUC19c_LYD646 | *Glycine max* | 4228, 4372, 4228, 4372 | 320 | 584 |
| LYD647 | pUC19c_LYD647 | *Glycine max* | 4229, 4373, 4476, 4575 | 321 | 484 |
| LYD648 | pQFNc_LYD648 | *Lycopersicum* ND | 4230, 4374, 4477, 4576 | 322 | 485 |
| LYD650 | pUC19c_LYD650 | *Lycopersicum* ND | 4231, 4375, 4478, 4577 | 323 | 585 |
| LYD651 | pQFNc_LYD651 | *Lycopersicum* ND | 4232, 4376, 4232, 4376 | 324 | 586 |
| LYD652 | pUC19c_LYD652 | *Lycopersicum* ND | 4233, 4377, 4479, 4578 | 325 | 587 |
| LYD654_GA | pMA-RQ_LYD654_GA | GeneArt ® | | 326 | 490 |
| LYD655 | pUC19c_LYD655 | *Lycopersicum* ND | 4234, 4378, 4480, 4579 | 327 | 491 |
| LYD657 | pUC19c_LYD657 | *Lycopersicum* ND | 4235, 4379, 4481, 4580 | 328 | 492 |
| LYD658 | pUC19c_LYD658 | *Lycopersicum* ND | 4236, 4380, 4482, 4581 | 329 | 493 |
| LYD659_GA | pMA_LYD659_GA | GeneArt ® | | 330 | 494 |
| LYD660 | pUC19c_LYD660 | *Lycopersicum* ND | 4237, 4381, 4237, 4381 | 331 | 588 |
| LYD661 | pUC19c_LYD661 | *Lycopersicum* ND | 4238, 4382, 4483, 4582 | 332 | 496 |
| LYD662 | pUC19c_LYD662 | *Lycopersicum* ND | 4239, 4383, 4484, 4583 | 333 | 497 |
| LYD663 | pQFNc_LYD663 | *Lycopersicum* ND | 4240, 4384, 4485, 4584 | 334 | 498 |
| LYD664 | pUC19c_LYD664 | *Lycopersicum* ND | 4241, 4385, 4486, 4585 | 335 | 499 |
| LYD665 | pUC19c_LYD665 | *Lycopersicum* ND | 4242, 4386, 4487, 4586 | 336 | 589 |
| LYD666 | pUC19c_LYD666 | *Lycopersicum* ND | 4243, 4387, 4243, 4387 | 337 | 590 |
| LYD667 | pUC19c_LYD667 | *Lycopersicum* ND | 4244, 4388, 4488, 4588 | 338 | 591 |
| LYD668 | pUC19c_LYD668 | *Lycopersicum* ND | 4245, 4389, 4489, 4589 | 339 | 592 |
| LYD669 | pUC19c_LYD669 | *Lycopersicum* ND | 4246, 4390, 4490, 4590 | 340 | 504 |
| LYD670 | pQFNc_LYD670 | *Lycopersicum* ND | 4247, 4391, 4491, 4591 | 341 | 505 |
| LYD671 | pQFNc_LYD671 | *Lycopersicum* ND | 4248, 4392, 4248, 4392 | 342 | 593 |
| LYD672 | pUC19c_LYD672 | *Lycopersicum* ND | 4249, 4393, 4492, 4592 | 343 | 507 |
| LYD673 | pQFNc_LYD673 | *Lycopersicum* ND | 4250, 4394, 4493, 4593 | 344 | 594 |
| LYD674 | pQFNc_LYD674 | *Lycopersicum* ND | 4251, 4395, 4494, 4594 | 345 | 509 |
| LYD675 | pUC19c_LYD675 | *Lycopersicum* ND | 4252, 4396, 4495, 4595 | 346 | 595 |
| LYD676 | pQFNc_LYD676 | *Lycopersicum* ND | 4253, 4397, 4496, 4596 | 347 | 596 |
| LYD677 | pUC19c_LYD677 | *Lycopersicum* ND | 4254, 4398, 4497, 4597 | 348 | 512 |
| LYD678 | pUC19c_LYD678 | *Lycopersicum* ND | 4255, 4399, 4498, 4598 | 349 | 513 |
| LYD679 | pUC19c_LYD679 | *Lycopersicum* ND | 4256, 4400, 4499, 4599 | 350 | 597 |
| LYD680 | pUC19c_LYD680 | *Lycopersicum* ND | 4257, 4401, 4257, 4401 | 351 | 598 |
| LYD681 | pQFNc_LYD681 | *Lycopersicum* ND | 4258, 4402, 4500, 4601 | 352 | 516 |
| LYD682 | pUC19c_LYD682 | *Lycopersicum* ND | 4259, 4403, 4501, 4602 | 353 | 517 |
| LYD683 | pUC19c_LYD683 | *Lycopersicum* ND | 4260, 4404, 4502, 4603 | 354 | 599 |
| LYD684 | pQFNc_LYD684 | *Lycopersicum* ND | 4261, 4405, 4503, 4604 | 355 | 519 |
| LYD685 | pQFNc_LYD685 | *Lycopersicum* ND | 4262, 4406, 4504, 4605 | 356 | 600 |
| LYD686 | pUC19c_LYD686 | *Lycopersicum* ND | 4263, 4407, 4505, 4606 | 357 | 521 |
| LYD688 | pQFNc_LYD688 | *Lycopersicum* ND | 4264, 4408, 4264, 4408 | 358 | 601 |

TABLE 55-continued

Genes cloned in high copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYD689 | pQFNc_LYD689 | Lycopersicum ND | 4265, 4409, 4506, 4607 | 359 | 524 |
| LYD690 | TopoB_LYD690 | Lycopersicum ND | 4266, 4410, 4507, 4608 | 360 | 525 |

Table 55.
"Polyn."—Polynucleotide;
"Polyp."—polypeptide.
For cloning of each gene at least 2 primers were used: Forward (Fwd) or Reverse (Rev).
In some cases, 4 primers were used: External forward (EF), External reverse (ER), nested forward (NF) or nested reverse (NR).
The sequences of the primers used for cloning the genes are provided in the sequence listing. The genes were cloned from the same organism as identified in the list of genes provided in Table 62 above, except for the genes that were synthetically produced by GENEART (Life Technologies Corporation).

Example 15

Evaluation of Transgenic Arabidopsis for Seed Yield and Plant Growth Rate Under Normal Conditions in Greenhouse Assays (GH-SM Assays)

Assay 1: Seed yield plant biomass and plant growth rate under normal greenhouse conditions—This assay follows seed yield production, the biomass formation and the rosette area growth of plants grown in the greenhouse at non-limiting nitrogen growth conditions. Transgenic Arabidopsis seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weight. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter and the selectable marker was used as control.

The plants were analyzed for their overall size, growth rate, flowering, seed yield, 1,000-seed weight, dry matter and harvest index (HI-seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs are square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number [Formula IX (described above)], rosette area [Formula VIII (described above)], plot coverage (Formula XIV, below) and harvest index [Formula IV (described above)] was calculated with the indicated formulas.

Relative growth rate of plot coverage=Regression coefficient of plot coverage along time course.   Formula XIV Seeds average weight—At the end of the experiment all seeds were collected. The seeds were scattered on a glass tray and a picture was taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr); 1000 seed weight (the weight of 1000 seeds) (gr.).

The harvest index (HI) was calculated using Formula IV as described above.

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra-Oxford Instrument) and its MultiQuant software package Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Tables 56-60 summarize the observed phenotypes of transgenic plants exogenously expressing the gene constructs using the seed maturation (GH-SM) assays under normal conditions. Transgenic plants expressing these genes exhibit higher biomass (Tables 56, 57, 59), yield (Tables 59 and 60), vigor (Table 58), growth rate (Table 58), as compared to control plants grown under identical growth conditions. The evaluation of each gene was performed by testing the performance of different number of events. Event with p-value <0.1 was considered statistically significant.

TABLE 56

Genes showing improved plant performance at Normal growth conditions under regulation of At6669 promoter

| Gene | | Dry Weight [mg] | | | Flowering (days) | | | Inflorescence Emergence (days) | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD689 | 72710.2 | — | — | — | 39.7 | 0.25 | −3 | 34.1 | 0.07 | −3 |
| LYD689 | 72711.2 | 1157.7 | 0.15 | 12 | 37.9 | L | −8 | 34.1 | 0.06 | −3 |
| LYD689 | 72713.1 | — | — | — | 40.3 | 0.22 | −2 | 34.5 | 0.17 | −2 |
| LYD677 | 72223.1 | — | — | — | — | — | — | 34.2 | 0.08 | −3 |
| LYD677 | 72223.6 | — | — | — | 39.3 | 0.10 | −4 | 34.3 | 0.12 | −3 |
| LYD677 | 72227.1 | — | — | — | 39.5 | 0.13 | −4 | 34.1 | 0.07 | −3 |
| LYD675 | 72644.3 | — | — | — | — | — | — | 34.6 | 0.23 | −2 |
| LYD648 | 72834.2 | 1073.6 | 0.28 | 4 | — | — | — | — | — | — |
| LYD641 | 72632.2 | — | — | — | — | — | — | 34.1 | 0.07 | −3 |
| LYD641 | 72635.2 | — | — | — | — | — | — | 34.2 | 0.09 | −3 |
| LYD636 | 72204.1 | — | — | — | 40.4 | 0.28 | −2 | 34.1 | 0.06 | −3 |
| LYD625 | 72752.4 | — | — | — | 40.3 | 0.23 | −2 | 34.5 | 0.17 | −2 |
| LYD625 | 72755.1 | 1166.7 | 0.05 | 13 | — | — | — | — | — | — |
| LYD611 | 71991.1 | — | — | — | — | — | — | 34.5 | 0.18 | −2 |
| LYD611 | 71992.6 | — | — | — | — | — | — | 34.7 | 0.28 | −2 |
| LYD602 | 72613.3 | — | — | — | — | — | — | 34.3 | 0.12 | −3 |
| LYD599 | 72270.5 | — | — | — | 39.3 | 0.05 | −4 | 34.5 | 0.18 | −2 |
| CONT. | — | 1033.1 | — | — | 41.0 | — | — | 35.3 | — | — |
| LYD667 | 72030.1 | 1106.2 | 0.02 | 19 | — | — | — | — | — | — |
| LYD667 | 72035.2 | — | — | — | — | — | — | 34.1 | 0.21 | −5 |
| LYD667 | 72035.6 | — | — | — | — | — | — | 34.5 | 0.13 | −4 |
| LYD635 | 72626.1 | 1004.8 | 0.22 | 8 | — | — | — | — | — | — |
| LYD635 | 72626.2 | 1100.0 | 0.02 | 18 | — | — | — | — | — | — |
| LYD635 | 72630.2 | 1081.2 | 0.13 | 16 | 42.8 | 0.19 | −2 | 35.2 | 0.29 | −2 |
| LYD635 | 72630.4 | 1083.8 | 0.04 | 16 | 42.0 | 0.13 | −4 | 34.5 | 0.10 | −4 |
| LYD632 | 72771.1 | 1086.5 | 0.07 | 17 | — | — | — | — | — | — |
| LYD632 | 72774.4 | 1129.4 | 0.02 | 21 | — | — | — | — | — | — |
| LYD631 | 72542.3 | — | — | — | 41.4 | 0.13 | −5 | 33.2 | L | −7 |
| LYD627 | 72764.3 | 1070.4 | 0.21 | 15 | — | — | — | — | — | — |
| LYD627 | 72765.1 | 1031.9 | 0.16 | 11 | — | — | — | — | — | — |
| LYD627 | 72766.1 | 1190.6 | 0.08 | 28 | — | — | — | — | — | — |
| LYD623 | 71970.2 | 1049.4 | 0.07 | 13 | 41.5 | L | −5 | 34.5 | 0.01 | −4 |
| LYD623 | 71970.4 | 1027.5 | 0.14 | 10 | 42.2 | 0.06 | −3 | 34.3 | 0.26 | −4 |
| LYD623 | 71972.3 | 1057.5 | 0.09 | 14 | — | — | — | — | — | — |
| LYD623 | 71974.1 | 1199.4 | L | 29 | — | — | — | — | — | — |
| LYD621 | 72573.3 | — | — | — | 42.6 | 0.07 | −2 | 33.9 | 0.02 | −5 |
| LYD621 | 72574.1 | 1111.9 | 0.27 | 19 | — | — | — | — | — | — |
| LYD618 | 72622.2 | 1121.2 | 0.02 | 20 | — | — | — | — | — | — |
| LYD618 | 72623.1 | 1026.5 | 0.25 | 10 | — | — | — | — | — | — |
| LYD618 | 72624.4 | 1070.6 | 0.11 | 15 | 41.3 | 0.08 | −5 | 34.3 | 0.14 | −4 |
| LYD612 | 71818.3 | 1065.5 | 0.05 | 14 | 42.8 | 0.18 | −2 | — | — | — |
| LYD603 | 72536.2 | 1036.2 | 0.10 | 11 | — | — | — | — | — | — |
| LYD603 | 72537.3 | — | — | — | 42.8 | 0.19 | −2 | 35.2 | 0.16 | −2 |
| LYD603 | 72537.5 | — | — | — | 41.1 | 0.20 | −5 | — | — | — |
| LYD603 | 72537.7 | 1131.9 | 0.03 | 22 | — | — | — | — | — | — |
| LYD593 | 71953.4 | 1041.2 | 0.10 | 12 | — | — | — | — | — | — |
| LYD585 | 72986.1 | 1158.8 | 0.16 | 24 | 43.0 | 0.25 | −1 | — | — | — |
| LYD585 | 72986.2 | 1137.5 | L | 22 | 42.9 | 0.19 | −1 | — | — | — |
| LYD585 | 72986.4 | 1116.2 | 0.02 | 20 | — | — | — | — | — | — |
| LYD585 | 72988.1 | 1083.1 | 0.22 | 16 | — | — | — | — | — | — |
| LYD585 | 72988.3 | 1048.8 | 0.08 | 13 | — | — | — | — | — | — |
| LYD572 | 72385.1 | 1126.9 | 0.01 | 21 | 41.8 | 0.29 | −4 | 34.4 | L | −4 |
| LYD571 | 72357.5 | — | — | — | 41.5 | 0.18 | −5 | 33.6 | 0.02 | −6 |
| LYD571 | 72358.3 | — | — | — | 40.6 | L | −7 | 32.6 | L | −9 |
| LYD571 | 72360.2 | 1095.0 | 0.06 | 18 | 41.4 | L | −5 | — | — | — |

TABLE 56-continued

Genes showing improved plant performance at Normal growth conditions under regulation of At6669 promoter

| Gene Name | Event # | Dry Weight [mg] | | | Flowering (days) | | | Inflorescence Emergence (days) | | |
|---|---|---|---|---|---|---|---|---|---|---|
| | | Ave. | P-Val. | % Incr. | Ave. | P-Val. | % Incr. | Ave. | P-Val. | % Incr. |
| LYD551 | 71984.1 | 1171.9 | 0.17 | 26 | — | — | — | — | — | — |
| LYD551 | 71986.4 | 1185.0 | 0.06 | 27 | 40.5 | L | −7 | 33.1 | L | −8 |
| LYD551 | 71986.7 | 1078.8 | 0.03 | 16 | 42.8 | 0.19 | −2 | 35.0 | 0.07 | −2 |
| LYD551 | 71986.9 | 1027.5 | 0.14 | 10 | — | — | — | — | — | — |
| LYD548 | 72656.1 | 1006.9 | 0.21 | 8 | 42.8 | 0.19 | −2 | — | — | — |
| LYD548 | 72656.2 | 1117.6 | 0.13 | 20 | — | — | — | — | — | — |
| LYD548 | 72676.1 | — | — | — | 42.9 | 0.21 | −1 | 35.1 | 0.15 | −2 |
| LYD548 | 72677.1 | 1168.8 | L | 26 | — | — | — | 34.1 | 0.21 | −5 |
| LYD531 | 71916.1 | — | — | — | — | — | — | 34.1 | 0.21 | −5 |
| LYD531 | 71917.1 | 1026.9 | 0.13 | 10 | 41.9 | 0.07 | −4 | 33.5 | 0.05 | −7 |
| LYD531 | 71917.2 | 1160.6 | 0.06 | 25 | — | — | — | — | — | — |
| LYD531 | 71921.2 | — | — | — | 41.4 | L | −5 | 33.5 | L | −7 |
| LYD527 | 72241.3 | 1016.9 | 0.28 | 9 | 41.9 | 0.15 | −4 | 33.9 | 0.25 | −5 |
| LYD527 | 72243.3 | — | — | — | 42.4 | 0.05 | −2 | 35.1 | 0.14 | −2 |
| LYD527 | 72245.2 | — | — | — | 42.1 | 0.02 | −3 | 34.2 | 0.28 | −5 |
| LYD527 | 72246.3 | 1131.9 | L | 22 | 41.6 | 0.10 | −4 | 33.9 | 0.18 | −5 |
| CONT. | — | 930.8 | — | — | 43.5 | — | — | 35.9 | — | — |
| LYD684 | 72271.2 | — | — | — | 40.5 | 0.21 | −4 | — | — | — |
| LYD684 | 72274.3 | — | — | — | 39.9 | L | −5 | 32.3 | 0.29 | −7 |
| LYD666 | 72391.3 | — | — | — | 41.1 | 0.11 | −3 | — | — | — |
| LYD666 | 72393.1 | — | — | — | 40.5 | 0.10 | −4 | — | — | — |
| LYD666 | 72394.5 | — | — | — | 40.2 | 0.01 | −5 | 33.0 | 0.05 | −5 |
| LYD666 | 72396.2 | 1208.1 | 0.19 | 1 | — | — | — | 33.3 | 0.11 | −4 |
| LYD662 | 72008.3 | — | — | — | 39.8 | 0.03 | −6 | 32.0 | 0.16 | −7 |
| LYD662 | 72011.2 | — | — | — | 41.0 | 0.10 | −3 | — | — | — |
| LYD662 | 72011.4 | — | — | — | 40.3 | 0.14 | −4 | — | — | — |
| LYD658 | 72279.1 | — | — | — | 41.0 | 0.08 | −3 | — | — | — |
| LYD645 | 72341.2 | — | — | — | 41.3 | 0.15 | −2 | 33.4 | 0.12 | −3 |
| LYD632 | 72771.1 | — | — | — | — | — | — | 33.4 | 0.12 | −3 |
| LYD632 | 72774.3 | 1219.4 | 0.04 | 8 | — | — | — | — | — | — |
| LYD631 | 72541.2 | — | — | — | — | — | — | 33.6 | 0.17 | −3 |
| LYD631 | 72544.1 | — | — | — | 40.7 | 0.06 | −4 | — | — | — |
| LYD631 | 72544.4 | — | — | — | 41.3 | 0.22 | −2 | 33.3 | 0.11 | −4 |
| LYD627 | 72766.1 | — | — | — | 40.3 | 0.02 | −5 | 32.0 | 0.16 | −7 |
| LYD627 | 72766.2 | — | — | — | — | — | — | 33.6 | 0.17 | −3 |
| LYD627 | 72767.1 | — | — | — | 40.2 | 0.18 | −5 | — | — | — |
| LYD586 | 71947.4 | — | — | — | — | — | — | 33.4 | 0.12 | −3 |
| LYD586 | 71949.6 | — | — | — | 40.6 | 0.07 | −4 | 33.3 | 0.09 | −4 |
| LYD586 | 71949.7 | — | — | — | 40.5 | 0.10 | −4 | 33.0 | 0.05 | −5 |
| LYD571 | 72357.5 | — | — | — | 40.8 | 0.13 | −3 | — | — | — |
| LYD571 | 72358.3 | 1205.0 | 0.07 | 7 | 39.9 | 0.24 | −6 | 30.6 | L | −12 |
| LYD571 | 72358.4 | — | — | — | 39.3 | L | −7 | 32.1 | 0.23 | −7 |
| LYD571 | 72360.2 | — | — | — | 40.6 | 0.07 | −4 | — | — | — |
| LYD570 | 71934.2 | — | — | — | — | — | — | 33.4 | 0.12 | −3 |
| LYD570 | 71936.2 | — | — | — | 40.7 | 0.15 | −3 | 33.3 | 0.09 | −4 |
| LYD570 | 71938.2 | — | — | — | 40.2 | 0.01 | −5 | 33.3 | 0.11 | −4 |
| LYD564 | 72182.4 | — | — | — | 39.6 | L | −6 | 31.7 | 0.29 | −8 |
| LYD564 | 72182.5 | — | — | — | — | — | — | 33.3 | 0.09 | −4 |
| LYD564 | 72185.1 | — | — | — | 40.7 | 0.06 | −4 | 33.3 | 0.11 | −4 |
| LYD564 | 72186.2 | — | — | — | 40.5 | 0.10 | −4 | — | — | — |
| LYD560 | 71924.1 | — | — | — | — | — | — | 33.6 | 0.17 | −3 |
| LYD560 | 71925.1 | — | — | — | 39.9 | L | −5 | 33.0 | 0.05 | −5 |
| LYD560 | 71926.1 | — | — | — | 41.2 | 0.12 | −2 | — | — | — |
| LYD560 | 71927.1 | — | — | — | 40.9 | 0.26 | −3 | — | — | — |
| LYD545 | 72510.2 | — | — | — | 40.0 | 0.01 | −5 | 33.1 | 0.06 | −4 |
| LYD543 | 72251.2 | — | — | — | — | — | — | 31.8 | 0.28 | −8 |
| LYD543 | 72252.1 | — | — | — | 39.6 | L | −6 | 31.8 | 0.20 | −8 |
| CONT. | — | 1124.2 | — | — | 42.2 | — | — | 34.6 | — | — |
| LYD672 | 72346.4 | — | — | — | 41.5 | 0.14 | −2 | 32.9 | 0.10 | −5 |
| LYD672 | 72347.3 | — | — | — | 40.7 | 0.06 | −4 | 32.8 | 0.03 | −6 |
| LYD672 | 72348.1 | — | — | — | 41.0 | 0.21 | −4 | 33.2 | 0.06 | −5 |
| LYD668 | 72020.2 | 1169.4 | L | 15 | — | — | — | — | — | — |
| LYD664 | 72015.2 | — | — | — | 40.9 | 0.04 | −4 | 32.8 | L | −6 |
| LYD664 | 72016.2 | — | — | — | 40.6 | 0.24 | −5 | 31.6 | 0.28 | −9 |
| LYD664 | 72017.8 | 1065.6 | 0.12 | 5 | — | — | — | — | — | — |
| LYD661 | 72325.1 | 1112.5 | 0.20 | 10 | — | — | — | — | — | — |
| LYD661 | 72325.4 | — | — | — | 40.1 | L | −6 | 33.1 | 0.06 | −5 |
| LYD661 | 72326.1 | — | — | — | 40.1 | L | −6 | 32.4 | L | −7 |
| LYD661 | 72328.2 | — | — | — | 40.0 | 0.28 | −6 | 32.5 | 0.14 | −7 |
| LYD661 | 72329.2 | — | — | — | 40.2 | 0.25 | −5 | 32.8 | 0.12 | −6 |
| LYD657 | 72400.3 | — | — | — | 39.4 | 0.11 | −7 | 32.4 | L | −7 |
| LYD657 | 72402.1 | — | — | — | 41.4 | 0.01 | −3 | 33.6 | 0.02 | −3 |

TABLE 56-continued

Genes showing improved plant performance at Normal growth conditions under regulation of At6669 promoter

| Gene Name | Event # | Dry Weight [mg] Ave. | P-Val. | % Incr. | Flowering (days) Ave. | P-Val. | % Incr. | Inflorescence Emergence (days) Ave. | P-Val. | % Incr. |
|---|---|---|---|---|---|---|---|---|---|---|
| LYD580 | 72188.2 | 1070.0 | 0.09 | 5 | 40.2 | L | −6 | 32.8 | L | −6 |
| LYD580 | 72189.1 | — | — | — | — | — | — | 33.6 | 0.28 | −3 |
| LYD580 | 72189.2 | 1090.2 | 0.23 | 7 | — | — | — | — | — | — |
| LYD573 | 72973.3 | — | — | — | 41.6 | 0.11 | −2 | 34.3 | 0.25 | −1 |
| LYD561 | 72178.1 | — | — | — | 40.7 | 0.12 | −4 | — | — | — |
| LYD554 | 72169.2 | — | — | — | 41.4 | L | −3 | 33.9 | 0.16 | −2 |
| LYD553 | 72741.2 | — | — | — | 40.1 | L | −6 | 32.5 | L | −6 |
| LYD553 | 72742.3 | 1073.1 | 0.21 | 6 | — | — | — | 33.7 | 0.09 | −3 |
| LYD547 | 71978.2 | — | — | — | 40.2 | L | −6 | 32.8 | L | −6 |
| LYD547 | 71978.3 | — | — | — | — | — | — | 33.1 | 0.09 | −5 |
| LYD547 | 71980.1 | — | — | — | 39.8 | 0.08 | −6 | 32.9 | L | −5 |
| LYD547 | 71980.3 | — | — | — | 40.6 | 0.06 | −5 | 33.4 | 0.22 | −4 |
| LYD538 | 72839.5 | — | — | — | 40.8 | 0.03 | −4 | 33.7 | 0.20 | −3 |
| LYD528 | 72311.1 | — | — | — | 40.5 | 0.02 | −5 | 32.5 | 0.07 | −7 |
| LYD528 | 72312.3 | — | — | — | — | — | — | 34.2 | 0.16 | −1 |
| LYD522 | 72720.1 | — | — | — | 40.9 | 0.15 | −4 | — | — | — |
| LYD521 | 72607.1 | — | — | — | 40.0 | L | −6 | 32.4 | 0.10 | −7 |
| LYD521 | 72611.3 | — | — | — | 41.1 | 0.17 | −3 | 33.4 | 0.01 | −4 |
| CONT. | — | 1014.5 | — | — | 42.5 | — | — | 34.8 | — | — |
| LYD682 | 72566.1 | — | — | — | 41.5 | 0.05 | −2 | 34.8 | 0.03 | −3 |
| LYD682 | 72568.2 | — | — | — | 41.0 | 0.02 | −3 | — | — | — |
| LYD665 | 72211.2 | — | — | — | 40.2 | 0.06 | −5 | 34.6 | 0.14 | −4 |
| LYD665 | 72216.5 | 1077.6 | 0.18 | 6 | — | — | — | — | — | — |
| LYD650 | 72641.2 | — | — | — | 40.5 | 0.26 | −5 | — | — | — |
| LYD644 | 72775.2 | — | — | — | 40.6 | 0.23 | −4 | — | — | — |
| LYD644 | 72780.2 | — | — | — | 41.9 | 0.22 | −1 | 35.3 | 0.27 | −2 |
| LYD639 | 72548.4 | — | — | — | 41.1 | 0.06 | −3 | — | — | — |
| LYD639 | 72549.3 | 1111.9 | 0.01 | 9 | — | — | — | — | — | — |
| LYD630 | 72404.3 | 1102.1 | 0.07 | 8 | 40.0 | L | −6 | 34.7 | 0.09 | −3 |
| LYD626 | 72002.1 | 1074.4 | 0.25 | 5 | 40.6 | L | −4 | — | — | — |
| LYD606 | 72500.2 | — | — | — | 40.8 | 0.19 | −4 | — | — | — |
| LYD606 | 72500.5 | — | — | — | 41.7 | 0.15 | −2 | — | — | — |
| LYD577 | 72745.4 | — | — | — | 41.0 | 0.09 | −3 | 35.3 | 0.27 | −2 |
| LYD577 | 72750.4 | — | — | — | 40.7 | 0.19 | −4 | 34.7 | 0.09 | −3 |
| LYD542 | 72733.2 | 1153.8 | L | 13 | — | — | — | — | — | — |
| LYD526 | 72164.4 | 1081.9 | 0.07 | 6 | — | — | — | — | — | — |
| LYD526 | 72167.4 | — | — | — | 39.6 | 0.14 | −7 | 35.3 | 0.27 | −2 |
| LYD526 | 72168.1 | — | — | — | 40.6 | L | −4 | — | — | — |
| CONT. | — | 1019.8 | — | — | 42.5 | — | — | 35.9 | — | — |
| LYD683 | 72867.2 | — | — | — | — | — | — | 30.7 | 0.19 | −3 |
| LYD683 | 72867.4 | 1178.1 | 0.27 | 4 | — | — | — | — | — | — |
| LYD674 | 72253.6 | — | — | — | 38.9 | 0.05 | −2 | 30.2 | 0.06 | −5 |
| LYD674 | 72255.1 | — | — | — | — | — | — | 30.5 | 0.12 | −4 |
| LYD664 | 72015.2 | — | — | — | — | — | — | 30.7 | 0.19 | −3 |
| LYD664 | 72016.2 | — | — | — | — | — | — | 30.3 | 0.07 | −4 |
| LYD664 | 72017.8 | — | — | — | 38.2 | 0.14 | −4 | 30.1 | 0.05 | −5 |
| LYD643 | 72333.6 | 1229.9 | 0.17 | 8 | — | — | — | — | — | — |
| LYD643 | 72336.3 | — | — | — | — | — | — | 30.1 | 0.04 | −5 |
| LYD642 | 71820.2 | — | — | — | — | — | — | 30.3 | 0.09 | −4 |
| LYD642 | 71824.5 | 1192.5 | 0.18 | 5 | — | — | — | 30.0 | 0.04 | −5 |
| LYD642 | 71825.1 | — | — | — | 38.4 | 0.25 | −3 | 30.4 | 0.09 | −4 |
| LYD634 | 71995.1 | 1339.4 | 0.04 | 18 | 37.7 | L | −5 | 30.1 | 0.05 | −5 |
| LYD634 | 71996.2 | 1319.4 | L | 16 | — | — | — | — | — | — |
| LYD634 | 71999.3 | — | — | — | 38.4 | 0.25 | −3 | 30.4 | 0.09 | −4 |
| LYD629 | 72198.2 | — | — | — | 38.9 | 0.05 | −2 | 30.1 | 0.04 | −5 |
| LYD629 | 72198.5 | — | — | — | — | — | — | 30.0 | 0.04 | −5 |
| LYD622 | 72024.3 | — | — | — | 37.7 | L | −5 | 30.2 | 0.06 | −5 |
| LYD622 | 72027.5 | — | — | — | 38.2 | 0.14 | −4 | 30.3 | 0.09 | −4 |
| LYD617 | 71966.6 | — | — | — | 38.7 | 0.02 | −2 | 30.2 | 0.06 | −5 |
| LYD603 | 72537.3 | — | — | — | — | — | — | 30.2 | 0.05 | −5 |
| LYD603 | 72537.5 | — | — | — | 39.2 | 0.20 | −1 | — | — | — |
| LYD603 | 72537.7 | — | — | — | — | — | — | 30.8 | 0.21 | −3 |
| LYD567 | 72495.3 | — | — | — | — | — | — | 30.5 | 0.10 | −4 |
| LYD567 | 72496.2 | — | — | — | 39.0 | 0.08 | −2 | 30.6 | 0.19 | −3 |
| LYD561 | 72177.1 | — | — | — | 38.2 | 0.14 | −4 | 30.1 | 0.04 | −5 |
| LYD561 | 72178.2 | — | — | — | — | — | — | 30.5 | 0.10 | −4 |
| LYD553 | 72743.1 | 1282.5 | 0.22 | 13 | — | — | — | — | — | — |
| LYD553 | 72743.2 | — | — | — | — | — | — | 30.5 | 0.10 | −4 |
| LYD547 | 71978.3 | — | — | — | — | — | — | 30.1 | 0.04 | −5 |
| LYD547 | 71980.3 | — | — | — | — | — | — | 30.5 | 0.10 | −4 |
| LYD547 | 71981.2 | — | — | — | 37.6 | L | −5 | 30.1 | 0.04 | −5 |
| LYD534 | 72414.3 | 1199.4 | 0.12 | 6 | — | — | — | — | — | — |

TABLE 56-continued

Genes showing improved plant performance at Normal growth conditions under regulation of At6669 promoter

| Gene | | Dry Weight [mg] | | | Flowering (days) | | | Inflorescence Emergence (days) | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD531 | 71917.1 | — | — | — | — | — | — | 30.1 | 0.04 | −5 |
| LYD531 | 71917.2 | — | — | — | — | — | — | 30.1 | 0.04 | −5 |
| LYD531 | 71921.2 | 1236.9 | 0.04 | 9 | — | — | — | 30.1 | 0.04 | −5 |
| LYD521 | 72610.2 | — | — | — | — | — | — | 30.6 | 0.19 | −3 |
| CONT. | — | 1135.4 | — | — | 39.7 | — | — | 31.7 | — | — |

Table 56. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

TABLE 57

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD689 | 72711.2 | 0.9 | 0.01 | 19 | — | — | — | 46.8 | 0.29 | 15 |
| LYD689 | 72713.1 | 0.8 | 0.11 | 9 | 10.0 | 0.14 | 5 | 46.3 | 0.08 | 13 |
| LYD677 | 72223.3 | 0.8 | 0.05 | 13 | — | — | — | 46.4 | 0.16 | 14 |
| LYD677 | 72223.6 | 0.9 | L | 25 | — | — | — | 51.9 | L | 27 |
| LYD677 | 72227.1 | 0.8 | 0.17 | 8 | — | — | — | — | — | — |
| LYD675 | 72644.3 | — | — | — | — | — | — | 46.4 | 0.27 | 14 |
| LYD671 | 72880.1 | 0.8 | 0.26 | 6 | — | — | — | — | — | — |
| LYD648 | 72831.3 | 0.8 | 0.23 | 8 | — | — | — | — | — | — |
| LYD641 | 72635.2 | 0.8 | 0.03 | 15 | — | — | — | 46.1 | 0.19 | 13 |
| LYD636 | 72204.1 | 0.8 | 0.09 | 10 | — | — | — | 44.4 | 0.21 | 9 |
| LYD625 | 72752.4 | 0.8 | 0.21 | 7 | — | — | — | 44.4 | 0.25 | 9 |
| LYD625 | 72755.1 | — | — | — | 10.2 | 0.05 | 1 | — | — | — |
| LYD625 | 72755.4 | 0.8 | 0.22 | 13 | — | — | — | — | — | — |
| LYD602 | 72613.3 | 0.8 | 0.26 | 6 | — | — | — | — | — | — |
| LYD599 | 72270.5 | — | — | — | 10.1 | 0.16 | 5 | 46.1 | 0.28 | 13 |
| LYD598 | 72421.2 | — | — | — | — | — | — | 44.3 | 0.26 | 8 |
| LYD585 | 72986.1 | 0.8 | 0.15 | 16 | — | — | — | — | — | — |
| LYD573 | 72977.1 | 0.8 | 0.05 | 16 | 10.2 | 0.10 | 7 | 49.7 | 0.02 | 22 |
| CONT. | — | 0.7 | — | — | 9.6 | — | — | 40.8 | — | — |
| LYD635 | 72630.2 | — | — | — | 12.4 | 0.16 | 14 | 69.9 | 0.28 | 18 |
| LYD635 | 72630.4 | 1.1 | L | 24 | — | — | — | 74.1 | 0.13 | 25 |
| LYD632 | 72769.2 | 1.0 | 0.15 | 6 | — | — | — | — | — | — |
| LYD631 | 72542.3 | 1.2 | L | 31 | 11.9 | 0.16 | 10 | 85.9 | L | 45 |
| LYD627 | 72764.3 | 1.0 | 0.02 | 11 | — | — | — | 66.8 | 0.01 | 12 |
| LYD627 | 72765.1 | 1.1 | L | 16 | — | — | — | 67.6 | L | 14 |
| LYD623 | 71970.2 | 1.1 | 0.03 | 18 | — | — | — | 71.0 | 0.09 | 19 |
| LYD623 | 71970.4 | 1.0 | 0.17 | 14 | — | — | — | 68.2 | L | 15 |
| LYD623 | 71972.3 | 1.1 | 0.14 | 23 | 11.4 | 0.03 | 6 | 74.9 | 0.19 | 26 |
| LYD621 | 72571.1 | 1.0 | 0.27 | 4 | — | — | — | 63.8 | 0.12 | 7 |
| LYD621 | 72573.3 | 1.2 | 0.19 | 29 | 11.8 | 0.22 | 9 | 80.2 | 0.20 | 35 |
| LYD621 | 72574.3 | — | — | — | 11.5 | 0.03 | 6 | 65.5 | 0.05 | 10 |
| LYD618 | 72621.2 | 1.0 | 0.10 | 8 | — | — | — | — | — | — |
| LYD618 | 72622.2 | — | — | — | 11.2 | 0.15 | 3 | — | — | — |
| LYD618 | 72622.3 | — | — | — | 11.3 | 0.07 | 4 | — | — | — |
| LYD618 | 72624.4 | 1.1 | 0.06 | 18 | 11.7 | 0.15 | 8 | 79.0 | 0.04 | 33 |
| LYD612 | 71817.3 | — | — | — | — | — | — | 67.5 | 0.01 | 14 |
| LYD612 | 71819.1 | — | — | — | 11.2 | 0.28 | 3 | 64.0 | 0.14 | 8 |
| LYD603 | 72535.2 | 1.0 | 0.08 | 8 | — | — | — | 67.9 | 0.03 | 14 |
| LYD603 | 72536.2 | — | — | — | 11.2 | 0.14 | 4 | — | — | — |
| LYD603 | 72537.5 | 1.0 | 0.20 | 10 | — | — | — | — | — | — |
| LYD585 | 72986.1 | 1.1 | 0.05 | 22 | — | — | — | 71.7 | L | 21 |
| LYD585 | 72986.2 | 1.0 | 0.05 | 9 | — | — | — | 65.6 | 0.11 | 10 |
| LYD585 | 72988.3 | 1.1 | 0.15 | 17 | 12.0 | L | 11 | 74.4 | 0.20 | 25 |
| LYD572 | 72385.1 | 1.0 | 0.22 | 10 | 11.8 | 0.22 | 9 | 70.1 | 0.22 | 18 |
| LYD572 | 72386.1 | — | — | — | 11.1 | 0.28 | 3 | — | — | — |
| LYD571 | 72357.5 | 1.1 | L | 20 | — | — | — | 75.0 | 0.02 | 26 |
| LYD571 | 72358.1 | 1.0 | 0.14 | 11 | — | — | — | 70.9 | 0.03 | 19 |
| LYD571 | 72358.3 | 1.3 | L | 41 | 11.7 | L | 8 | 86.4 | L | 45 |
| LYD571 | 72358.4 | 1.0 | 0.14 | 9 | — | — | — | 65.6 | 0.03 | 11 |
| LYD571 | 72360.2 | — | — | — | 11.6 | 0.01 | 7 | 70.5 | 0.04 | 19 |
| LYD551 | 71984.1 | — | — | — | 11.2 | 0.28 | 3 | — | — | — |
| LYD551 | 71986.4 | 1.1 | L | 19 | — | — | — | — | — | — |

TABLE 57-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD551 | 71986.7 | 1.0 | 0.05 | 9 | 11.7 | L | 8 | 66.4 | 0.02 | 12 |
| LYD551 | 71986.9 | — | — | — | — | — | — | 63.2 | 0.27 | 6 |
| LYD548 | 72656.1 | 1.0 | 0.26 | 10 | 11.8 | 0.08 | 8 | — | — | — |
| LYD548 | 72673.3 | — | — | — | 11.7 | 0.04 | 8 | 64.7 | 0.06 | 9 |
| LYD548 | 72676.1 | 1.0 | L | 15 | — | — | — | 70.8 | L | 19 |
| LYD548 | 72677.1 | 1.0 | 0.13 | 6 | — | — | — | — | — | — |
| LYD531 | 71916.1 | 1.0 | 0.23 | 9 | — | — | — | 67.9 | 0.20 | 14 |
| LYD531 | 71917.1 | 1.1 | L | 18 | 11.5 | 0.15 | 6 | 72.6 | L | 22 |
| LYD531 | 71917.2 | — | — | — | 11.9 | L | 10 | 72.0 | 0.06 | 21 |
| LYD531 | 71921.2 | 1.1 | 0.02 | 18 | 11.9 | 0.06 | 10 | 76.7 | L | 29 |
| LYD527 | 72241.3 | 1.1 | 0.14 | 21 | 11.4 | 0.25 | 6 | 72.3 | 0.06 | 22 |
| LYD527 | 72243.3 | 1.0 | L | 14 | 11.4 | 0.07 | 5 | 68.8 | L | 16 |
| LYD527 | 72243.4 | — | — | — | — | — | — | 63.0 | 0.19 | 6 |
| LYD527 | 72245.2 | 1.0 | 0.05 | 9 | — | — | — | 69.9 | L | 18 |
| LYD527 | 72246.3 | 1.1 | L | 18 | 12.0 | 0.05 | 11 | 72.6 | 0.01 | 22 |
| CONT. | — | 0.9 | — | — | 10.8 | — | — | 59.4 | — | — |
| LYD684 | 72271.2 | — | — | — | 10.4 | 0.22 | 4 | 48.0 | 0.25 | 9 |
| LYD684 | 72274.3 | 0.9 | 0.03 | 13 | 10.4 | 0.05 | 3 | 50.7 | 0.08 | 15 |
| LYD666 | 72391.3 | 0.8 | 0.14 | 7 | — | — | — | — | — | — |
| LYD666 | 72393.1 | 0.9 | 0.17 | 12 | — | — | — | 50.8 | 0.04 | 15 |
| LYD666 | 72396.2 | — | — | — | 10.3 | 0.11 | 3 | — | — | — |
| LYD662 | 72008.3 | 0.9 | 0.03 | 14 | — | — | — | 51.5 | 0.01 | 17 |
| LYD662 | 72011.4 | 0.9 | 0.02 | 12 | — | — | — | 46.9 | 0.24 | 6 |
| LYD658 | 72277.2 | 0.8 | 0.18 | 7 | — | — | — | 47.5 | 0.17 | 7 |
| LYD658 | 72282.1 | 0.8 | 0.04 | 11 | — | — | — | 50.0 | 0.04 | 13 |
| LYD645 | 72340.2 | — | — | — | 10.2 | 0.17 | 2 | — | — | — |
| LYD645 | 72341.2 | 0.9 | 0.10 | 14 | — | — | — | 51.6 | 0.14 | 17 |
| LYD632 | 72771.1 | 0.8 | 0.06 | 10 | — | — | — | 48.6 | 0.24 | 10 |
| LYD632 | 72774.4 | 0.8 | 0.27 | 7 | — | — | — | — | — | — |
| LYD631 | 72544.1 | 0.8 | 0.13 | 8 | — | — | — | — | — | — |
| LYD631 | 72544.3 | — | — | — | 10.4 | 0.03 | 4 | — | — | — |
| LYD631 | 72544.4 | 0.9 | 0.03 | 11 | — | — | — | 50.9 | 0.02 | 15 |
| LYD627 | 72764.3 | 0.8 | 0.16 | 7 | — | — | — | — | — | — |
| LYD627 | 72765.1 | — | — | — | 10.8 | L | 7 | 49.7 | 0.08 | 13 |
| LYD627 | 72766.1 | 1.0 | 0.04 | 30 | — | — | — | 58.7 | L | 33 |
| LYD601 | 72872.2 | 0.9 | 0.02 | 13 | — | — | — | 51.0 | 0.04 | 16 |
| LYD586 | 71949.6 | 0.8 | 0.09 | 8 | — | — | — | — | — | — |
| LYD586 | 71949.7 | 0.9 | 0.03 | 11 | 10.6 | 0.14 | 5 | 53.1 | 0.02 | 20 |
| LYD571 | 72357.5 | 0.8 | 0.25 | 8 | — | — | — | 51.1 | 0.07 | 16 |
| LYD571 | 72358.3 | 1.0 | L | 30 | 11.4 | 0.06 | 13 | 60.9 | 0.03 | 38 |
| LYD571 | 72358.4 | 0.9 | 0.21 | 15 | — | — | — | 49.9 | 0.10 | 13 |
| LYD564 | 72182.4 | 0.9 | 0.09 | 17 | — | — | — | 55.5 | 0.11 | 26 |
| LYD564 | 72182.5 | 0.8 | 0.15 | 6 | — | — | — | — | — | — |
| LYD564 | 72185.1 | 0.8 | 0.10 | 8 | 10.7 | 0.25 | 6 | 50.0 | 0.04 | 13 |
| LYD564 | 72186.2 | — | — | — | 10.3 | 0.11 | 3 | — | — | — |
| LYD560 | 71925.1 | 0.9 | 0.01 | 14 | — | — | — | 50.4 | 0.04 | 14 |
| LYD545 | 72510.2 | 0.9 | 0.15 | 13 | 10.2 | 0.17 | 2 | 52.3 | 0.12 | 18 |
| LYD543 | 72252.1 | 0.8 | 0.27 | 5 | — | — | — | 49.4 | 0.06 | 12 |
| CONT. | — | 0.8 | — | — | 10.0 | — | — | 44.2 | — | — |
| LYD672 | 72346.4 | 0.8 | 0.12 | 7 | — | — | — | 47.5 | 0.18 | 14 |
| LYD672 | 72347.3 | — | — | — | 10.5 | L | 9 | 54.2 | 0.16 | 30 |
| LYD668 | 72023.3 | 0.8 | 0.29 | 8 | — | — | — | 46.7 | 0.04 | 12 |
| LYD664 | 72012.1 | 0.8 | 0.13 | 7 | — | — | — | 45.9 | 0.07 | 10 |
| LYD664 | 72015.2 | — | — | — | — | — | — | 44.8 | 0.22 | 8 |
| LYD664 | 72016.2 | 0.9 | L | 20 | 10.1 | 0.05 | 6 | 53.1 | L | 28 |
| LYD664 | 72017.8 | 0.8 | 0.22 | 13 | 9.9 | 0.25 | 3 | 47.3 | 0.16 | 14 |
| LYD661 | 72325.1 | — | — | — | 10.1 | 0.16 | 5 | — | — | — |
| LYD661 | 72325.4 | — | — | — | 10.2 | 0.10 | 6 | — | — | — |
| LYD661 | 72326.1 | 0.8 | 0.08 | 8 | — | — | — | — | — | — |
| LYD661 | 72328.2 | 0.9 | 0.14 | 21 | 10.4 | 0.24 | 8 | 56.0 | 0.28 | 35 |
| LYD661 | 72329.2 | 0.9 | 0.05 | 16 | — | — | — | 51.4 | 0.07 | 23 |
| LYD657 | 72400.3 | 0.9 | 0.17 | 27 | 10.5 | L | 9 | 54.8 | 0.26 | 32 |
| LYD580 | 72188.2 | 0.9 | 0.11 | 16 | — | — | — | 51.8 | L | 24 |
| LYD580 | 72189.1 | 0.8 | 0.05 | 12 | 10.3 | 0.06 | 8 | 48.7 | 0.01 | 17 |
| LYD580 | 72192.3 | 0.9 | L | 20 | 9.8 | 0.29 | 2 | 51.9 | L | 25 |
| LYD561 | 72177.1 | 0.8 | 0.30 | 13 | — | — | — | — | — | — |
| LYD561 | 72178.1 | 0.9 | 0.11 | 17 | — | — | — | 51.4 | 0.19 | 23 |
| LYD560 | 71925.1 | 0.8 | 0.12 | 7 | — | — | — | 48.6 | 0.25 | 17 |
| LYD554 | 72169.2 | 0.8 | 0.16 | 7 | — | — | — | — | — | — |
| LYD553 | 72741.2 | 0.8 | 0.09 | 8 | — | — | — | 45.1 | 0.29 | 8 |
| LYD547 | 71978.2 | 0.9 | 0.16 | 29 | 10.9 | 0.04 | 13 | 57.5 | 0.12 | 38 |
| LYD547 | 71978.3 | — | — | — | 10.0 | 0.12 | 4 | 50.9 | 0.29 | 22 |
| LYD547 | 71980.1 | 0.8 | 0.22 | 9 | 10.2 | 0.15 | 7 | 47.3 | 0.08 | 14 |

TABLE 57-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD547 | 71980.3 | 0.8 | 0.09 | 8 | 10.1 | 0.05 | 6 | 47.6 | 0.07 | 14 |
| LYD538 | 72835.2 | 0.8 | 0.06 | 9 | — | — | — | 45.0 | 0.13 | 8 |
| LYD538 | 72839.5 | — | — | — | 10.1 | 0.04 | 5 | — | — | — |
| LYD528 | 72311.1 | 0.8 | 0.03 | 10 | — | — | — | 45.7 | 0.12 | 10 |
| LYD528 | 72312.3 | 0.8 | 0.06 | 14 | — | — | — | 45.5 | 0.11 | 9 |
| LYD522 | 72715.2 | — | — | — | 9.8 | 0.29 | 2 | — | — | — |
| LYD522 | 72720.1 | 0.9 | L | 16 | 10.1 | 0.03 | 6 | 49.8 | 0.02 | 20 |
| LYD522 | 72720.2 | — | — | — | — | — | — | 49.2 | 0.30 | 18 |
| LYD521 | 72607.1 | 0.9 | 0.03 | 23 | 10.2 | 0.15 | 7 | 55.1 | 0.07 | 32 |
| LYD521 | 72610.1 | — | — | — | 9.9 | 0.25 | 3 | — | — | — |
| LYD521 | 72610.2 | — | — | — | 10.1 | 0.03 | 6 | 58.3 | 0.22 | 40 |
| LYD521 | 72611.3 | 0.8 | 0.28 | 7 | — | — | — | — | — | — |
| CONT. | — | 0.7 | — | — | 9.6 | — | — | 41.6 | — | — |
| LYD683 | 72870.1 | 0.8 | 0.02 | 16 | — | — | — | 44.3 | 0.05 | 26 |
| LYD682 | 72566.1 | 0.8 | L | 26 | — | — | — | 46.7 | L | 33 |
| LYD682 | 72568.2 | 0.8 | L | 21 | — | — | — | 45.9 | 0.02 | 31 |
| LYD678 | 72787.2 | 0.7 | 0.08 | 7 | 9.8 | 0.12 | 5 | 41.5 | 0.03 | 18 |
| LYD665 | 72211.2 | 0.8 | L | 20 | — | — | — | 44.6 | L | 27 |
| LYD650 | 72639.4 | 0.7 | 0.04 | 13 | — | — | — | 41.2 | 0.02 | 18 |
| LYD644 | 72775.1 | 0.7 | 0.01 | 13 | — | — | — | 41.1 | 0.03 | 17 |
| LYD644 | 72775.2 | 0.8 | 0.24 | 20 | 9.9 | 0.11 | 5 | 45.1 | 0.17 | 29 |
| LYD644 | 72780.2 | 0.7 | 0.03 | 13 | — | — | — | 42.3 | 0.12 | 21 |
| LYD639 | 72548.4 | 0.7 | 0.22 | 13 | 9.8 | 0.20 | 4 | 44.0 | L | 26 |
| LYD639 | 72548.6 | — | — | — | — | — | — | 40.6 | 0.29 | 16 |
| LYD639 | 72549.3 | — | — | — | — | — | — | 41.2 | 0.02 | 17 |
| LYD639 | 72551.1 | 0.7 | 0.21 | 13 | — | — | — | 40.9 | 0.22 | 17 |
| LYD639 | 72551.2 | 0.8 | 0.01 | 24 | — | — | — | 44.7 | L | 27 |
| LYD630 | 72404.3 | 0.9 | L | 34 | — | — | — | 50.9 | L | 45 |
| LYD626 | 72002.1 | 0.7 | 0.06 | 10 | — | — | — | 40.3 | 0.04 | 15 |
| LYD626 | 72004.4 | — | — | — | — | — | — | 40.6 | 0.08 | 16 |
| LYD606 | 72500.5 | 0.8 | L | 14 | — | — | — | 40.5 | 0.03 | 16 |
| LYD606 | 72501.1 | 0.7 | 0.16 | 7 | — | — | — | — | — | — |
| LYD577 | 72745.4 | 0.8 | L | 19 | — | — | — | 42.0 | 0.01 | 20 |
| LYD577 | 72747.4 | 0.7 | 0.11 | 7 | — | — | — | 38.4 | 0.11 | 10 |
| LYD577 | 72748.2 | 0.7 | 0.02 | 12 | — | — | — | 40.9 | 0.02 | 17 |
| LYD577 | 72750.4 | — | — | — | — | — | — | 44.2 | 0.29 | 26 |
| LYD536 | 72529.2 | — | — | — | — | — | — | 44.2 | 0.20 | 26 |
| LYD536 | 72529.5 | 0.8 | 0.15 | 15 | — | — | — | 44.1 | L | 26 |
| LYD536 | 72534.2 | 0.7 | 0.07 | 7 | — | — | — | 39.9 | 0.05 | 14 |
| LYD526 | 72164.4 | 0.8 | 0.24 | 21 | — | — | — | 47.5 | 0.13 | 36 |
| LYD526 | 72167.4 | 0.9 | L | 31 | 10.4 | 0.01 | 11 | 53.8 | L | 53 |
| LYD526 | 72168.1 | 0.7 | 0.02 | 12 | — | — | — | 42.4 | 0.01 | 21 |
| CONT. | — | 0.7 | — | — | 9.4 | — | — | 35.1 | — | — |
| LYD683 | 72867.2 | 1.0 | 0.20 | 8 | — | — | — | 57.7 | 0.20 | 10 |
| LYD674 | 72253.6 | — | — | — | 10.9 | 0.25 | 6 | 58.4 | 0.24 | 11 |
| LYD664 | 72015.2 | — | — | — | 10.8 | 0.17 | 4 | — | — | — |
| LYD664 | 72016.2 | 1.0 | 0.13 | 12 | — | — | — | 57.9 | 0.21 | 10 |
| LYD664 | 72017.8 | 1.1 | 0.03 | 27 | 11.6 | L | 12 | 69.3 | L | 32 |
| LYD643 | 72336.3 | — | — | — | — | — | — | 68.0 | 0.22 | 30 |
| LYD642 | 71820.2 | — | — | — | 10.9 | 0.05 | 6 | — | — | — |
| LYD642 | 71824.5 | 1.0 | 0.17 | 10 | 11.4 | 0.05 | 10 | 58.2 | 0.16 | 11 |
| LYD634 | 71995.1 | — | — | — | 11.1 | 0.10 | 8 | 60.9 | 0.13 | 16 |
| LYD629 | 72195.1 | — | — | — | 11.1 | 0.19 | 7 | 58.9 | 0.13 | 12 |
| LYD629 | 72198.2 | — | — | — | — | — | — | 62.3 | 0.27 | 19 |
| LYD629 | 72198.5 | 1.1 | 0.02 | 28 | 11.6 | L | 12 | 71.0 | L | 35 |
| LYD622 | 72028.3 | — | — | — | 10.6 | 0.28 | 3 | — | — | — |
| LYD617 | 71966.6 | 1.0 | 0.08 | 12 | — | — | — | — | — | — |
| LYD603 | 72535.2 | — | — | — | 10.6 | 0.28 | 3 | — | — | — |
| LYD595 | 72907.4 | 1.0 | 0.18 | 9 | — | — | — | — | — | — |
| LYD595 | 72909.1 | 1.0 | 0.18 | 13 | — | — | — | 61.3 | 0.18 | 17 |
| LYD595 | 72910.3 | 1.0 | 0.18 | 9 | 11.1 | 0.10 | 8 | 59.0 | 0.13 | 12 |
| LYD567 | 72496.2 | 1.1 | 0.04 | 20 | 11.3 | 0.21 | 9 | 63.6 | 0.02 | 21 |
| LYD561 | 72175.4 | — | — | — | 11.2 | 0.02 | 8 | — | — | — |
| LYD561 | 72177.1 | 0.9 | 0.30 | 7 | — | — | — | 59.5 | 0.12 | 13 |
| LYD561 | 72178.2 | — | — | — | 10.9 | 0.05 | 6 | — | — | — |
| LYD553 | 72743.2 | 1.0 | 0.28 | 13 | — | — | — | 58.8 | 0.21 | 12 |
| LYD547 | 71978.3 | 1.0 | 0.23 | 8 | — | — | — | 61.1 | 0.06 | 16 |
| LYD547 | 71981.2 | 1.0 | 0.04 | 17 | 11.9 | 0.08 | 15 | 65.3 | 0.01 | 24 |

TABLE 57-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD531 | 71921.2 | 1.0 | 0.04 | 16 | 11.6 | 0.16 | 12 | 65.4 | 0.06 | 25 |
| CONT. | — | 0.9 | — | — | 10.3 | — | — | 52.5 | — | — |

Table 57. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

TABLE 58

Genes showing improved plant performance at Normal growth conditions under regulation of At6669 promoter

| Gene | | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD689 | 72711.2 | — | — | — | — | — | — | 0.4 | 0.14 | 15 |
| LYD677 | 72223.6 | — | — | — | 6.4 | 0.08 | 26 | 0.4 | 0.29 | 10 |
| LYD625 | 72755.1 | — | — | — | 6.4 | 0.12 | 27 | 0.4 | 0.23 | 13 |
| LYD573 | 72977.1 | — | — | — | 6.2 | 0.14 | 22 | — | — | — |
| CONT. | — | — | — | — | 5.1 | — | — | 0.4 | — | — |
| LYD635 | 72626.1 | — | — | — | 8.5 | 0.17 | 17 | — | — | — |
| LYD635 | 72626.2 | — | — | — | 8.2 | 0.29 | 13 | — | — | — |
| LYD635 | 72630.2 | — | — | — | 8.4 | 0.18 | 16 | — | — | — |
| LYD635 | 72630.4 | — | — | — | 9.0 | 0.04 | 24 | 0.5 | 0.09 | 17 |
| LYD632 | 72770.2 | — | — | — | 8.5 | 0.16 | 18 | — | — | — |
| LYD631 | 72542.3 | 0.8 | 0.27 | 16 | 10.6 | L | 46 | 0.5 | 0.04 | 20 |
| LYD627 | 72765.1 | — | — | — | 8.3 | 0.21 | 14 | 0.5 | 0.27 | 10 |
| LYD623 | 71970.2 | — | — | — | 8.7 | 0.08 | 20 | 0.5 | 0.25 | 11 |
| LYD623 | 71970.4 | — | — | — | 8.4 | 0.16 | 16 | — | — | — |
| LYD623 | 71972.3 | — | — | — | 9.0 | 0.04 | 25 | 0.5 | 0.21 | 13 |
| LYD621 | 72573.3 | — | — | — | 9.8 | L | 36 | 0.5 | 0.19 | 13 |
| LYD618 | 72624.4 | — | — | — | 9.5 | 0.01 | 31 | — | — | — |
| LYD612 | 71817.3 | — | — | — | 8.2 | 0.27 | 13 | — | — | — |
| LYD612 | 71818.3 | 0.8 | 0.23 | 19 | — | — | — | — | — | — |
| LYD603 | 72535.2 | — | — | — | 8.4 | 0.16 | 16 | — | — | — |
| LYD585 | 72986.1 | — | — | — | 8.8 | 0.05 | 22 | 0.5 | 0.30 | 10 |
| LYD585 | 72988.3 | 0.8 | 0.11 | 24 | 9.1 | 0.04 | 25 | — | — | — |
| LYD572 | 72385.1 | — | — | — | 8.6 | 0.10 | 20 | — | — | — |
| LYD572 | 72387.1 | — | — | — | 8.9 | 0.08 | 22 | — | — | — |
| LYD571 | 72357.5 | — | — | — | 9.1 | 0.03 | 26 | 0.5 | 0.21 | 12 |
| LYD571 | 72358.1 | 0.8 | 0.27 | 16 | 8.6 | 0.10 | 19 | — | — | — |
| LYD571 | 72358.3 | — | — | — | 10.5 | L | 45 | 0.5 | 0.04 | 20 |
| LYD571 | 72360.2 | — | — | — | 8.7 | 0.08 | 20 | — | — | — |
| LYD551 | 71986.2 | 0.8 | 0.26 | 16 | — | — | — | — | — | — |
| LYD551 | 71986.4 | — | — | — | 8.5 | 0.13 | 18 | 0.5 | 0.25 | 11 |
| LYD551 | 71986.7 | 0.8 | 0.26 | 17 | — | — | — | — | — | — |
| LYD548 | 72656.1 | — | — | — | 8.3 | 0.20 | 15 | — | — | — |
| LYD548 | 72673.3 | 0.8 | 0.25 | 16 | — | — | — | — | — | — |
| LYD548 | 72676.1 | — | — | — | 8.6 | 0.11 | 18 | — | — | — |
| LYD531 | 71916.1 | — | — | — | 8.2 | 0.24 | 13 | — | — | — |
| LYD531 | 71917.1 | — | — | — | 8.8 | 0.06 | 22 | 0.5 | 0.21 | 13 |
| LYD531 | 71917.2 | — | — | — | 8.7 | 0.08 | 20 | 0.5 | 0.21 | 12 |
| LYD531 | 71921.2 | — | — | — | 9.4 | 0.02 | 29 | 0.5 | 0.12 | 15 |
| LYD527 | 72241.3 | — | — | — | 8.8 | 0.06 | 22 | 0.5 | 0.27 | 11 |
| LYD527 | 72243.3 | — | — | — | 8.4 | 0.14 | 17 | — | — | — |
| LYD527 | 72245.2 | — | — | — | 8.5 | 0.14 | 17 | — | — | — |
| LYD527 | 72246.3 | — | — | — | 8.9 | 0.04 | 23 | 0.5 | 0.24 | 11 |
| CONT. | — | 0.7 | — | — | 7.2 | — | — | 0.4 | — | — |
| LYD684 | 72274.3 | — | — | — | 6.3 | 0.11 | 15 | — | — | — |
| LYD666 | 72393.1 | — | — | — | 6.2 | 0.14 | 14 | — | — | — |
| LYD662 | 72008.3 | — | — | — | 6.3 | 0.08 | 17 | 0.4 | 0.21 | 9 |
| LYD662 | 72008.5 | — | — | — | — | — | — | 0.4 | 0.15 | 14 |
| LYD658 | 72277.2 | 0.7 | 0.28 | 14 | — | — | — | — | — | — |
| LYD658 | 72282.1 | — | — | — | — | — | — | 0.4 | 0.30 | 8 |
| LYD645 | 72341.2 | — | — | — | 6.3 | 0.09 | 16 | 0.4 | 0.29 | 8 |
| LYD632 | 72771.1 | — | — | — | 6.0 | 0.21 | 12 | — | — | — |
| LYD631 | 72544.1 | 0.6 | 0.30 | 12 | — | — | — | — | — | — |
| LYD631 | 72544.4 | — | — | — | 6.2 | 0.11 | 15 | 0.4 | 0.16 | 11 |
| LYD627 | 72764.3 | 0.7 | 0.27 | 14 | — | — | — | 0.4 | 0.18 | 11 |
| LYD627 | 72765.1 | — | — | — | 6.0 | 0.23 | 11 | — | — | — |

TABLE 58-continued

Genes showing improved plant performance at Normal growth conditions under regulation of At6669 promoter

| Gene Name | Event # | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LYD627 | 72766.1 | — | — | — | 7.1 | L | 30 | 0.4 | 0.13 | 12 |
| LYD601 | 72872.2 | — | — | — | 6.2 | 0.11 | 15 | — | — | — |
| LYD586 | 71949.7 | — | — | — | 6.5 | 0.04 | 20 | — | — | — |
| LYD571 | 72357.5 | — | — | — | 6.2 | 0.12 | 15 | 0.4 | 0.28 | 8 |
| LYD571 | 72358.3 | — | — | — | 7.5 | L | 38 | 0.4 | 0.02 | 19 |
| LYD571 | 72358.4 | — | — | — | 6.2 | 0.14 | 14 | — | — | — |
| LYD570 | 71934.2 | 0.7 | 0.23 | 15 | — | — | — | — | — | — |
| LYD570 | 71936.4 | 0.7 | 0.04 | 25 | — | — | — | — | — | — |
| LYD564 | 72182.4 | — | — | — | 6.6 | 0.03 | 23 | — | — | — |
| LYD564 | 72182.5 | — | — | — | 6.0 | 0.28 | 11 | — | — | — |
| LYD564 | 72185.1 | — | — | — | 6.1 | 0.18 | 13 | 0.4 | 0.20 | 10 |
| LYD560 | 71925.1 | — | — | — | 6.1 | 0.17 | 13 | 0.4 | 0.26 | 8 |
| LYD545 | 72510.2 | — | — | — | 6.5 | 0.05 | 20 | — | — | — |
| LYD543 | 72252.1 | — | — | — | 6.0 | 0.22 | 12 | — | — | — |
| CONT. | — | 0.6 | — | — | 5.4 | — | — | 0.3 | — | — |
| LYD672 | 72346.4 | — | — | — | 6.0 | 0.26 | 16 | — | — | — |
| LYD672 | 72347.3 | — | — | — | 6.7 | 0.05 | 29 | 0.4 | 0.19 | 15 |
| LYD664 | 72012.1 | — | — | — | — | — | — | 0.4 | 0.27 | 12 |
| LYD664 | 72016.2 | — | — | — | 6.6 | 0.06 | 28 | — | — | — |
| LYD661 | 72325.1 | — | — | — | 6.2 | 0.20 | 19 | — | — | — |
| LYD661 | 72326.1 | — | — | — | — | — | — | 0.4 | 0.30 | 11 |
| LYD661 | 72328.2 | — | — | — | 6.9 | 0.04 | 34 | 0.4 | 0.30 | 13 |
| LYD661 | 72329.2 | — | — | — | 6.4 | 0.10 | 24 | 0.4 | 0.22 | 13 |
| LYD657 | 72400.3 | 0.7 | 0.29 | 16 | 6.8 | 0.05 | 31 | 0.4 | 0.15 | 18 |
| LYD580 | 72188.2 | — | — | — | 6.4 | 0.10 | 24 | 0.4 | 0.22 | 14 |
| LYD580 | 72189.1 | — | — | — | 6.0 | 0.24 | 16 | — | — | — |
| LYD580 | 72192.3 | — | — | — | 6.4 | 0.10 | 25 | — | — | — |
| LYD561 | 72177.1 | — | — | — | 6.0 | 0.29 | 15 | — | — | — |
| LYD561 | 72178.1 | — | — | — | 6.4 | 0.11 | 24 | — | — | — |
| LYD560 | 71925.1 | — | — | — | 6.0 | 0.28 | 16 | — | — | — |
| LYD554 | 72174.4 | — | — | — | 6.2 | 0.27 | 19 | — | — | — |
| LYD547 | 71978.2 | — | — | — | 7.1 | 0.01 | 38 | 0.4 | 0.14 | 16 |
| LYD547 | 71978.3 | — | — | — | 6.3 | 0.13 | 22 | 0.4 | 0.24 | 13 |
| LYD547 | 71981.2 | — | — | — | 6.4 | 0.14 | 23 | — | — | — |
| LYD538 | 72838.3 | — | — | — | 6.3 | 0.20 | 22 | — | — | — |
| LYD522 | 72715.2 | — | — | — | 6.2 | 0.23 | 19 | — | — | — |
| LYD522 | 72720.1 | — | — | — | 6.1 | 0.21 | 18 | 0.4 | 0.28 | 12 |
| LYD522 | 72720.2 | — | — | — | 6.2 | 0.20 | 19 | — | — | — |
| LYD521 | 72607.1 | — | — | — | 6.9 | 0.03 | 33 | 0.4 | 0.16 | 16 |
| LYD521 | 72610.2 | — | — | — | 7.2 | 0.02 | 39 | 0.4 | 0.29 | 12 |
| CONT. | — | 0.6 | — | — | 5.2 | — | — | 0.3 | — | — |
| LYD683 | 72866.4 | — | — | — | 5.1 | 0.28 | 17 | — | — | — |
| LYD683 | 72870.1 | — | — | — | 5.5 | 0.09 | 27 | 0.4 | 0.23 | 11 |
| LYD682 | 72566.1 | — | — | — | 5.7 | 0.06 | 31 | — | — | — |
| LYD682 | 72568.2 | — | — | — | 5.6 | 0.05 | 30 | 0.4 | 0.14 | 13 |
| LYD678 | 72787.2 | — | — | — | 5.2 | 0.18 | 20 | — | — | — |
| LYD665 | 72211.2 | — | — | — | 5.4 | 0.08 | 26 | — | — | — |
| LYD650 | 72639.4 | — | — | — | 5.1 | 0.21 | 18 | 0.4 | 0.17 | 12 |
| LYD644 | 72775.1 | — | — | — | 5.1 | 0.20 | 19 | 0.4 | 0.15 | 12 |
| LYD644 | 72775.2 | — | — | — | 5.6 | 0.06 | 30 | — | — | — |
| LYD644 | 72780.2 | — | — | — | 5.2 | 0.17 | 21 | — | — | — |
| LYD639 | 72548.4 | — | — | — | 5.4 | 0.11 | 25 | 0.4 | 0.19 | 12 |
| LYD639 | 72549.3 | — | — | — | 5.1 | 0.24 | 17 | — | — | — |
| LYD639 | 72551.1 | — | — | — | 5.1 | 0.23 | 18 | — | — | — |
| LYD639 | 72551.2 | — | — | — | 5.5 | 0.06 | 28 | 0.4 | 0.03 | 19 |
| LYD630 | 72404.3 | — | — | — | 6.3 | L | 45 | 0.4 | 0.03 | 20 |
| LYD626 | 72002.1 | — | — | — | 5.0 | 0.28 | 15 | 0.4 | 0.23 | 11 |
| LYD626 | 72004.4 | — | — | — | 5.1 | 0.24 | 17 | — | — | — |
| LYD606 | 72500.2 | — | — | — | 5.2 | 0.21 | 20 | — | — | — |
| LYD606 | 72500.5 | — | — | — | 5.2 | 0.18 | 19 | 0.4 | 0.06 | 16 |
| LYD577 | 72745.4 | — | — | — | 5.2 | 0.18 | 20 | 0.4 | 0.15 | 13 |
| LYD577 | 72748.2 | — | — | — | 5.1 | 0.21 | 18 | 0.4 | 0.14 | 13 |
| LYD577 | 72750.4 | — | — | — | 5.5 | 0.09 | 27 | 0.4 | 0.27 | 10 |
| LYD536 | 72529.2 | — | — | — | 5.5 | 0.08 | 27 | 0.4 | 0.20 | 12 |
| LYD536 | 72529.5 | — | — | — | 5.5 | 0.07 | 27 | — | — | — |
| LYD536 | 72534.2 | — | — | — | 5.0 | 0.30 | 15 | — | — | — |
| LYD526 | 72164.4 | — | — | — | 5.9 | 0.03 | 36 | 0.4 | 0.22 | 12 |
| LYD526 | 72167.4 | — | — | — | 6.6 | L | 53 | 0.4 | 0.04 | 18 |
| LYD526 | 72168.1 | — | — | — | 5.3 | 0.14 | 21 | — | — | — |
| CONT. | — | — | — | — | 4.3 | — | — | 0.3 | — | — |
| LYD664 | 72017.8 | — | — | — | 8.5 | 0.03 | 29 | 0.4 | 0.20 | 14 |
| LYD643 | 72336.3 | — | — | — | 8.3 | 0.05 | 27 | — | — | — |

TABLE 58-continued

Genes showing improved plant performance at Normal growth conditions under regulation of At6669 promoter

| Gene Name | Event # | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LYD629 | 72198.2 | — | — | — | 7.6 | 0.19 | 17 | 0.4 | 0.29 | 12 |
| LYD629 | 72198.5 | 0.7 | 0.28 | 17 | 8.7 | 0.01 | 33 | 0.4 | 0.11 | 17 |
| LYD595 | 72909.1 | — | — | — | 7.5 | 0.23 | 15 | — | — | — |
| LYD567 | 72496.2 | — | — | — | 8.0 | 0.08 | 22 | 0.4 | 0.21 | 13 |
| LYD561 | 72175.4 | 0.7 | 0.26 | 17 | — | — | — | — | — | — |
| LYD553 | 72743.2 | — | — | — | — | — | — | 0.4 | 0.20 | 14 |
| LYD547 | 71978.3 | — | — | — | 7.4 | 0.27 | 14 | — | — | — |
| LYD547 | 71981.2 | 0.7 | 0.21 | 21 | 8.0 | 0.08 | 22 | 0.4 | 0.14 | 16 |
| LYD531 | 71921.2 | — | — | — | 8.0 | 0.07 | 23 | 0.4 | 0.29 | 11 |
| CONT. | — | 0.6 | — | — | 6.5 | — | — | 0.4 | — | — |

Table 58. "CONT."—Control; "Ave."—Average; "% Incr." = % increment; "p-val."—p-value, L—p < 0.01. RGR = relative growth rate. The transgenes were under the transcriptional regulation of the new At6669 promoter (SEQ ID NO: 4111). "—" = results are still unavailable.

TABLE 59

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD689 | 72711.2 | — | — | — | 6.2 | 0.02 | 22 | 4.5 | 0.04 | 14 |
| LYD689 | 72713.1 | — | — | — | 5.8 | 0.08 | 13 | 4.2 | 0.09 | 7 |
| LYD677 | 72223.3 | — | — | — | 5.8 | 0.16 | 14 | 4.3 | 0.05 | 9 |
| LYD677 | 72223.6 | 0.2 | 0.21 | 14 | 6.5 | L | 27 | 4.5 | 0.03 | 13 |
| LYD677 | 72227.1 | 0.2 | 0.22 | 17 | — | — | — | — | — | — |
| LYD675 | 72643.1 | 0.2 | 0.15 | 21 | — | — | — | — | — | — |
| LYD675 | 72644.3 | 0.2 | 0.03 | 32 | 5.8 | 0.27 | 14 | 4.2 | 0.28 | 6 |
| LYD648 | 72831.3 | — | — | — | — | — | — | 4.1 | 0.23 | 5 |
| LYD641 | 72632.2 | 0.2 | 0.04 | 27 | — | — | — | — | — | — |
| LYD641 | 72635.2 | 0.2 | 0.04 | 27 | 5.8 | 0.19 | 13 | 4.3 | 0.04 | 10 |
| LYD636 | 72204.1 | — | — | — | 5.6 | 0.21 | 9 | — | — | — |
| LYD625 | 72752.4 | 0.2 | 0.03 | 29 | 5.6 | 0.25 | 9 | 4.1 | 0.20 | 5 |
| LYD625 | 72755.4 | — | — | — | — | — | — | 4.3 | 0.18 | 8 |
| LYD611 | 71991.1 | 0.2 | 0.25 | 50 | — | — | — | — | — | — |
| LYD599 | 72270.5 | 0.2 | 0.18 | 15 | 5.8 | 0.28 | 13 | — | — | — |
| LYD598 | 72421.2 | 0.2 | 0.13 | 21 | 5.5 | 0.26 | 8 | — | — | — |
| LYD573 | 72977.1 | 0.2 | 0.05 | 26 | 6.2 | 0.02 | 22 | 4.3 | 0.08 | 9 |
| CONT. | — | 0.2 | — | — | 5.1 | — | — | 3.9 | — | — |
| LYD667 | 72031.1 | — | — | — | — | — | — | 5.4 | 0.27 | 6 |
| LYD635 | 72626.1 | — | — | — | — | — | — | 5.6 | 0.21 | 11 |
| LYD635 | 72630.2 | — | — | — | 8.7 | 0.28 | 18 | — | — | — |
| LYD635 | 72630.4 | — | — | — | 9.3 | 0.13 | 25 | 5.8 | L | 16 |
| LYD632 | 72769.2 | 0.2 | 0.09 | 9 | — | — | — | 5.2 | 0.02 | 4 |
| LYD631 | 72541.5 | — | — | — | — | — | — | 5.3 | 0.01 | 4 |
| LYD631 | 72542.3 | 0.2 | 0.02 | 12 | 10.7 | L | 45 | 6.0 | L | 19 |
| LYD631 | 72544.1 | 0.2 | 0.02 | 13 | — | — | — | 5.2 | 0.14 | 3 |
| LYD627 | 72764.3 | — | — | — | 8.4 | 0.01 | 12 | 5.4 | L | 7 |
| LYD627 | 72765.1 | — | — | — | 8.4 | L | 14 | 5.5 | 0.11 | 8 |
| LYD627 | 72766.2 | — | — | — | — | — | — | 5.3 | 0.01 | 4 |
| LYD623 | 71970.2 | — | — | — | 8.9 | 0.09 | 19 | 5.6 | 0.20 | 11 |
| LYD623 | 71970.4 | — | — | — | 8.5 | L | 15 | 5.4 | 0.17 | 8 |
| LYD623 | 71972.2 | 0.2 | 0.12 | 11 | — | — | — | — | — | — |
| LYD623 | 71972.3 | — | — | — | 9.4 | 0.19 | 26 | 5.8 | 0.21 | 14 |
| LYD621 | 72571.1 | — | — | — | 8.0 | 0.12 | 7 | 5.3 | L | 6 |
| LYD621 | 72573.3 | — | — | — | 10.0 | 0.20 | 35 | 5.8 | 0.19 | 15 |
| LYD621 | 72574.3 | 0.2 | 0.06 | 9 | 8.2 | 0.05 | 10 | 5.5 | L | 8 |
| LYD618 | 72621.2 | — | — | — | — | — | — | 5.3 | 0.20 | 6 |
| LYD618 | 72622.2 | 0.2 | 0.12 | 9 | — | — | — | — | — | — |
| LYD618 | 72622.3 | — | — | — | — | — | — | 5.2 | 0.06 | 3 |
| LYD618 | 72623.1 | — | — | — | — | — | — | 5.2 | 0.05 | 4 |
| LYD618 | 72624.4 | 0.2 | 0.22 | 10 | 9.9 | 0.04 | 33 | 5.8 | L | 14 |
| LYD612 | 71817.3 | 0.2 | L | 16 | 8.4 | 0.01 | 14 | 5.4 | 0.03 | 7 |
| LYD612 | 71819.1 | — | — | — | 8.0 | 0.14 | 8 | — | — | — |
| LYD603 | 72535.2 | — | — | — | 8.5 | 0.03 | 14 | 5.5 | 0.06 | 8 |
| LYD603 | 72537.3 | 0.2 | 0.07 | 17 | — | — | — | — | — | — |
| LYD593 | 71957.5 | — | — | — | — | — | — | 5.2 | 0.06 | 3 |
| LYD585 | 72986.1 | 0.2 | 0.07 | 9 | 9.0 | L | 21 | 5.6 | L | 10 |

TABLE 59-continued

Genes showing improved plant performance at Normal growth conditions under regulation of At6669 promoter

| Gene | | Harvest Index | | | Rosette Area [cm²] | | | Rosette Diameter [cm] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD585 | 72986.2 | 0.2 | 0.10 | 8 | 8.2 | 0.11 | 10 | 5.3 | L | 5 |
| LYD585 | 72988.3 | — | — | — | 9.3 | 0.20 | 25 | 5.5 | 0.21 | 10 |
| LYD572 | 72385.1 | — | — | — | 8.8 | 0.22 | 18 | — | — | — |
| LYD572 | 72387.1 | 0.2 | 0.16 | 7 | — | — | — | — | — | — |
| LYD571 | 72357.5 | 0.2 | L | 26 | 9.4 | 0.02 | 26 | 5.7 | L | 12 |
| LYD571 | 72358.1 | — | — | — | 8.9 | 0.03 | 19 | 5.4 | 0.02 | 8 |
| LYD571 | 72358.3 | 0.2 | 0.08 | 26 | 10.8 | L | 45 | 6.0 | L | 20 |
| LYD571 | 72358.4 | — | — | — | 8.2 | 0.03 | 11 | 5.4 | 0.16 | 6 |
| LYD571 | 72360.2 | — | — | — | 8.8 | 0.04 | 19 | 5.4 | 0.06 | 8 |
| LYD551 | 71986.4 | 0.2 | 0.15 | 7 | — | — | — | 5.5 | L | 9 |
| LYD551 | 71986.7 | — | — | — | 8.3 | 0.02 | 12 | — | — | — |
| LYD551 | 71986.9 | 0.2 | 0.03 | 21 | 7.9 | 0.27 | 6 | 5.2 | 0.17 | 2 |
| LYD548 | 72673.3 | — | — | — | 8.1 | 0.06 | 9 | 5.3 | L | 6 |
| LYD548 | 72676.1 | — | — | — | 8.9 | L | 19 | 5.5 | 0.10 | 8 |
| LYD548 | 72677.1 | — | — | — | — | — | — | 5.3 | 0.24 | 5 |
| LYD531 | 71916.1 | — | — | — | 8.5 | 0.20 | 14 | 5.4 | 0.19 | 7 |
| LYD531 | 71917.1 | 0.2 | 0.23 | 13 | 9.1 | L | 22 | 5.6 | 0.03 | 11 |
| LYD531 | 71917.2 | — | — | — | 9.0 | 0.06 | 21 | 5.6 | L | 11 |
| LYD531 | 71921.2 | — | — | — | 9.6 | L | 29 | 5.7 | L | 14 |
| LYD527 | 72241.3 | 0.2 | 0.19 | 17 | 9.0 | 0.06 | 22 | 5.5 | 0.17 | 10 |
| LYD527 | 72243.3 | — | — | — | 8.6 | L | 16 | 5.4 | 0.04 | 7 |
| LYD527 | 72243.4 | — | — | — | 7.9 | 0.19 | 6 | 5.2 | 0.27 | 3 |
| LYD527 | 72245.2 | 0.2 | L | 34 | 8.7 | L | 18 | 5.4 | L | 7 |
| LYD527 | 72246.3 | — | — | — | 9.1 | 0.01 | 22 | 5.5 | 0.07 | 9 |
| CONT. | — | 0.2 | — | — | 7.4 | — | — | 5.0 | — | — |
| LYD684 | 72271.2 | — | — | — | 6.0 | 0.25 | 9 | 4.3 | 0.17 | 3 |
| LYD684 | 72274.3 | 0.2 | 0.07 | 29 | 6.3 | 0.08 | 15 | 4.3 | 0.07 | 5 |
| LYD666 | 72391.3 | — | — | — | — | — | — | 4.2 | 0.28 | 2 |
| LYD666 | 72393.1 | 0.1 | 0.22 | 19 | 6.3 | 0.04 | 15 | — | — | — |
| LYD662 | 72008.3 | — | — | — | 6.4 | 0.01 | 17 | 4.5 | 0.11 | 10 |
| LYD662 | 72011.4 | 0.2 | 0.06 | 31 | 5.9 | 0.24 | 6 | 4.2 | 0.25 | 3 |
| LYD658 | 72277.2 | — | — | — | 5.9 | 0.17 | 7 | 4.3 | 0.15 | 4 |
| LYD658 | 72279.3 | 0.2 | 0.08 | 28 | — | — | — | — | — | — |
| LYD658 | 72282.1 | — | — | — | 6.2 | 0.04 | 13 | 4.5 | L | 8 |
| LYD645 | 72341.2 | — | — | — | 6.4 | 0.14 | 17 | 4.4 | 0.05 | 8 |
| LYD632 | 72771.1 | 0.1 | 0.27 | 18 | 6.1 | 0.24 | 10 | 4.3 | 0.06 | 5 |
| LYD631 | 72541.2 | 0.1 | 0.25 | 17 | — | — | — | — | — | — |
| LYD631 | 72544.3 | — | — | — | — | — | — | 4.2 | 0.27 | 3 |
| LYD631 | 72544.4 | — | — | — | 6.4 | 0.02 | 15 | 4.5 | 0.05 | 9 |
| LYD627 | 72764.3 | — | — | — | — | — | — | 4.4 | 0.04 | 6 |
| LYD627 | 72765.1 | — | — | — | 6.2 | 0.08 | 13 | — | — | — |
| LYD627 | 72766.1 | — | — | — | 7.3 | L | 33 | 4.8 | 0.05 | 15 |
| LYD618 | 72622.3 | — | — | — | — | — | — | 4.4 | 0.05 | 6 |
| LYD601 | 72872.2 | — | — | — | 6.4 | 0.04 | 16 | 4.5 | 0.13 | 8 |
| LYD586 | 71949.7 | — | — | — | 6.6 | 0.02 | 20 | 4.4 | 0.05 | 7 |
| LYD571 | 72357.5 | — | — | — | 6.4 | 0.07 | 16 | 4.5 | 0.15 | 8 |
| LYD571 | 72358.3 | — | — | — | 7.6 | 0.03 | 38 | 4.8 | L | 17 |
| LYD571 | 72358.4 | 0.2 | 0.04 | 38 | 6.2 | 0.10 | 13 | 4.3 | 0.24 | 5 |
| LYD571 | 72360.2 | 0.1 | 0.25 | 16 | — | — | — | — | — | — |
| LYD570 | 71936.2 | 0.1 | 0.30 | 19 | — | — | — | — | — | — |
| LYD564 | 72182.4 | 0.1 | 0.19 | 22 | 6.9 | 0.11 | 26 | 4.6 | 0.14 | 11 |
| LYD564 | 72182.5 | — | — | — | — | — | — | 4.3 | 0.19 | 4 |
| LYD564 | 72185.1 | — | — | — | 6.2 | 0.04 | 13 | 4.4 | 0.03 | 7 |
| LYD560 | 71925.1 | 0.2 | 0.07 | 29 | 6.3 | 0.04 | 14 | 4.4 | 0.01 | 8 |
| LYD560 | 71926.1 | 0.2 | 0.20 | 24 | — | — | — | — | — | — |
| LYD560 | 71927.1 | 0.2 | 0.10 | 26 | — | — | — | — | — | — |
| LYD545 | 72510.2 | 0.2 | 0.21 | 39 | 6.5 | 0.12 | 18 | 4.4 | 0.15 | 6 |
| LYD543 | 72251.2 | 0.2 | 0.11 | 34 | — | — | — | — | — | — |
| LYD543 | 72252.1 | — | — | — | 6.2 | 0.06 | 12 | 4.3 | 0.10 | 4 |
| CONT. | — | 0.1 | — | — | 5.5 | — | — | 4.1 | — | — |
| LYD672 | 72346.4 | 0.2 | 0.28 | 26 | 5.9 | 0.18 | 14 | 4.2 | 0.17 | 5 |
| LYD672 | 72347.3 | — | — | — | 6.8 | 0.16 | 30 | 4.5 | 0.20 | 14 |
| LYD668 | 72020.4 | 0.2 | 0.14 | 13 | — | — | — | — | — | — |
| LYD668 | 72023.3 | 0.2 | 0.02 | 25 | 5.8 | 0.04 | 12 | 4.1 | 0.26 | 4 |
| LYD664 | 72012.1 | 0.3 | 0.10 | 37 | 5.7 | 0.07 | 10 | 4.3 | 0.06 | 7 |
| LYD664 | 72015.2 | — | — | — | 5.6 | 0.22 | 8 | — | — | — |
| LYD664 | 72016.2 | — | — | — | 6.6 | L | 28 | 4.4 | 0.01 | 11 |
| LYD664 | 72017.7 | 0.2 | 0.26 | 15 | — | — | — | — | — | — |
| LYD664 | 72017.8 | 0.2 | 0.09 | 22 | 5.9 | 0.16 | 14 | — | — | — |
| LYD661 | 72326.1 | 0.2 | 0.20 | 11 | — | — | — | — | — | — |
| LYD661 | 72328.2 | — | — | — | 7.0 | 0.28 | 35 | 4.6 | 0.27 | 14 |
| LYD661 | 72329.2 | 0.3 | 0.01 | 32 | 6.4 | 0.07 | 23 | 4.4 | 0.13 | 10 |
| LYD657 | 72400.1 | 0.2 | 0.01 | 22 | — | — | — | — | — | — |

TABLE 59-continued

Genes showing improved plant performance at Normal growth conditions under regulation of At6669 promoter

| Gene | | Harvest Index | | | Rosette Area [cm²] | | | Rosette Diameter [cm] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD657 | 72400.3 | — | — | — | 6.8 | 0.26 | 32 | 4.6 | 0.29 | 15 |
| LYD657 | 72401.2 | 0.3 | L | 29 | — | — | — | 4.2 | 0.27 | 5 |
| LYD657 | 72402.1 | 0.3 | 0.07 | 30 | — | — | — | — | — | — |
| LYD580 | 72188.2 | 0.2 | 0.03 | 18 | 6.5 | L | 24 | 4.5 | 0.08 | 12 |
| LYD580 | 72189.1 | — | — | — | 6.1 | 0.01 | 17 | 4.3 | 0.05 | 7 |
| LYD580 | 72191.1 | 0.2 | 0.10 | 17 | — | — | — | — | — | — |
| LYD580 | 72192.3 | 0.3 | 0.14 | 48 | 6.5 | L | 25 | 4.5 | L | 12 |
| LYD573 | 72973.2 | 0.2 | 0.11 | 12 | — | — | — | — | — | — |
| LYD573 | 72977.1 | 0.2 | 0.17 | 19 | — | — | — | — | — | — |
| LYD561 | 72177.1 | 0.2 | 0.28 | 12 | — | — | — | 4.2 | 0.28 | 6 |
| LYD561 | 72177.2 | 0.2 | 0.16 | 23 | — | — | — | — | — | — |
| LYD561 | 72178.1 | — | — | — | 6.4 | 0.19 | 23 | 4.3 | 0.15 | 9 |
| LYD560 | 71922.1 | 0.3 | L | 29 | — | — | — | — | — | — |
| LYD560 | 71925.1 | 0.2 | 0.11 | 16 | 6.1 | 0.25 | 17 | — | — | — |
| LYD560 | 71926.1 | 0.2 | 0.01 | 21 | — | — | — | — | — | — |
| LYD554 | 72174.4 | 0.2 | 0.10 | 24 | — | — | — | — | — | — |
| LYD553 | 72741.2 | 0.2 | 0.06 | 15 | 5.6 | 0.29 | 8 | 4.2 | 0.09 | 6 |
| LYD553 | 72743.2 | 0.2 | 0.26 | 9 | — | — | — | — | — | — |
| LYD547 | 71978.2 | — | — | — | 7.2 | 0.12 | 38 | 4.7 | 0.06 | 17 |
| LYD547 | 71978.3 | — | — | — | 6.4 | 0.29 | 22 | 4.4 | 0.28 | 12 |
| LYD547 | 71980.1 | 0.2 | 0.19 | 24 | 5.9 | 0.08 | 14 | — | — | — |
| LYD547 | 71980.3 | 0.2 | 0.25 | 21 | 5.9 | 0.07 | 14 | 4.2 | 0.14 | 5 |
| LYD538 | 72835.2 | 0.2 | L | 25 | 5.6 | 0.13 | 8 | 4.2 | 0.15 | 5 |
| LYD528 | 72310.1 | 0.3 | L | 39 | — | — | — | — | — | — |
| LYD528 | 72311.1 | — | — | — | 5.7 | 0.12 | 10 | 4.2 | 0.21 | 5 |
| LYD528 | 72312.2 | 0.2 | 0.07 | 24 | — | — | — | — | — | — |
| LYD528 | 72312.3 | — | — | — | 5.7 | 0.11 | 9 | 4.3 | 0.12 | 7 |
| LYD528 | 72312.4 | 0.2 | 0.16 | 18 | — | — | — | — | — | — |
| LYD522 | 72716.6 | 0.2 | 0.25 | 25 | — | — | — | — | — | — |
| LYD522 | 72720.1 | — | — | — | 6.2 | 0.02 | 20 | 4.3 | 0.02 | 9 |
| LYD522 | 72720.2 | — | — | — | 6.2 | 0.30 | 18 | — | — | — |
| LYD521 | 72607.1 | 0.3 | 0.24 | 34 | 6.9 | 0.07 | 32 | 4.5 | 0.10 | 13 |
| LYD521 | 72610.1 | 0.2 | 0.24 | 12 | — | — | — | — | — | — |
| LYD521 | 72610.2 | 0.3 | 0.23 | 28 | 7.3 | 0.22 | 40 | — | — | — |
| LYD521 | 72611.1 | 0.2 | 0.01 | 22 | — | — | — | — | — | — |
| CONT. | — | 0.2 | — | — | 5.2 | — | — | 4.0 | — | — |
| LYD683 | 72870.1 | — | — | — | 5.5 | 0.05 | 26 | 4.1 | L | 13 |
| LYD682 | 72565.1 | — | — | — | — | — | — | 3.9 | 0.14 | 7 |
| LYD682 | 72566.1 | — | — | — | 5.8 | L | 33 | 4.2 | L | 15 |
| LYD682 | 72568.2 | 0.1 | 0.26 | 14 | 5.7 | 0.02 | 31 | 4.2 | L | 16 |
| LYD678 | 72787.2 | — | — | — | 5.2 | 0.03 | 18 | 3.9 | 0.05 | 8 |
| LYD665 | 72211.2 | — | — | — | 5.6 | L | 27 | 4.0 | L | 11 |
| LYD665 | 72216.5 | — | — | — | — | — | — | 3.8 | 0.07 | 5 |
| LYD650 | 72639.4 | — | — | — | 5.2 | 0.02 | 18 | 4.1 | L | 13 |
| LYD644 | 72775.1 | — | — | — | 5.1 | 0.03 | 17 | 3.9 | 0.03 | 8 |
| LYD644 | 72775.2 | — | — | — | 5.6 | 0.17 | 29 | 4.1 | 0.15 | 14 |
| LYD644 | 72780.2 | 0.1 | 0.19 | 42 | 5.3 | 0.12 | 21 | 4.0 | 0.03 | 10 |
| LYD639 | 72548.4 | — | — | — | 5.5 | L | 26 | 4.1 | L | 12 |
| LYD639 | 72548.6 | — | — | — | 5.1 | 0.29 | 16 | 3.9 | 0.22 | 8 |
| LYD639 | 72549.3 | — | — | — | 5.1 | 0.02 | 17 | 4.0 | 0.01 | 10 |
| LYD639 | 72551.1 | — | — | — | 5.1 | 0.22 | 17 | — | — | — |
| LYD639 | 72551.2 | 0.1 | 0.27 | 18 | 5.6 | L | 27 | 4.2 | L | 17 |
| LYD630 | 72404.3 | — | — | — | 6.4 | L | 45 | 4.5 | L | 23 |
| LYD626 | 72002.1 | 0.1 | 0.11 | 49 | 5.0 | 0.04 | 15 | 4.0 | 0.02 | 9 |
| LYD626 | 72004.4 | 0.1 | 0.23 | 26 | 5.1 | 0.08 | 16 | 3.9 | 0.07 | 8 |
| LYD606 | 72500.5 | — | — | — | 5.1 | 0.03 | 16 | 4.0 | L | 11 |
| LYD606 | 72501.1 | — | — | — | — | — | — | 3.8 | 0.26 | 4 |
| LYD577 | 72745.4 | — | — | — | 5.2 | 0.01 | 20 | 4.1 | L | 13 |
| LYD577 | 72747.4 | — | — | — | 4.8 | 0.11 | 10 | 3.9 | 0.03 | 8 |
| LYD577 | 72748.2 | — | — | — | 5.1 | 0.02 | 17 | 4.1 | L | 12 |
| LYD577 | 72750.4 | 0.1 | 0.26 | 32 | 5.5 | 0.29 | 26 | 4.1 | 0.21 | 13 |
| LYD536 | 72529.2 | — | — | — | 5.5 | 0.20 | 26 | 4.2 | 0.17 | 15 |
| LYD536 | 72529.5 | — | — | — | 5.5 | L | 26 | 4.1 | L | 13 |
| LYD536 | 72534.2 | — | — | — | 5.0 | 0.05 | 14 | 3.9 | 0.04 | 8 |
| LYD526 | 72164.4 | — | — | — | 5.9 | 0.13 | 36 | 4.2 | 0.11 | 17 |
| LYD526 | 72167.4 | — | — | — | 6.7 | L | 53 | 4.5 | L | 23 |
| LYD526 | 72168.1 | 0.1 | 0.07 | 33 | 5.3 | 0.01 | 21 | 4.0 | 0.10 | 9 |
| CONT. | — | 0.1 | — | — | 4.4 | — | — | 3.6 | — | — |
| LYD683 | 72867.2 | — | — | — | 7.2 | 0.20 | 10 | 4.7 | 0.20 | 5 |
| LYD674 | 72253.6 | 0.2 | 0.12 | 17 | 7.3 | 0.24 | 11 | — | — | — |
| LYD674 | 72255.1 | 0.2 | 0.10 | 23 | — | — | — | — | — | — |
| LYD664 | 72016.2 | — | — | — | 7.2 | 0.21 | 10 | 4.7 | 0.23 | 5 |
| LYD664 | 72017.8 | 0.2 | L | 25 | 8.7 | L | 32 | 5.1 | 0.05 | 13 |

TABLE 59-continued

Genes showing improved plant performance at Normal growth conditions under regulation of At6669 promoter

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| LYD643 | 72336.3 | 0.2 | 0.02 | 10 | 8.5 | 0.22 | 30 | — | — | — |
| LYD642 | 71824.5 | — | — | — | 7.3 | 0.16 | 11 | 4.8 | 0.12 | 7 |
| LYD642 | 71825.1 | 0.2 | L | 14 | — | — | — | — | — | — |
| LYD634 | 71995.1 | — | — | — | 7.6 | 0.13 | 16 | — | — | — |
| LYD634 | 71999.3 | 0.2 | L | 17 | — | — | — | — | — | — |
| LYD629 | 72195.1 | — | — | — | 7.4 | 0.13 | 12 | 4.7 | 0.17 | 6 |
| LYD629 | 72198.2 | 0.2 | L | 19 | 7.8 | 0.27 | 19 | 4.9 | 0.27 | 9 |
| LYD629 | 72198.5 | — | — | — | 8.9 | L | 35 | 5.2 | L | 16 |
| LYD622 | 72027.5 | 0.2 | L | 24 | — | — | — | — | — | — |
| LYD617 | 71966.6 | — | — | — | — | — | — | 4.7 | 0.22 | 5 |
| LYD595 | 72909.1 | — | — | — | 7.7 | 0.18 | 17 | 4.8 | 0.17 | 8 |
| LYD595 | 72910.3 | — | — | — | 7.4 | 0.13 | 12 | — | — | — |
| LYD567 | 72496.2 | 0.2 | 0.02 | 12 | 8.0 | 0.02 | 21 | 4.8 | 0.09 | 7 |
| LYD567 | 72496.3 | 0.2 | 0.20 | 5 | — | — | — | — | — | — |
| LYD561 | 72175.4 | 0.2 | 0.11 | 11 | — | — | — | — | — | — |
| LYD561 | 72177.1 | — | — | — | 7.4 | 0.12 | 13 | 4.7 | 0.26 | 5 |
| LYD553 | 72743.2 | 0.2 | 0.01 | 16 | 7.4 | 0.21 | 12 | 4.9 | 0.10 | 9 |
| LYD547 | 71978.3 | — | — | — | 7.6 | 0.06 | 16 | 4.8 | 0.13 | 8 |
| LYD547 | 71981.2 | — | — | — | 8.2 | 0.01 | 24 | 5.0 | 0.02 | 12 |
| LYD531 | 71921.2 | — | — | — | 8.2 | 0.06 | 25 | 4.9 | 0.04 | 10 |
| CONT. | — | 0.2 | — | — | 6.6 | — | — | 4.5 | — | — |

Table 59. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

TABLE 60

Genes showing improved plant performance at Normal growth conditions under regulation of At6669 promoter

| Gene Name | Event # | Seed Yield [mg] Ave. | Seed Yield [mg] P-Val. | Seed Yield [mg] % Incr. | 1000 Seed Weight [mg] Ave. | 1000 Seed Weight [mg] P-Val. | 1000 Seed Weight [mg] % Incr. |
|---|---|---|---|---|---|---|---|
| LYD689 | 72111.2 | 205.6 | 0.26 | 33 | 27.5 | 0.25 | 19 |
| LYD689 | 72713.1 | 171.1 | 0.25 | 10 | 25.2 | 0.02 | 9 |
| LYD677 | 72227.1 | 191.4 | 0.04 | 23 | 24.3 | 0.21 | 6 |
| LYD675 | 72643.1 | 175.7 | 0.16 | 13 | — | — | — |
| LYD675 | 72644.3 | 173.1 | 0.21 | 12 | — | — | — |
| LYD641 | 72632.2 | 198.5 | 0.10 | 28 | — | — | — |
| LYD641 | 72635.2 | 179.0 | 0.14 | 15 | 23.8 | 0.14 | 3 |
| LYD636 | 72204.1 | — | — | — | 27.0 | 0.27 | 17 |
| LYD625 | 72752.4 | 187.9 | 0.05 | 21 | — | — | — |
| LYD625 | 72756.2 | — | — | — | 25.3 | 0.21 | 10 |
| LYD599 | 72270.5 | 183.2 | 0.07 | 18 | — | — | — |
| LYD573 | 72977.1 | 186.6 | 0.25 | 20 | — | — | — |
| CONT. | — | 155.2 | — | — | 23.1 | — | — |
| LYD667 | 72030.4 | — | — | — | 18.8 | 0.30 | 3 |
| LYD667 | 72035.6 | 175.8 | 0.11 | 13 | — | — | — |
| LYD635 | 72626.1 | 185.3 | 0.27 | 20 | — | — | — |
| LYD635 | 72630.2 | — | — | — | 21.7 | 0.22 | 19 |
| LYD632 | 72769.2 | 170.0 | 0.22 | 10 | — | — | — |
| LYD632 | 72770.2 | — | — | — | 19.3 | 0.06 | 5 |
| LYD632 | 72771.1 | — | — | — | 20.2 | L | 10 |
| LYD632 | 72774.4 | 204.8 | 0.05 | 32 | — | — | — |
| LYD631 | 72542.3 | 180.0 | 0.07 | 16 | 20.2 | 0.21 | 11 |
| LYD631 | 72544.1 | 174.3 | 0.26 | 13 | — | — | — |
| LYD631 | 72544.4 | — | — | — | 21.3 | L | 17 |
| LYD627 | 72764.3 | — | — | — | 20.3 | 0.14 | 11 |
| LYD627 | 72765.1 | — | — | — | 19.6 | 0.02 | 7 |
| LYD627 | 72766.1 | — | — | — | 19.8 | 0.06 | 8 |
| LYD623 | 71970.2 | 185.5 | 0.08 | 20 | — | — | — |
| LYD623 | 71974.1 | 215.8 | 0.26 | 39 | 19.1 | 0.12 | 4 |
| LYD618 | 72621.2 | — | — | — | 19.3 | 0.09 | 5 |
| LYD618 | 72622.2 | 202.6 | 0.04 | 31 | — | — | — |
| LYD618 | 72624.4 | 196.1 | 0.18 | 27 | 21.4 | 0.29 | 17 |
| LYD612 | 71817.3 | 186.8 | 0.07 | 21 | — | — | — |
| LYD603 | 72536.2 | 196.2 | 0.20 | 27 | — | — | — |
| LYD603 | 72537.3 | 180.7 | 0.06 | 17 | — | — | — |
| LYD603 | 72537.7 | 209.6 | 0.19 | 35 | — | — | — |
| LYD585 | 72986.1 | 209.3 | 0.09 | 35 | — | — | — |
| LYD585 | 72986.2 | 203.8 | L | 32 | — | — | — |
| LYD585 | 72986.4 | 188.1 | 0.02 | 21 | — | — | — |
| LYD585 | 72988.3 | 186.2 | 0.25 | 20 | 19.8 | 0.05 | 8 |
| LYD572 | 72387.1 | 176.6 | 0.24 | 14 | — | — | — |
| LYD572 | 72388.2 | 185.3 | 0.24 | 20 | — | — | — |
| LYD571 | 72357.5 | 210.4 | L | 36 | — | — | — |
| LYD571 | 72358.3 | 199.2 | 0.05 | 29 | 20.8 | L | 14 |
| LYD551 | 71986.4 | 209.9 | 0.02 | 35 | — | — | — |
| LYD551 | 71986.7 | 203.3 | 0.11 | 31 | — | — | — |
| LYD551 | 71986.9 | 206.2 | 0.04 | 33 | — | — | — |
| LYD531 | 71916.1 | — | — | — | 20.7 | L | 13 |
| LYD531 | 71917.1 | 193.3 | 0.11 | 25 | — | — | — |
| LYD531 | 71917.2 | — | — | — | 20.0 | 0.03 | 9 |
| LYD527 | 72241.3 | 197.2 | L | 27 | — | — | — |
| LYD527 | 72245.2 | 207.2 | 0.17 | 34 | — | — | — |
| LYD527 | 72246.3 | 190.5 | 0.04 | 23 | — | — | — |
| CONT. | — | 154.9 | — | — | 18.3 | — | — |
| LYD684 | 72274.3 | 166.6 | 0.25 | 19 | — | — | — |
| LYD666 | 72393.1 | 163.6 | 0.29 | 17 | — | — | — |
| LYD662 | 72011.4 | 188.5 | 0.05 | 35 | — | — | — |
| LYD658 | 72282.1 | — | — | — | 20.6 | 0.02 | 5 |
| LYD632 | 72771.1 | — | — | — | 22.7 | L | 15 |
| LYD632 | 72774.3 | — | — | — | 20.5 | 0.05 | 4 |
| LYD631 | 72544.4 | — | — | — | 21.8 | 0.02 | 10 |
| LYD627 | 72764.3 | — | — | — | 21.7 | 0.18 | 10 |
| LYD627 | 72765.1 | — | — | — | 23.3 | 0.07 | 18 |
| LYD601 | 72872.2 | — | — | — | 20.2 | 0.23 | 2 |
| LYD571 | 72358.1 | — | — | — | 21.1 | 0.16 | 7 |
| LYD571 | 72358.3 | 173.9 | 0.28 | 24 | 22.8 | 0.03 | 16 |
| LYD571 | 72358.4 | 190.9 | 0.06 | 36 | 20.3 | 0.25 | 3 |
| LYD570 | 71935.1 | — | — | — | 20.8 | L | 6 |
| LYD570 | 71936.2 | — | — | — | 20.6 | 0.26 | 4 |
| LYD564 | 72182.4 | 172.7 | 0.28 | 23 | — | — | — |
| LYD564 | 72182.5 | — | — | — | 21.0 | 0.07 | 7 |
| LYD560 | 71925.1 | 179.4 | 0.10 | 28 | — | — | — |
| LYD560 | 71927.1 | 170.0 | 0.20 | 21 | — | — | — |
| LYD545 | 72510.2 | 183.4 | 0.23 | 31 | — | — | — |

TABLE 60-continued

Genes showing improved plant performance at Normal growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LYD543 | 72251.2 | 175.6 | 0.23 | 25 | — | — | — |
| CONT. | — | 140.1 | — | — | 19.7 | — | — |
| LYD672 | 72347.2 | 268.4 | L | 36 | — | — | — |
| LYD672 | 72347.3 | — | — | — | 22.7 | 0.10 | 13 |
| LYD672 | 72348.1 | 220.3 | 0.15 | 11 | — | — | — |
| LYD668 | 72020.2 | — | — | — | 21.5 | 0.25 | 1 |
| LYD668 | 72023.1 | — | — | — | 21.6 | 0.16 | 8 |
| LYD668 | 72023.3 | 218.8 | 0.15 | 11 | — | — | — |
| LYD664 | 72012.1 | 244.8 | 0.01 | 24 | — | — | — |
| LYD664 | 72015.2 | 225.2 | 0.07 | 14 | — | — | — |
| LYD664 | 72017.7 | 227.5 | 0.06 | 15 | — | — | — |
| LYD664 | 72017.8 | 254.0 | 0.04 | 28 | — | — | — |
| LYD661 | 72325.1 | — | — | — | 23.6 | 0.11 | 18 |
| LYD661 | 72329.2 | 258.5 | L | 31 | — | — | — |
| LYD657 | 72400.1 | 222.1 | 0.15 | 12 | — | — | — |
| LYD657 | 72401.2 | 233.5 | 0.03 | 18 | — | — | — |
| LYD657 | 72402.1 | 249.7 | 0.04 | 26 | — | — | — |
| LYD580 | 72188.2 | 246.1 | L | 24 | 21.6 | 0.08 | 8 |
| LYD580 | 72189.2 | 248.5 | 0.24 | 26 | — | — | — |
| LYD580 | 72192.3 | 277.0 | 0.13 | 40 | — | — | — |
| LYD561 | 72177.2 | 246.7 | L | 25 | — | — | — |
| LYD561 | 72179.1 | 221.4 | 0.19 | 12 | — | — | — |
| LYD560 | 71922.1 | 239.6 | 0.14 | 21 | — | — | — |
| LYD560 | 71925.1 | 243.7 | 0.01 | 23 | — | — | — |
| LYD560 | 71926.1 | 238.5 | 0.06 | 20 | — | — | — |
| LYD554 | 72174.4 | 241.0 | 0.02 | 22 | — | — | — |
| LYD547 | 71978.2 | — | — | — | 22.5 | 0.06 | 12 |
| LYD547 | 71980.3 | 215.7 | 0.21 | 9 | — | — | — |
| LYD538 | 72835.2 | 243.9 | 0.02 | 23 | — | — | — |
| LYD528 | 72310.1 | 277.8 | L | 40 | — | — | — |
| LYD528 | 72312.2 | 236.6 | 0.17 | 19 | — | — | — |
| LYD528 | 72312.4 | 237.6 | 0.28 | 20 | — | — | — |
| LYD522 | 72716.2 | 244.8 | 0.19 | 24 | — | — | — |
| LYD522 | 72716.6 | 247.0 | 0.21 | 25 | — | — | — |
| LYD521 | 72611.1 | 237.8 | 0.28 | 20 | — | — | — |
| CONT. | — | 198.0 | — | — | 20.0 | — | — |
| LYD682 | 72566.1 | — | — | — | 25.2 | 0.29 | 6 |
| LYD682 | 72568.2 | 100.2 | 0.17 | 17 | — | — | — |
| LYD665 | 72211.2 | — | — | — | 26.3 | 0.01 | 11 |
| LYD644 | 72780.2 | 126.2 | 0.29 | 48 | — | — | — |
| LYD630 | 72404.3 | 116.1 | 0.28 | 36 | 26.6 | 0.04 | 12 |
| LYD626 | 72002.1 | 134.7 | 0.05 | 58 | — | — | — |
| LYD626 | 72004.4 | 105.6 | 0.07 | 24 | — | — | — |
| LYD606 | 72500.2 | — | — | — | 24.9 | 0.12 | 5 |
| LYD577 | 72750.4 | 106.8 | 0.06 | 25 | — | — | — |
| LYD526 | 72167.4 | — | — | — | 24.8 | 0.14 | 5 |
| LYD526 | 72168.1 | 113.5 | 0.03 | 33 | — | — | — |
| CONT. | — | 85.5 | — | — | 23.7 | — | — |
| LYD683 | 72866.4 | — | — | — | 20.4 | 0.29 | 4 |
| LYD674 | 72255.1 | 246.4 | 0.16 | 28 | — | — | — |
| LYD664 | 72015.2 | 208.6 | L | 9 | 20.1 | 0.24 | 3 |
| LYD664 | 72016.2 | 197.0 | 0.30 | 3 | 21.1 | 0.01 | 8 |
| LYD643 | 72333.2 | — | — | — | 20.1 | 0.25 | 3 |
| LYD643 | 72336.3 | — | — | — | 22.9 | 0.08 | 17 |
| LYD643 | 72336.6 | — | — | — | 21.4 | 0.05 | 9 |
| LYD642 | 71824.5 | — | — | — | 24.0 | 0.13 | 23 |
| LYD634 | 71995.1 | — | — | — | 25.0 | 0.08 | 28 |
| LYD634 | 71999.3 | 230.6 | 0.04 | 20 | — | — | — |
| LYD629 | 72195.1 | — | — | — | 20.4 | 0.29 | 4 |
| LYD629 | 72198.5 | 200.8 | 0.08 | 5 | 21.8 | L | 12 |
| LYD622 | 72027.5 | — | — | — | 20.9 | 0.17 | 7 |
| LYD622 | 72028.3 | — | — | — | 20.9 | 0.02 | 7 |
| LYD617 | 71964.2 | — | — | — | 20.0 | 0.26 | 3 |
| LYD617 | 71966.6 | 219.6 | 0.28 | 14 | — | — | — |
| LYD603 | 72537.3 | 215.9 | 0.21 | 12 | — | — | — |
| LYD595 | 72909.1 | — | — | — | 21.6 | 0.11 | 11 |
| LYD595 | 72910.3 | 206.8 | 0.04 | 8 | — | — | — |
| LYD567 | 72495.3 | — | — | — | 20.2 | 0.19 | 4 |
| LYD567 | 72496.2 | 217.3 | L | 13 | — | — | — |
| LYD561 | 72175.4 | 212.5 | 0.21 | 11 | — | — | — |
| LYD561 | 72177.1 | 215.3 | 0.04 | 12 | — | — | — |
| LYD561 | 72177.2 | — | — | — | 20.5 | 0.28 | 5 |
| LYD553 | 72743.1 | 252.0 | 0.29 | 31 | — | — | — |
| LYD547 | 71978.3 | 209.6 | L | 9 | — | — | — |
| LYD547 | 71980.3 | — | — | — | 20.3 | 0.19 | 4 |
| LYD547 | 71981.2 | — | — | — | 22.8 | 0.23 | 17 |
| LYD534 | 72411.2 | — | — | — | 20.3 | 0.12 | 4 |
| LYD534 | 72414.3 | 224.6 | 0.27 | 17 | 20.9 | 0.03 | 7 |
| LYD521 | 72607.1 | — | — | — | 20.2 | 0.22 | 4 |
| LYD521 | 72610.2 | — | — | — | 20.1 | 0.24 | 3 |
| CONT. | — | 192.1 | — | — | 19.5 | — | — |

Table 60. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

Example 16

Evaluation of Transgenic Arabidopsis for Seed Yield and Plant Growth Rate Under Normal Conditions in Greenhouse Assays Until Bolting (GH-SB Assays)

Assay 2: Plant performance improvement measured until bolting stage: plant biomass and plant growth rate under normal greenhouse conditions (GH-SB Assays)—This assay follows the plant biomass formation and the rosette area growth of plants grown in the greenhouse under normal growth conditions. Transgenic Arabidopsis seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing of 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until bolting stage. Plant biomass (the above ground tissue) was weight in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the 35S promoter and the selectable marker was used as control.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number (Formula IX, described above), rosette area (Formula VIII described above) and plot coverage (Formula XIV, described above) were calculated using the indicated formulas.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Experimental Results:

Tables 61-63 summarize the observed phenotypes of transgenic plants expressing the genes constructs using the GH-SB Assays.

The genes listed in Tables 61-63 improved plant performance when grown at normal conditions. These genes produced larger plants with a larger photosynthetic area, biomass (fresh weight, dry weight, rosette diameter, rosette area and plot coverage), and relative growth rate (of leaf number, plot coverage and rosette diameter) as compared to control plants grown under identical growth conditions. The genes were cloned under the regulation of a constitutive At6669 promoter (SEQ ID NO:4111). The evaluation of each gene was performed by testing the performance of different number of events. Event with p-value <0.1 was considered statistically significant.

TABLE 61

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LYD684 | 72211.4 | 377.2 | 0.04 | 13 | 4795.5 | 0.01 | 11 | — | — | — |
| LYD684 | 72274.1 | 379.4 | L | 14 | 4718.8 | L | 9 | 11.1 | 0.03 | 7 |
| LYD672 | 72347.3 | 364.8 | L | 9 | 4987.5 | L | 15 | — | — | — |
| LYD667 | 72030.1 | 368.8 | 0.07 | 11 | 4643.8 | L | 7 | — | — | — |
| LYD667 | 72031.1 | 371.9 | 0.03 | 11 | 4575.0 | 0.02 | 6 | — | — | — |
| LYD661 | 72325.1 | 366.2 | L | 10 | 4831.2 | L | 12 | 11.9 | 0.17 | 14 |
| LYD661 | 72328.1 | 358.3 | 0.02 | 7 | — | — | — | 11.1 | 0.23 | 6 |
| LYD661 | 72328.2 | — | — | — | — | — | — | 10.8 | 0.11 | 4 |
| LYD651 | 73026.4 | — | — | — | 4675.0 | L | 8 | — | — | — |
| LYD626 | 72004.4 | — | — | — | — | — | — | 11.2 | 0.01 | 8 |
| LYD620 | 73066.3 | 359.4 | L | 8 | 4681.2 | L | 8 | 11.4 | 0.07 | 9 |
| LYD617 | 71966.2 | 349.4 | 0.05 | 5 | 4581.2 | 0.10 | 6 | — | — | — |
| LYD617 | 71966.3 | 358.1 | 0.04 | 7 | 4600.0 | 0.11 | 6 | — | — | — |
| LYD617 | 71966.6 | 345.6 | 0.11 | 4 | 4568.8 | 0.15 | 6 | 11.4 | 0.02 | 10 |
| LYD612 | 71814.5 | — | — | — | 4618.8 | 0.01 | 7 | — | — | — |
| LYD612 | 71818.3 | 350.6 | 0.07 | 5 | — | — | — | — | — | — |
| LYD609 | 73124.4 | — | — | — | 4943.8 | 0.01 | 14 | 11.2 | 0.22 | 8 |
| LYD609 | 73125.3 | — | — | — | 4581.2 | 0.29 | 6 | — | — | — |
| LYD609 | 73125.4 | 365.6 | 0.10 | 10 | 4543.8 | 0.06 | 5 | 10.9 | 0.05 | 5 |
| LYD596 | 73639.1 | 360.0 | 0.01 | 8 | 4506.2 | 0.19 | 4 | — | — | — |
| LYD593 | 71952.1 | 365.0 | 0.03 | 9 | 4593.8 | 0.02 | 6 | — | — | — |
| LYD593 | 71957.5 | 347.1 | 0.09 | 4 | — | — | — | — | — | — |
| LYD574 | 73118.4 | 376.9 | 0.02 | 13 | 4783.0 | L | 11 | 11.1 | 0.03 | 7 |
| LYD574 | 73122.3 | 371.9 | L | 11 | 4625.0 | L | 7 | — | — | — |
| LYD564 | 72182.4 | — | — | — | 4437.5 | 0.23 | 3 | — | — | — |
| LYD558 | 73112.3 | 390.0 | 0.16 | 17 | 5143.8 | L | 19 | 11.4 | 0.18 | 9 |
| LYD558 | 73114.3 | — | — | — | 4600.9 | L | 6 | 11.2 | 0.01 | 8 |
| LYD527 | 72241.3 | — | — | — | 4662.5 | 0.22 | 8 | — | — | — |
| LYD527 | 72243.4 | — | — | — | 4581.2 | 0.07 | 6 | — | — | — |
| LYD527 | 72246.3 | 378.1 | 0.11 | 13 | 4781.2 | L | 11 | — | — | — |
| LYD526 | 72164.4 | 367.5 | 0.17 | 10 | 4518.8 | 0.13 | 5 | — | — | — |
| LYD526 | 72164.5 | — | — | — | — | — | — | 10.8 | 0.11 | 4 |
| LYD526 | 72167.4 | — | — | — | 4687.5 | 0.06 | 8 | 10.9 | 0.27 | 4 |
| LYD526 | 72168.1 | — | — | — | 4475.0 | 0.10 | 4 | — | — | — |
| CONT. | — | 333.6 | — | — | 4322.7 | — | — | 10.4 | — | — |
| LYD680 | 72230.2 | — | — | — | — | — | — | 9.8 | 0.26 | 5 |
| LYD680 | 72232.1 | — | — | — | — | — | — | 10.2 | 0.06 | 10 |
| LYD668 | 72019.2 | — | — | — | — | — | — | 9.8 | L | 6 |
| LYD668 | 72019.3 | — | — | — | — | — | — | 9.9 | 0.03 | 7 |
| LYD668 | 72020.2 | 257.1 | 0.03 | 15 | 3474.1 | 0.29 | 11 | 9.6 | 0.02 | 4 |

TABLE 61-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LYD668 | 72023.3 | 262.0 | 0.07 | 17 | 3536.6 | 0.17 | 13 | — | — | — |
| LYD664 | 72012.1 | 277.9 | 0.12 | 24 | 3435.7 | 0.28 | 9 | 9.9 | 0.20 | 7 |
| LYD664 | 72015.2 | — | — | — | — | — | — | 9.9 | 0.03 | 7 |
| LYD664 | 72016.2 | 235.0 | 0.30 | 5 | 3450.0 | 0.01 | 10 | 9.9 | 0.03 | 7 |
| LYD664 | 72017.8 | 260.0 | 0.03 | 16 | 3356.2 | 0.05 | 7 | 9.9 | 0.10 | 7 |
| LYD661 | 72325.1 | — | — | — | 3386.6 | 0.17 | 8 | 9.6 | 0.12 | 4 |
| LYD661 | 72325.4 | 236.9 | 0.28 | 6 | 3400.0 | 0.19 | 8 | — | — | — |
| LYD661 | 72328.2 | 258.1 | 0.01 | 15 | 3700.0 | L | 18 | 9.9 | 0.03 | 7 |
| LYD661 | 72329.2 | — | — | — | 3481.2 | 0.29 | 11 | — | — | — |
| LYD657 | 72400.1 | 236.2 | 0.26 | 6 | — | — | — | — | — | — |
| LYD657 | 72400.3 | — | — | — | 3630.4 | 0.13 | 16 | — | — | — |
| LYD657 | 72401.1 | 280.5 | 0.04 | 25 | 3461.6 | 0.16 | 10 | — | — | — |
| LYD657 | 72401.2 | — | — | — | 3325.0 | 0.14 | 6 | — | — | — |
| LYD642 | 71820.2 | — | — | — | — | — | — | 9.7 | 0.02 | 5 |
| LYD642 | 71824.5 | 290.0 | 0.23 | 30 | 3868.8 | 0.23 | 23 | 10.8 | 0.15 | 17 |
| LYD642 | 71825.1 | — | — | — | 3368.8 | 0.28 | 7 | 9.9 | 0.03 | 7 |
| LYD642 | 71825.3 | — | — | — | 3356.2 | 0.06 | 7 | 9.7 | 0.20 | 5 |
| LYD631 | 72541.2 | — | — | — | — | — | — | 9.6 | 0.07 | 3 |
| LYD631 | 72544.3 | 268.2 | 0.10 | 20 | 3484.5 | 0.08 | 11 | — | — | — |
| LYD631 | 72544.4 | — | — | — | 3318.8 | 0.17 | 6 | — | — | — |
| LYD621 | 72571.1 | 248.1 | 0.06 | 11 | 3431.2 | 0.17 | 9 | — | — | — |
| LYD621 | 72573.6 | 272.5 | 0.01 | 22 | 3681.2 | 0.21 | 17 | 9.8 | 0.25 | 6 |
| LYD621 | 72574.1 | — | — | — | 3468.8 | 0.14 | 11 | — | — | — |
| LYD618 | 72621.2 | — | — | — | 3393.8 | 0.03 | 8 | 9.6 | 0.02 | 4 |
| LYD618 | 72622.2 | — | — | — | 3562.5 | 0.20 | 13 | — | — | — |
| LYD618 | 72622.3 | 247.5 | 0.14 | 11 | 3550.0 | 0.16 | 13 | — | — | — |
| LYD618 | 72624.4 | 255.7 | 0.13 | 14 | 3592.9 | 0.03 | 14 | 9.9 | 0.03 | 7 |
| LYD603 | 72535.2 | — | — | — | 3393.8 | 0.05 | 8 | — | — | — |
| LYD603 | 72536.1 | — | — | — | 3318.8 | 0.17 | 6 | — | — | — |
| LYD603 | 72537.7 | — | — | — | 3487.5 | L | 11 | — | — | — |
| LYD572 | 72388.2 | 240.6 | 0.18 | 8 | — | — | — | 9.4 | 0.25 | 2 |
| LYD572 | 72390.3 | — | — | — | — | — | — | 9.9 | L | 7 |
| LYD568 | 71930.1 | 240.6 | 0.16 | 8 | 3487.5 | L | 11 | 9.7 | 0.02 | 5 |
| LYD568 | 71931.2 | — | — | — | 3406.2 | 0.20 | 9 | — | — | — |
| LYD568 | 71931.4 | — | — | — | 3581.2 | L | 14 | 9.6 | 0.12 | 4 |
| LYD561 | 72175.4 | — | — | — | — | — | — | 9.8 | L | 6 |
| LYD561 | 72177.1 | — | — | — | 3362.5 | 0.24 | 7 | 10.1 | 0.20 | 9 |
| LYD561 | 72179.1 | — | — | — | — | — | — | 9.8 | 0.06 | 5 |
| LYD551 | 71986.9 | 238.1 | 0.20 | 6 | 3312.5 | 0.11 | 6 | 10.0 | 0.02 | 8 |
| LYD531 | 71916.3 | — | — | — | 3343.8 | 0.06 | 7 | 9.8 | 0.26 | 5 |
| LYD531 | 71917.1 | — | — | — | 3406.2 | 0.06 | 9 | — | — | — |
| LYD531 | 71917.2 | — | — | — | 3400.0 | 0.22 | 8 | 9.8 | L | 6 |
| LYD531 | 71918.1 | 258.8 | 0.08 | 16 | 3562.5 | 0.03 | 13 | 10.4 | 0.09 | 12 |
| LYD531 | 71921.2 | 255.0 | 0.03 | 14 | 3418.8 | 0.04 | 9 | 9.9 | 0.20 | 7 |
| LYD528 | 72310.1 | — | — | — | 3325.9 | 0.08 | 6 | — | — | — |
| LYD528 | 72312.4 | 245.6 | 0.12 | 10 | 3556.2 | 0.19 | 13 | 9.5 | 0.27 | 3 |
| LYD522 | 72716.2 | — | — | — | 3456.2 | 0.27 | 10 | 10.1 | 0.01 | 9 |
| LYD522 | 72716.6 | 274.9 | L | 23 | 3799.1 | 0.12 | 21 | — | — | — |
| LYD522 | 72720.1 | — | — | — | 3437.5 | 0.11 | 10 | — | — | — |
| LYD522 | 72720.2 | 241.9 | 0.12 | 8 | 3450.0 | 0.02 | 10 | 9.9 | 0.03 | 7 |
| CONT. | — | 223.6 | — | — | 3138.8 | — | — | 9.3 | — | — |
| LYD688 | 73129.1 | — | — | — | — | — | — | 11.4 | 0.30 | 5 |
| LYD688 | 73133.1 | 371.2 | 0.01 | 15 | 4818.8 | 0.04 | 11 | 11.8 | 0.04 | 8 |
| LYD688 | 73133.3 | — | — | — | — | — | — | 11.4 | 0.30 | 5 |
| LYD688 | 73133.6 | 368.1 | 0.17 | 14 | 4987.5 | 0.01 | 15 | — | — | — |
| LYD670 | 73346.2 | 350.0 | 0.20 | 8 | 4675.0 | 0.17 | 7 | — | — | — |
| LYD670 | 73347.4 | — | — | — | 4912.5 | 0.07 | 13 | — | — | — |
| LYD670 | 73348.1 | — | — | — | — | — | — | 12.2 | 0.28 | 12 |
| LYD670 | 73350.2 | 376.2 | 0.12 | 16 | 5050.0 | L | 16 | 11.5 | 0.08 | 5 |
| LYD662 | 72008.3 | — | — | — | 4637.5 | 0.17 | 7 | 11.8 | 0.02 | 8 |
| LYD643 | 72336.3 | 354.8 | 0.10 | 10 | 4816.7 | 0.21 | 11 | — | — | — |
| LYD629 | 72198.3 | — | — | — | — | — | — | 11.8 | 0.03 | 8 |
| LYD623 | 71972.3 | — | — | — | 4575.0 | 0.28 | 5 | — | — | — |
| LYD606 | 72500.2 | — | — | — | — | — | — | 11.5 | 0.10 | 5 |
| LYD606 | 72500.5 | 341.2 | 0.25 | 6 | — | — | — | — | — | — |
| LYD599 | 72266.2 | 375.0 | 0.01 | 16 | 4831.2 | 0.04 | 11 | 12.1 | L | 11 |
| LYD594 | 73307.4 | — | — | — | — | — | — | 11.4 | 0.28 | 4 |
| LYD562 | 73484.1 | — | — | — | — | — | — | 11.4 | 0.17 | 5 |
| LYD562 | 73484.2 | 351.2 | 0.16 | 9 | 4781.2 | 0.06 | 10 | 11.5 | 0.10 | 5 |
| LYD562 | 73486.3 | 350.0 | 0.13 | 8 | 4756.2 | 0.13 | 9 | — | — | — |
| LYD562 | 73489.1 | 352.5 | 0.09 | 9 | 4687.5 | 0.13 | 8 | — | — | — |
| LYD549 | 73029.2 | 363.1 | 0.03 | 12 | 4806.2 | 0.07 | 10 | — | — | — |
| LYD549 | 73032.1 | — | — | — | — | — | — | 11.5 | 0.19 | 5 |

TABLE 61-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| CONT. | — | 323.4 | — | — | 4352.3 | — | — | 10.9 | — | — |
| LYD669 | 72217.2 | — | — | — | 4262.5 | 0.11 | 17 | — | — | — |
| LYD660 | 73929.2 | 395.6 | 0.23 | 30 | — | — | — | 11.9 | 0.17 | 13 |
| LYD660 | 73933.5 | 374.4 | 0.11 | 23 | 4137.5 | 0.01 | 13 | 12.2 | 0.05 | 16 |
| LYD654 | 73924.4 | 328.8 | 0.15 | 8 | 3875.0 | 0.29 | 6 | — | — | — |
| LYD643 | 72333.1 | — | — | — | 3843.8 | 0.29 | 5 | — | — | — |
| LYD643 | 72333.2 | — | — | — | — | — | — | 11.0 | 0.19 | 4 |
| LYD643 | 72333.6 | — | — | — | 4231.2 | 0.03 | 16 | — | — | — |
| LYD643 | 72336.3 | — | — | — | — | — | — | 11.2 | 0.11 | 6 |
| LYD634 | 71995.1 | — | — | — | 4012.5 | 0.07 | 10 | 11.4 | 0.04 | 8 |
| LYD634 | 71996.1 | — | — | — | 3829.2 | 0.23 | 5 | — | — | — |
| LYD634 | 71996.2 | — | — | — | 3931.2 | 0.19 | 8 | — | — | — |
| LYD629 | 72195.1 | — | — | — | 4075.0 | 0.15 | 12 | 11.9 | L | 13 |
| LYD629 | 72198.3 | 328.8 | 0.17 | 8 | — | — | — | 11.4 | 0.20 | 8 |
| LYD622 | 72024.3 | — | — | — | 3868.8 | 0.21 | 6 | — | — | — |
| LYD614 | 73916.4 | 340.6 | 0.12 | 12 | 4231.2 | 0.04 | 16 | — | — | — |
| LYD614 | 73917.1 | — | — | — | 4156.2 | 0.05 | 14 | — | — | — |
| LYD614 | 73917.3 | 337.5 | 0.18 | 11 | — | — | — | — | — | — |
| LYD609 | 73125.4 | — | — | — | — | — | — | 11.4 | 0.09 | 8 |
| LYD609 | 73128.5 | — | — | — | 3875.0 | 0.16 | 6 | — | — | — |
| LYD603 | 72537.7 | 330.0 | 0.13 | 8 | 4131.2 | 0.01 | 13 | — | — | — |
| LYD584 | 73915.2 | — | — | — | — | — | — | 11.4 | 0.09 | 8 |
| LYD584 | 73915.4 | — | — | — | — | — | — | 11.3 | 0.07 | 7 |
| LYD580 | 72188.2 | — | — | — | 4237.5 | L | 16 | 10.9 | 0.23 | 4 |
| LYD580 | 72189.1 | — | — | — | 3837.5 | 0.23 | 5 | — | — | — |
| LYD570 | 71937.3 | 323.1 | 0.29 | 6 | 4043.8 | 0.06 | 11 | 12.1 | 0.20 | 15 |
| LYD561 | 72177.2 | — | — | — | 3868.8 | 0.21 | 6 | — | — | — |
| LYD556 | 72903.5 | — | — | — | — | — | — | 11.4 | 0.09 | 8 |
| LYD556 | 72903.6 | — | — | — | 4062.5 | 0.02 | 11 | — | — | — |
| LYD556 | 72904.3 | — | — | — | 4131.2 | 0.01 | 13 | — | — | — |
| LYD534 | 72409.2 | — | — | — | 3912.5 | 0.15 | 7 | — | — | — |
| CONT. | — | 305.2 | — | — | 3651.8 | — | — | 10.6 | — | — |
| LYD674 | 72254.1 | — | — | — | 3581.2 | 0.14 | 8 | — | — | — |
| LYD672 | 72347.3 | — | — | — | — | — | — | 9.6 | 0.03 | 6 |
| LYD635 | 72626.2 | — | — | — | 3737.5 | 0.03 | 13 | 9.4 | 0.21 | 4 |
| LYD635 | 72630.1 | — | — | — | — | — | — | 9.7 | 0.01 | 7 |
| LYD635 | 72630.2 | — | — | — | — | — | — | 10.1 | 0.06 | 12 |
| LYD635 | 72630.4 | — | — | — | — | — | — | 9.6 | 0.02 | 7 |
| LYD632 | 72770.2 | — | — | — | 3617.9 | 0.10 | 9 | 9.4 | 0.11 | 4 |
| LYD627 | 72765.1 | — | — | — | — | — | — | 10.1 | L | 12 |
| LYD627 | 72767.1 | — | — | — | 3568.8 | 0.16 | 8 | — | — | — |
| LYD623 | 71970.2 | — | — | — | — | — | — | 9.9 | L | 10 |
| LYD623 | 71972.2 | — | — | — | — | — | — | 9.4 | 0.07 | 4 |
| LYD623 | 71972.3 | — | — | — | — | — | — | 9.8 | 0.13 | 8 |
| LYD623 | 71974.3 | 271.9 | 0.19 | 15 | — | — | — | 9.8 | L | 8 |
| LYD593 | 71957.1 | — | — | — | 3714.3 | 0.06 | 12 | 9.6 | 0.13 | 6 |
| LYD593 | 71957.5 | 283.1 | 0.11 | 20 | — | — | — | 9.3 | 0.19 | 3 |
| LYD580 | 72188.2 | — | — | — | — | — | — | 9.9 | L | 10 |
| LYD580 | 72189.1 | — | — | — | — | — | — | 9.7 | 0.08 | 7 |
| LYD580 | 72189.2 | 288.8 | 0.02 | 22 | 3793.8 | 0.02 | 15 | 9.9 | L | 9 |
| LYD571 | 72357.5 | — | — | — | — | — | — | 9.6 | 0.18 | 7 |
| LYD571 | 72358.1 | 278.1 | 0.12 | 18 | 3675.0 | 0.06 | 11 | — | — | — |
| LYD571 | 72358.3 | 287.0 | 0.22 | 22 | 3955.4 | 0.03 | 20 | 10.1 | L | 12 |
| LYD571 | 72360.2 | — | — | — | — | — | — | 9.4 | 0.07 | 4 |
| LYD560 | 71925.1 | 265.9 | 0.19 | 13 | — | — | — | 9.5 | 0.26 | 5 |
| LYD554 | 72169.2 | — | — | — | — | — | — | 9.6 | 0.04 | 7 |
| LYD554 | 72173.2 | — | — | — | — | — | — | 9.6 | 0.13 | 6 |
| LYD553 | 72742.1 | — | — | — | — | — | — | 9.6 | 0.18 | 7 |
| LYD553 | 72743.2 | — | — | — | — | — | — | 9.3 | 0.19 | 3 |
| LYD548 | 72656.1 | — | — | — | — | — | — | 9.6 | 0.30 | 6 |
| LYD548 | 72656.2 | — | — | — | — | — | — | 9.5 | 0.26 | 5 |
| LYD548 | 72673.3 | — | — | — | — | — | — | 9.5 | 0.04 | 5 |
| LYD548 | 72677.1 | 276.9 | 0.28 | 17 | — | — | — | — | — | — |
| LYD547 | 71978.3 | — | — | — | — | — | — | 9.8 | L | 9 |
| LYD547 | 71980.1 | — | — | — | — | — | — | 10.0 | 0.08 | 11 |
| LYD547 | 71980.3 | — | — | — | 3590.2 | 0.26 | 9 | — | — | — |
| LYD547 | 71981.2 | — | — | — | — | — | — | 10.0 | L | 11 |
| LYD538 | 72835.2 | 273.8 | 0.08 | 16 | 3837.5 | 0.17 | 16 | 9.9 | 0.22 | 9 |
| LYD538 | 72835.4 | 262.9 | 0.16 | 11 | — | — | — | 9.4 | 0.18 | 4 |
| LYD538 | 72839.1 | — | — | — | — | — | — | 9.7 | 0.23 | 7 |
| LYD538 | 72839.5 | — | — | — | — | — | — | 9.7 | 0.08 | 7 |
| LYD527 | 72241.3 | — | — | — | — | — | — | 9.6 | 0.30 | 6 |
| LYD527 | 72243.4 | — | — | — | — | — | — | 9.3 | 0.19 | 3 |

TABLE 61-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LYD527 | 72245.2 | — | — | — | — | — | — | 9.4 | 0.18 | 4 |
| LYD527 | 72246.3 | — | — | — | — | — | — | 9.5 | 0.08 | 5 |
| LYD521 | 72607.1 | — | — | — | — | — | — | 9.8 | 0.13 | 8 |
| LYD521 | 72610.2 | — | — | — | — | — | — | 9.9 | 0.22 | 9 |
| LYD521 | 72611.3 | — | — | — | — | — | — | 9.4 | 0.21 | 4 |
| CONT. | — | 236.0 | — | — | 3306.4 | — | — | 9.0 | — | — |
| LYD680 | 72230.2 | — | — | — | 3043.8 | 0.03 | 15 | — | — | — |
| LYD680 | 72231.2 | 281.9 | L | 30 | 3675.0 | L | 39 | — | — | — |
| LYD680 | 72232.1 | 275.6 | L | 27 | 3568.8 | L | 35 | 9.8 | 0.13 | 6 |
| LYD678 | 72787.2 | 304.4 | L | 41 | 3562.5 | 0.01 | 35 | — | — | — |
| LYD678 | 72788.1 | — | — | — | 3081.2 | 0.25 | 17 | — | — | — |
| LYD678 | 72790.1 | — | — | — | — | — | — | 9.6 | 0.15 | 4 |
| LYD674 | 72254.3 | — | — | — | 3387.5 | 0.17 | 28 | — | — | — |
| LYD674 | 72255.1 | 261.2 | 0.03 | 21 | 3550.0 | L | 34 | 9.7 | 0.04 | 4 |
| LYD674 | 72256.3 | 244.4 | 0.06 | 13 | — | — | — | — | — | — |
| LYD664 | 72015.2 | 250.6 | 0.10 | 16 | 3455.4 | 0.16 | 31 | — | — | — |
| LYD664 | 72017.7 | 286.9 | L | 33 | 3668.8 | L | 39 | 9.6 | 0.15 | 4 |
| LYD642 | 71821.4 | 275.0 | L | 27 | 3662.5 | L | 39 | — | — | — |
| LYD642 | 71824.5 | — | — | — | — | — | — | 9.7 | 0.21 | 4 |
| LYD642 | 71825.1 | 270.0 | 0.03 | 25 | 3568.8 | L | 35 | — | — | — |
| LYD642 | 71825.3 | — | — | — | — | — | — | 9.7 | 0.04 | 4 |
| LYD641 | 72632.2 | — | — | — | 2881.2 | 0.08 | 9 | 9.5 | 0.19 | 2 |
| LYD641 | 72633.4 | 302.5 | L | 40 | 3950.0 | L | 50 | — | — | — |
| LYD641 | 72635.2 | 244.4 | 0.08 | 13 | 3256.2 | 0.01 | 23 | — | — | — |
| LYD637 | 73684.1 | 273.1 | L | 26 | 3475.0 | L | 32 | — | — | — |
| LYD637 | 73685.1 | 271.9 | 0.14 | 26 | 3781.2 | L | 43 | — | — | — |
| LYD637 | 73685.2 | — | — | — | 3231.2 | L | 22 | — | — | — |
| LYD637 | 73685.3 | 262.5 | L | 21 | 3293.8 | L | 25 | — | — | — |
| LYD624 | 73382.3 | — | — | — | 3256.2 | 0.11 | 23 | — | — | — |
| LYD624 | 73385.3 | 264.9 | 0.14 | 22 | — | — | — | — | — | — |
| LYD621 | 72571.1 | — | — | — | — | — | — | 9.8 | 0.07 | 5 |
| LYD621 | 72574.1 | 245.8 | 0.19 | 14 | — | — | — | — | — | — |
| LYD621 | 72574.3 | — | — | — | — | — | — | 9.6 | 0.06 | 4 |
| LYD617 | 71964.2 | — | — | — | 3437.5 | L | 30 | — | — | — |
| LYD617 | 71966.2 | 264.4 | 0.25 | 22 | 3525.0 | 0.06 | 33 | — | — | — |
| LYD617 | 71966.6 | 258.1 | L | 19 | 3243.8 | L | 23 | 9.5 | 0.19 | 2 |
| LYD617 | 71967.1 | 244.4 | 0.03 | 13 | 3268.8 | L | 24 | — | — | — |
| LYD616 | 73057.1 | 239.4 | 0.13 | 11 | 2981.2 | 0.21 | 13 | — | — | — |
| LYD616 | 73057.4 | — | — | — | 3425.0 | L | 30 | 9.5 | 0.19 | 2 |
| LYD616 | 73058.4 | 265.6 | L | 23 | 3425.0 | L | 30 | — | — | — |
| LYD616 | 73059.1 | — | — | — | 3475.0 | 0.09 | 32 | — | — | — |
| LYD616 | 73059.4 | — | — | — | — | — | — | 9.6 | 0.12 | 3 |
| LYD588 | 73852.1 | 233.8 | 0.15 | 8 | — | — | — | — | — | — |
| LYD588 | 73852.2 | 241.9 | 0.14 | 12 | 3062.5 | 0.01 | 16 | — | — | — |
| LYD572 | 72387.1 | 258.1 | L | 19 | 3381.2 | L | 28 | — | — | — |
| LYD572 | 72390.3 | 276.2 | L | 28 | 3625.0 | L | 37 | — | — | — |
| LYD567 | 72495.3 | 255.6 | 0.20 | 18 | 3637.5 | 0.08 | 38 | — | — | — |
| LYD567 | 72495.4 | — | — | — | — | — | — | 10.0 | 0.28 | 8 |
| LYD567 | 72496.2 | — | — | — | — | — | — | 9.5 | 0.19 | 2 |
| LYD567 | 72496.3 | 259.4 | 0.04 | 20 | 3518.8 | 0.01 | 33 | — | — | — |
| LYD559 | 73623.3 | — | — | — | 3412.5 | 0.22 | 29 | — | — | — |
| LYD559 | 73624.1 | — | — | — | — | — | — | 9.6 | 0.15 | 4 |
| LYD559 | 73626.1 | — | — | — | 2916.1 | 0.29 | 10 | — | — | — |
| LYD538 | 72835.4 | 260.0 | L | 20 | 3281.2 | L | 24 | 9.8 | 0.07 | 5 |
| LYD537 | 73628.1 | 279.4 | 0.02 | 29 | 3631.2 | L | 37 | — | — | — |
| LYD537 | 73633.1 | 265.6 | 0.01 | 23 | 3212.5 | L | 22 | — | — | — |
| LYD537 | 73633.4 | 238.3 | 0.06 | 10 | 2902.1 | 0.08 | 10 | — | — | — |
| LYD537 | 73633.5 | 248.8 | 0.12 | 15 | 2981.2 | 0.02 | 13 | — | — | — |
| LYD521 | 72607.1 | 277.5 | L | 28 | 3368.8 | L | 28 | — | — | — |
| LYD521 | 72610.1 | 240.0 | 0.05 | 11 | 3043.8 | 0.03 | 15 | 9.8 | 0.27 | 5 |
| LYD521 | 72610.2 | — | — | — | — | — | — | 9.6 | 0.06 | 4 |
| LYD521 | 72611.1 | 241.2 | 0.04 | 12 | — | — | — | 9.7 | 0.04 | 4 |
| LYD521 | 72611.3 | 294.4 | L | 36 | 3406.2 | L | 29 | — | — | — |
| CONT. | — | 216.3 | — | — | 2641.6 | — | — | 9.3 | — | — |
| LYD689 | 72711.2 | — | — | — | 5537.5 | 0.02 | 12 | 10.6 | 0.05 | 5 |
| LYD689 | 72712.3 | 465.0 | 0.01 | 17 | 5575.0 | 0.11 | 13 | — | — | — |
| LYD689 | 72713.1 | 446.2 | 0.26 | 12 | 5656.2 | 0.04 | 15 | 10.4 | 0.16 | 3 |
| LYD682 | 72566.2 | 460.6 | 0.05 | 16 | 5618.8 | 0.02 | 14 | — | — | — |
| LYD682 | 72568.2 | 474.3 | L | 19 | 5596.4 | 0.01 | 13 | — | — | — |
| LYD677 | 72223.6 | — | — | — | — | — | — | 10.8 | 0.18 | 8 |
| LYD677 | 72223.7 | 461.1 | 0.04 | 16 | 5209.8 | 0.21 | 6 | — | — | — |
| LYD677 | 72227.1 | — | — | — | — | — | — | 10.5 | 0.27 | 4 |
| LYD669 | 73327.1 | 471.4 | 0.09 | 19 | 5750.0 | L | 17 | 10.9 | 0.25 | 9 |

TABLE 61-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD666 | 72394.3 | — | — | — | 5631.2 | 0.01 | 14 | — | — | — |
| LYD657 | 72400.1 | 453.8 | 0.29 | 14 | 5868.8 | 0.01 | 19 | — | — | — |
| LYD657 | 72400.3 | 426.4 | 0.19 | 7 | 5291.1 | 0.13 | 7 | — | — | — |
| LYD657 | 72401.1 | 421.9 | 0.27 | 6 | 5293.8 | 0.12 | 7 | — | — | — |
| LYD620 | 73063.3 | — | — | — | 5291.1 | 0.19 | 7 | — | — | — |
| LYD620 | 73066.3 | — | — | — | 5262.5 | 0.30 | 7 | 10.6 | 0.14 | 5 |
| LYD602 | 72613.1 | — | — | — | 5443.8 | 0.04 | 10 | — | — | — |
| LYD602 | 72613.2 | 429.3 | 0.17 | 8 | — | — | — | — | — | — |
| LYD598 | 72421.1 | — | — | — | 5250.0 | 0.28 | 6 | — | — | — |
| LYD598 | 72446.4 | 446.9 | 0.09 | 12 | 5187.5 | 0.24 | 5 | — | — | — |
| LYD595 | 72907.4 | — | — | — | — | — | — | 10.5 | 0.07 | 4 |
| LYD595 | 72907.5 | 434.4 | 0.16 | 9 | 5743.8 | L | 16 | — | — | — |
| LYD574 | 73118.3 | 447.5 | 0.22 | 13 | 5300.0 | 0.12 | 7 | — | — | — |
| LYD574 | 73118.4 | — | — | — | 5237.5 | 0.18 | 6 | — | — | — |
| LYD574 | 73119.1 | 463.8 | 0.25 | 17 | 5525.0 | 0.05 | 12 | 10.9 | 0.22 | 8 |
| LYD574 | 73121.2 | 461.0 | 0.28 | 16 | 5226.8 | 0.22 | 6 | 10.3 | 0.26 | 3 |
| LYD574 | 73122.3 | 466.9 | 0.15 | 17 | 5881.2 | L | 19 | — | — | — |
| LYD562 | 73484.2 | — | — | — | — | — | — | 10.7 | 0.02 | 6 |
| LYD549 | 73029.1 | — | — | — | — | — | — | 10.3 | 0.26 | 3 |
| LYD549 | 73029.4 | 457.1 | 0.02 | 15 | — | — | — | — | — | — |
| LYD549 | 73032.1 | 424.8 | 0.20 | 7 | — | — | — | — | — | — |
| LYD549 | 73032.2 | — | — | — | 5481.2 | 0.06 | 11 | — | — | — |
| LYD542 | 72733.2 | 425.6 | 0.25 | 7 | 5425.0 | 0.04 | 10 | — | — | — |
| LYD542 | 72735.4 | 426.7 | 0.23 | 7 | 5600.0 | 0.01 | 13 | 10.3 | 0.26 | 3 |
| LYD542 | 72736.3 | 423.8 | 0.29 | 7 | — | — | — | — | — | — |
| LYD542 | 72736.4 | — | — | — | — | — | — | 10.6 | 0.03 | 6 |
| LYD542 | 72736.7 | 433.0 | 0.11 | 9 | 5530.4 | 0.02 | 12 | — | — | — |
| LYD536 | 72531.3 | 424.4 | 0.24 | 7 | 5493.8 | 0.07 | 11 | — | — | — |
| LYD533 | 72726.2 | — | — | — | 5268.8 | 0.18 | 7 | — | — | — |
| CONT. | — | 397.4 | — | — | 4934.9 | — | — | 10.1 | — | — |
| LYD688 | 73133.1 | 449.2 | 0.02 | 11 | 5805.4 | 0.08 | 5 | — | — | — |
| LYD688 | 73134.6 | 455.0 | 0.07 | 13 | 5831.2 | 0.03 | 6 | 10.5 | 0.02 | 7 |
| LYD681 | 73184.1 | — | — | — | — | — | — | 10.6 | L | 8 |
| LYD681 | 73184.3 | — | — | — | — | — | — | 10.4 | 0.11 | 6 |
| LYD681 | 73186.2 | — | — | — | 5762.5 | 0.06 | 5 | 10.5 | 0.02 | 7 |
| LYD675 | 72644.1 | 435.0 | 0.02 | 8 | 5893.8 | 0.01 | 7 | 11.1 | 0.12 | 13 |
| LYD675 | 72644.3 | — | — | — | — | — | — | 10.4 | 0.04 | 6 |
| LYD675 | 72648.1 | 460.0 | 0.15 | 14 | — | — | — | — | — | — |
| LYD671 | 72877.1 | 427.5 | 0.21 | 6 | — | — | — | — | — | — |
| LYD671 | 72878.2 | 425.0 | 0.25 | 5 | — | — | — | — | — | — |
| LYD671 | 72879.2 | 464.4 | 0.29 | 15 | 5862.5 | 0.13 | 6 | — | — | — |
| LYD665 | 72216.5 | 435.6 | 0.29 | 8 | — | — | — | — | — | — |
| LYD665 | 72216.6 | 426.9 | 0.06 | 6 | — | — | — | — | — | — |
| LYD652 | 72559.1 | — | — | — | — | — | — | 10.1 | 0.17 | 3 |
| LYD652 | 72560.1 | — | — | — | 5817.0 | 0.03 | 6 | — | — | — |
| LYD651 | 73021.3 | 451.2 | 0.10 | 12 | 6031.2 | L | 10 | — | — | — |
| LYD648 | 72831.3 | 420.0 | 0.23 | 4 | — | — | — | — | — | — |
| LYD648 | 72832.2 | 442.2 | 0.02 | 10 | — | — | — | — | — | — |
| LYD644 | 72775.1 | 476.6 | L | 18 | 5875.9 | 0.01 | 7 | — | — | — |
| LYD644 | 72778.1 | 420.6 | 0.11 | 4 | — | — | — | — | — | — |
| LYD644 | 72778.2 | 421.3 | 0.28 | 4 | — | — | — | — | — | — |
| LYD639 | 72548.4 | — | — | — | — | — | — | 10.0 | 0.20 | 2 |
| LYD639 | 72549.3 | — | — | — | — | — | — | 10.2 | 0.08 | 4 |
| LYD639 | 72551.3 | 440.6 | L | 9 | — | — | — | — | — | — |
| LYD596 | 73635.1 | — | — | — | 5756.2 | 0.06 | 5 | — | — | — |
| LYD596 | 73635.3 | — | — | — | 5700.0 | 0.15 | 4 | — | — | — |
| LYD596 | 73636.1 | 453.6 | 0.25 | 12 | — | — | — | — | — | — |
| LYD596 | 73637.1 | 440.0 | 0.18 | 9 | 6206.2 | L | 13 | — | — | — |
| LYD594 | 73303.1 | 416.2 | 0.21 | 3 | — | — | — | — | — | — |
| LYD594 | 73307.1 | 462.5 | 0.21 | 15 | 6068.8 | 0.11 | 10 | — | — | — |
| LYD594 | 73307.3 | 434.4 | 0.02 | 8 | — | — | — | — | — | — |
| LYD594 | 73307.4 | 475.0 | 0.08 | 18 | — | — | — | 10.2 | 0.03 | 4 |
| LYD577 | 72747.4 | 481.2 | L | 19 | — | — | — | — | — | — |
| LYD577 | 72748.2 | — | — | — | — | — | — | 10.1 | 0.17 | 3 |
| LYD577 | 72748.3 | — | — | — | — | — | — | 10.2 | 0.24 | 4 |
| LYD577 | 72750.4 | 430.0 | 0.06 | 7 | — | — | — | — | — | — |
| LYD545 | 72506.2 | 448.8 | L | 11 | 5956.2 | L | 8 | — | — | — |
| LYD545 | 72508.2 | 429.2 | 0.10 | 6 | — | — | — | — | — | — |
| LYD545 | 72508.5 | 428.8 | 0.19 | 6 | — | — | — | — | — | — |
| LYD541 | 72729.1 | 432.3 | 0.25 | 7 | — | — | — | — | — | — |
| LYD541 | 72729.2 | 439.4 | 0.15 | 9 | — | — | — | — | — | — |
| LYD541 | 72732.1 | 452.7 | 0.03 | 12 | — | — | — | — | — | — |
| LYD534 | 72409.2 | — | — | — | — | — | — | 10.2 | 0.24 | 4 |

TABLE 61-continued

Genes showing improved plant performance at Normal growth conditions under regulation of At6669 promoter

| Gene | | Dry Weight [mg] | | | Fresh Weight [mg] | | | Leaf Number | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD534 | 72414.3 | — | — | — | — | — | — | 10.1 | 0.05 | 3 |
| LYD522 | 72715.2 | 474.4 | 0.23 | 18 | — | — | — | — | — | — |
| LYD522 | 72720.1 | — | — | — | — | — | — | 10.2 | 0.03 | 4 |
| CONT. | — | 403.4 | — | — | 5506.6 | — | — | 9.8 | — | — |

Table 61. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

TABLE 62

Genes showing improved plant performance at Normal growth conditions under regulation of At6669 promoter

| Gene | | Plot Coverage [cm²] | | | Rosette Area [cm²] | | | Rosette Diameter [cm] | | |
|---|---|---|---|---|---|---|---|---|---|---|
| Name | Event # | Ave. | P-Val. | % Incr. | Ave. | P-Val. | % Incr. | Ave. | P-Val. | %Incr. |
| LYD684 | 72271.4 | — | — | — | — | — | — | 4.8 | 0.24 | 7 |
| LYD684 | 72272.3 | 57.6 | 0.17 | 9 | 7.2 | 0.17 | 9 | — | — | — |
| LYD684 | 72274.1 | 73.6 | 0.13 | 39 | 9.2 | 0.13 | 39 | 5.1 | 0.14 | 13 |
| LYD681 | 73188.3 | 62.4 | 0.24 | 18 | 7.8 | 0.24 | 18 | 4.8 | 0.22 | 6 |
| LYD667 | 72030.4 | 58.0 | 0.22 | 9 | 7.2 | 0.22 | 9 | — | — | — |
| LYD661 | 72325.1 | 63.0 | L | 19 | 7.9 | L | 19 | 4.9 | 0.07 | 7 |
| LYD661 | 72328.1 | 70.3 | L | 32 | 8.8 | L | 32 | 5.1 | 0.01 | 14 |
| LYD661 | 72328.2 | 67.7 | 0.04 | 28 | 8.5 | 0.04 | 28 | 5.1 | 0.12 | 13 |
| LYD651 | 73026.4 | 60.2 | 0.11 | 13 | 7.5 | 0.11 | 13 | — | — | — |
| LYD626 | 72002.1 | — | — | — | — | — | — | 4.8 | 0.27 | 7 |
| LYD626 | 72003.1 | — | — | — | — | — | — | 4.9 | 0.14 | 9 |
| LYD620 | 73066.3 | 67.2 | L | 26 | 8.4 | L | 26 | 5.1 | L | 13 |
| LYD617 | 71964.2 | 58.2 | 0.12 | 10 | 7.3 | 0.12 | 10 | 4.8 | 0.22 | 6 |
| LYD617 | 71966.3 | 56.1 | 0.28 | 6 | 7.0 | 0.28 | 6 | — | — | — |
| LYD617 | 71966.6 | 70.1 | L | 32 | 8.8 | L | 32 | 5.0 | L | 11 |
| LYD612 | 71818.4 | 58.0 | 0.08 | 9 | 7.3 | 0.08 | 9 | 4.7 | 0.12 | 5 |
| LYD609 | 73125.3 | 61.6 | 0.28 | 16 | 7.7 | 0.28 | 16 | 4.9 | 0.22 | 7 |
| LYD609 | 73125.4 | 61.1 | 0.08 | 15 | 7.6 | 0.08 | 15 | 4.8 | 0.14 | 5 |
| LYD609 | 73128.5 | 59.9 | 0.23 | 13 | 7.5 | 0.23 | 13 | 4.9 | 0.05 | 7 |
| LYD596 | 73635.1 | — | — | — | — | — | — | 5.1 | 0.02 | 12 |
| LYD596 | 73639.1 | 61.5 | 0.08 | 16 | 7.7 | 0.08 | 16 | 5.1 | 0.03 | 12 |
| LYD593 | 71952.1 | 62.5 | 0.26 | 18 | 7.8 | 0.26 | 18 | — | — | — |
| LYD593 | 71952.2 | 58.4 | 0.06 | 10 | 7.3 | 0.06 | 10 | 4.7 | 0.28 | 4 |
| LYD593 | 71957.5 | 58.9 | 0.05 | 11 | 7.4 | 0.05 | 11 | — | — | — |
| LYD574 | 73118.4 | 70.3 | L | 32 | 8.8 | L | 32 | 5.1 | L | 13 |
| LYD574 | 73119.1 | 58.2 | 0.17 | 10 | 7.3 | 0.17 | 10 | — | — | — |
| LYD564 | 72182.4 | 62.0 | 0.17 | 17 | 7.8 | 0.17 | 17 | — | — | — |
| LYD564 | 72182.5 | 56.0 | 0.26 | 5 | 7.0 | 0.26 | 5 | — | — | — |
| LYD558 | 73112.3 | 71.0 | 0.07 | 34 | 8.9 | 0.07 | 34 | 5.2 | L | 15 |
| LYD558 | 73113.1 | 60.3 | 0.02 | 14 | 7.5 | 0.02 | 14 | 4.7 | 0.19 | 4 |
| LYD558 | 73114.3 | 58.1 | 0.21 | 9 | 7.3 | 0.21 | 9 | — | — | — |
| LYD558 | 73114.6 | 58.5 | 0.17 | 10 | 7.3 | 0.17 | 10 | 4.7 | 0.19 | 4 |
| LYD527 | 72246.1 | 56.0 | 0.27 | 5 | 7.0 | 0.27 | 5 | — | — | — |
| LYD527 | 72246.3 | 67.2 | 0.29 | 26 | 8.4 | 0.29 | 26 | — | — | — |
| LYD526 | 72164.5 | 63.0 | L | 19 | 7.9 | L | 19 | 4.9 | 0.01 | 9 |
| LYD526 | 72167.4 | 67.9 | 0.10 | 28 | 8.5 | 0.10 | 28 | 5.1 | 0.03 | 13 |
| LYD526 | 72168.1 | 59.6 | 0.06 | 12 | 7.5 | 0.06 | 12 | 4.8 | 0.25 | 6 |
| LYD526 | 72168.4 | 64.1 | L | 21 | 8.0 | L | 21 | 4.9 | 0.02 | 9 |
| CONT. | — | 53.1 | — | — | 6.6 | — | — | 4.5 | — | — |
| LYD680 | 72232.1 | 53.7 | 0.29 | 16 | 6.7 | 0.29 | 16 | — | — | — |
| LYD664 | 72012.1 | 52.0 | 0.02 | 12 | 6.5 | 0.02 | 12 | 4.3 | 0.11 | 4 |
| LYD664 | 72015.2 | 54.4 | 0.29 | 17 | 6.8 | 0.29 | 17 | 4.5 | 0.25 | 8 |
| LYD661 | 72325.1 | 54.7 | 0.25 | 18 | 6.8 | 0.25 | 18 | 4.4 | 0.28 | 6 |
| LYD661 | 72328.2 | 57.9 | 0.01 | 25 | 7.2 | 0.01 | 25 | 4.5 | 0.06 | 8 |
| LYD657 | 72401.1 | 50.7 | 0.02 | 9 | 6.3 | 0.02 | 9 | — | — | — |
| LYD642 | 71820.2 | 49.8 | 0.14 | 7 | 6.2 | 0.14 | 7 | 4.4 | 0.10 | 6 |
| LYD642 | 71821.4 | 51.0 | 0.02 | 10 | 6.4 | 0.02 | 10 | 4.5 | 0.01 | 7 |
| LYD642 | 71824.5 | 64.5 | 0.08 | 39 | 8.1 | 0.08 | 39 | 4.9 | 0.06 | 17 |
| LYD642 | 71825.1 | 48.2 | 0.25 | 4 | 6.0 | 0.25 | 4 | — | — | — |
| LYD631 | 72544.4 | 54.4 | 0.20 | 17 | 6.8 | 0.20 | 17 | 4.5 | 0.09 | 8 |
| LYD621 | 72571.1 | 53.2 | L | 15 | 6.7 | L | 15 | 4.5 | L | 9 |
| LYD618 | 72621.2 | 57.2 | 0.20 | 23 | 7.1 | 0.20 | 23 | 4.6 | 0.29 | 10 |
| LYD618 | 72622.2 | 49.8 | 0.23 | 7 | 6.2 | 0.23 | 7 | — | — | — |
| LYD572 | 72390.3 | 54.2 | L | 17 | 6.8 | L | 17 | 4.5 | 0.04 | 8 |

TABLE 62-continued

Genes showing improved plant performance at Normal growth conditions under regulation of At6669 promoter

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | %Incr. |
|---|---|---|---|---|---|---|---|---|---|---|
| LYD568 | 71930.1 | 57.5 | 0.22 | 24 | 7.2 | 0.22 | 24 | 4.7 | 0.13 | 13 |
| LYD568 | 71931.4 | 53.7 | 0.01 | 16 | 6.7 | 0.01 | 16 | 4.4 | 0.12 | 7 |
| LYD561 | 72177.1 | 51.2 | 0.01 | 10 | 6.4 | 0.01 | 10 | 4.3 | 0.14 | 4 |
| LYD551 | 71984.1 | 50.0 | 0.27 | 8 | 6.2 | 0.27 | 8 | — | — | — |
| LYD551 | 71986.9 | 52.7 | L | 14 | 6.6 | L | 14 | 4.4 | 0.15 | 5 |
| LYD531 | 71917.1 | 52.2 | 0.10 | 13 | 6.5 | 0.10 | 13 | 4.6 | 0.01 | 9 |
| LYD531 | 71917.2 | 52.6 | 0.17 | 13 | 6.6 | 0.17 | 13 | 4.4 | 0.10 | 5 |
| LYD531 | 71918.1 | 59.7 | 0.15 | 29 | 7.5 | 0.15 | 29 | 4.7 | 0.03 | 13 |
| LYD531 | 71921.2 | — | — | — | — | — | — | 4.4 | 0.21 | 5 |
| LYD528 | 72312.2 | 49.5 | 0.08 | 7 | 6.2 | 0.08 | 7 | 4.3 | 0.16 | 3 |
| LYD522 | 72715.2 | 48.9 | 0.13 | 6 | 6.1 | 0.13 | 6 | 4.3 | 0.21 | 3 |
| LYD522 | 72720.1 | 51.5 | 0.29 | 11 | 6.4 | 0.29 | 11 | — | — | — |
| LYD522 | 72720.2 | 53.8 | 0.12 | 16 | 6.7 | 0.12 | 16 | — | — | — |
| CONT. | — | 46.4 | — | — | 5.8 | — | — | 4.2 | — | — |
| LYD688 | 73129.1 | 74.6 | 0.07 | 22 | 9.3 | 0.07 | 22 | 5.4 | 0.05 | 13 |
| LYD688 | 73133.1 | 75.8 | 0.03 | 24 | 9.5 | 0.03 | 24 | 5.3 | 0.04 | 10 |
| LYD688 | 73133.3 | — | — | — | — | — | — | 5.2 | 0.27 | 8 |
| LYD688 | 73133.6 | 67.7 | 0.26 | 11 | 8.5 | 0.26 | 11 | — | — | — |
| LYD670 | 73346.2 | 70.3 | 0.17 | 15 | 8.8 | 0.17 | 15 | 5.2 | 0.08 | 9 |
| LYD670 | 73347.4 | — | — | — | — | — | — | 5.1 | 0.20 | 5 |
| LYD670 | 73348.1 | 77.6 | 0.22 | 27 | 9.7 | 0.22 | 27 | 5.4 | 0.10 | 11 |
| LYD662 | 72008.3 | 74.8 | 0.04 | 22 | 9.4 | 0.04 | 22 | 5.5 | L | 14 |
| LYD646 | 73040.5 | — | — | — | — | — | — | 5.0 | 0.24 | 5 |
| LYD646 | 73042.4 | 75.7 | 0.07 | 24 | 9.5 | 0.07 | 24 | 5.4 | 0.09 | 13 |
| LYD643 | 72336.3 | 72.6 | 0.07 | 19 | 9.1 | 0.07 | 19 | 5.3 | 0.07 | 9 |
| LYD643 | 72336.6 | 72.1 | 0.12 | 18 | 9.0 | 0.12 | 18 | 5.3 | 0.03 | 10 |
| LYD629 | 72198.3 | 72.8 | 0.07 | 19 | 9.1 | 0.07 | 19 | 5.3 | 0.15 | 10 |
| LYD623 | 71972.3 | 70.0 | 0.15 | 15 | 8.8 | 0.15 | 15 | 5.2 | 0.10 | 7 |
| LYD622 | 72026.1 | 68.2 | 0.26 | 12 | 8.5 | 0.26 | 12 | 5.1 | 0.17 | 6 |
| LYD599 | 72266.2 | 81.3 | 0.04 | 33 | 10.2 | 0.04 | 33 | 5.5 | 0.11 | 15 |
| LYD594 | 73307.4 | 71.2 | 0.22 | 16 | 8.9 | 0.22 | 16 | 5.2 | 0.26 | 8 |
| LYD562 | 73484.1 | 71.5 | 0.15 | 17 | 8.9 | 0.15 | 17 | 5.2 | 0.29 | 8 |
| LYD562 | 73484.2 | 74.9 | 0.10 | 23 | 9.4 | 0.10 | 23 | 5.4 | 0.08 | 12 |
| LYD562 | 73486.3 | — | — | — | — | — | — | 5.1 | 0.12 | 7 |
| LYD551 | 71986.9 | 71.9 | 0.08 | 18 | 9.0 | 0.08 | 18 | 5.4 | 0.02 | 12 |
| LYD549 | 73029.4 | — | — | — | — | — | — | 5.3 | 0.06 | 11 |
| LYD549 | 73032.1 | — | — | — | — | — | — | 5.3 | 0.03 | 10 |
| LYD528 | 72312.4 | — | — | — | — | — | — | 5.2 | 0.10 | 8 |
| CONT. | — | 61.1 | — | — | 7.6 | — | — | 4.8 | — | — |
| LYD669 | 73330.2 | 65.0 | 0.19 | 11 | 8.1 | 0.19 | 11 | — | — | — |
| LYD660 | 73929.2 | 70.6 | 0.05 | 21 | 8.8 | 0.05 | 21 | 4.9 | 0.25 | 9 |
| LYD660 | 73933.4 | — | — | — | — | — | — | 4.8 | 0.05 | 7 |
| LYD660 | 73933.5 | 78.5 | L | 34 | 9.8 | L | 34 | 5.2 | L | 16 |
| LYD654 | 73924.5 | — | — | — | — | — | — | 4.9 | 0.04 | 9 |
| LYD654 | 73926.3 | 63.7 | 0.20 | 9 | 8.0 | 0.20 | 9 | 4.8 | 0.11 | 6 |
| LYD643 | 72336.3 | 67.8 | 0.08 | 16 | 8.5 | 0.08 | 16 | 4.8 | 0.24 | 8 |
| LYD634 | 71995.1 | 64.0 | 0.13 | 9 | 8.0 | 0.13 | 9 | — | — | — |
| LYD629 | 72195.1 | 69.2 | 0.05 | 18 | 8.7 | 0.05 | 18 | — | — | — |
| LYD629 | 72198.2 | 65.7 | 0.15 | 12 | 8.2 | 0.15 | 12 | 4.8 | 0.08 | 6 |
| LYD629 | 72198.3 | 73.0 | 0.02 | 25 | 9.1 | 0.02 | 25 | 4.9 | 0.02 | 9 |
| LYD629 | 72198.5 | 65.6 | 0.17 | 12 | 8.2 | 0.17 | 12 | — | — | — |
| LYD614 | 73916.4 | 68.0 | 0.02 | 16 | 8.5 | 0.02 | 16 | 4.8 | 0.18 | 6 |
| LYD614 | 73916.5 | — | — | — | — | — | — | 5.0 | 0.28 | 10 |
| LYD614 | 73917.3 | 63.0 | 0.20 | 8 | 7.9 | 0.20 | 8 | — | — | — |
| LYD609 | 73125.4 | 63.8 | 0.15 | 9 | 8.0 | 0.15 | 9 | 4.8 | 0.11 | 6 |
| LYD584 | 73912.3 | — | — | — | — | — | — | 4.7 | 0.14 | 5 |
| LYD584 | 73915.2 | 66.8 | 0.15 | 14 | 8.3 | 0.15 | 14 | 4.8 | 0.28 | 8 |
| LYD584 | 73915.4 | 68.4 | 0.02 | 17 | 8.5 | 0.02 | 17 | 4.8 | 0.05 | 7 |
| LYD580 | 72188.2 | 67.7 | 0.03 | 16 | 8.5 | 0.03 | 16 | 4.8 | 0.12 | 7 |
| LYD570 | 71937.3 | 71.1 | L | 22 | 8.9 | L | 22 | 4.9 | 0.08 | 9 |
| LYD561 | 72177.2 | — | — | — | — | — | — | 4.9 | 0.26 | 10 |
| LYD556 | 72903.5 | — | — | — | — | — | — | 4.7 | 0.27 | 4 |
| LYD534 | 72414.4 | 62.8 | 0.22 | 7 | 7.9 | 0.22 | 7 | — | — | — |
| CONT. | — | 58.5 | — | — | 7.3 | — | — | 4.5 | — | — |
| LYD672 | 72348.2 | — | — | — | — | — | — | 4.1 | 0.06 | 7 |
| LYD635 | 72626.2 | 44.4 | 0.02 | 13 | 5.5 | 0.02 | 13 | 4.0 | 0.02 | 6 |
| LYD632 | 72771.1 | 45.1 | 0.07 | 15 | 5.6 | 0.07 | 15 | 4.1 | 0.01 | 7 |
| LYD632 | 72774.3 | — | — | — | — | — | — | 4.1 | 0.12 | 7 |
| LYD632 | 72774.4 | 42.8 | 0.25 | 9 | 5.3 | 0.25 | 9 | — | — | — |
| LYD627 | 72766.1 | 44.0 | 0.09 | 12 | 5.5 | 0.09 | 12 | 4.0 | 0.25 | 5 |
| LYD627 | 72767.1 | — | — | — | — | — | — | 4.2 | 0.25 | 11 |
| LYD593 | 71957.5 | 42.8 | 0.05 | 9 | 5.3 | 0.05 | 9 | 4.0 | 0.06 | 5 |
| LYD580 | 72188.2 | 44.2 | 0.10 | 12 | 5.5 | 0.10 | 12 | — | — | — |

TABLE 62-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | %Incr. |
| LYD571 | 72357.5 | 47.7 | L | 21 | 6.0 | L | 21 | 4.1 | L | 8 |
| LYD571 | 72358.1 | 47.9 | L | 22 | 6.0 | L | 22 | 4.2 | L | 11 |
| LYD571 | 72358.3 | 54.2 | 0.20 | 38 | 6.8 | 0.20 | 38 | 4.4 | 0.18 | 17 |
| LYD571 | 72358.4 | 46.7 | 0.08 | 19 | 5.8 | 0.08 | 19 | 4.1 | 0.19 | 8 |
| LYD554 | 72174.4 | 45.3 | 0.18 | 15 | 5.7 | 0.18 | 15 | — | — | — |
| LYD553 | 72741.2 | 44.2 | 0.15 | 12 | 5.5 | 0.15 | 12 | 4.1 | 0.03 | 6 |
| LYD548 | 72656.2 | — | — | — | — | — | — | 4.0 | 0.13 | 4 |
| LYD548 | 72677.1 | 43.9 | 0.27 | 12 | 5.5 | 0.27 | 12 | — | — | — |
| LYD547 | 71980.1 | 47.4 | L | 20 | 5.9 | L | 20 | — | — | — |
| LYD538 | 72835.2 | 52.6 | L | 34 | 6.6 | L | 34 | 4.5 | 0.07 | 18 |
| LYD538 | 72835.4 | 41.7 | 0.06 | 6 | 5.2 | 0.06 | 6 | — | — | — |
| LYD538 | 72839.5 | 41.4 | 0.10 | 5 | 5.2 | 0.10 | 5 | — | — | — |
| LYD527 | 72246.3 | 44.2 | L | 12 | 5.5 | L | 12 | 4.2 | L | 10 |
| LYD521 | 72610.2 | 42.6 | 0.02 | 8 | 5.3 | 0.02 | 8 | — | — | — |
| CONT. | — | 39.4 | — | — | 4.9 | — | — | 3.8 | — | — |
| LYD680 | 72231.2 | — | — | — | — | — | — | 3.4 | 0.26 | 5 |
| LYD680 | 72232.1 | 32.4 | 0.11 | 11 | 4.0 | 0.11 | 11 | — | — | — |
| LYD680 | 72232.4 | 31.3 | 0.29 | 7 | 3.9 | 0.29 | 7 | 3.6 | 0.07 | 9 |
| LYD678 | 72787.2 | 32.1 | 0.13 | 10 | 4.0 | 0.13 | 10 | — | — | — |
| LYD678 | 72790.1 | 33.7 | 0.15 | 16 | 4.2 | 0.15 | 16 | 3.5 | 0.07 | 6 |
| LYD664 | 72016.2 | — | — | — | — | — | — | 3.4 | 0.23 | 4 |
| LYD664 | 72017.7 | 35.1 | 0.06 | 20 | 4.4 | 0.06 | 20 | 3.5 | 0.11 | 8 |
| LYD642 | 71824.5 | 33.3 | 0.05 | 14 | 4.2 | 0.05 | 14 | 3.7 | L | 13 |
| LYD642 | 71825.1 | 31.4 | 0.22 | 8 | 3.9 | 0.22 | 8 | 3.4 | 0.16 | 4 |
| LYD641 | 72632.2 | 31.4 | 0.24 | 8 | 3.9 | 0.24 | 8 | — | — | — |
| LYD641 | 72633.4 | 41.0 | 0.11 | 41 | 5.1 | 0.11 | 41 | 3.9 | 0.08 | 19 |
| LYD637 | 73683.1 | 32.6 | 0.17 | 12 | 4.3 | 0.02 | 19 | 3.6 | 0.01 | 11 |
| LYD637 | 73685.3 | — | — | — | — | — | — | 3.4 | 0.12 | 5 |
| LYD624 | 73382.4 | — | — | — | — | — | — | 3.6 | 0.02 | 10 |
| LYD621 | 72571.1 | 32.2 | 0.11 | 11 | 4.0 | 0.11 | 11 | 3.5 | 0.03 | 8 |
| LYD621 | 72573.6 | 32.3 | 0.11 | 11 | 4.0 | 0.11 | 11 | 3.5 | 0.24 | 6 |
| LYD621 | 72574.3 | 32.5 | 0.09 | 12 | 4.1 | 0.09 | 12 | 3.5 | 0.08 | 6 |
| LYD617 | 71966.6 | — | — | — | — | — | — | 3.4 | 0.28 | 4 |
| LYD616 | 73058.4 | 36.6 | L | 26 | 4.6 | L | 26 | 3.6 | 0.02 | 10 |
| LYD616 | 73059.4 | — | — | — | — | — | — | 3.5 | 0.14 | 6 |
| LYD588 | 73855.2 | 35.1 | 0.23 | 20 | 4.4 | 0.23 | 20 | 3.6 | 0.20 | 12 |
| LYD588 | 73855.3 | 32.5 | 0.14 | 11 | 4.1 | 0.14 | 11 | 3.5 | 0.04 | 8 |
| LYD567 | 72495.3 | — | — | — | — | — | — | 3.4 | 0.19 | 4 |
| LYD567 | 72495.4 | 31.6 | 0.19 | 9 | 4.0 | 0.19 | 9 | 3.4 | 0.11 | 5 |
| LYD567 | 72496.3 | 32.4 | 0.09 | 11 | 4.1 | 0.09 | 11 | 3.4 | 0.11 | 5 |
| LYD559 | 73624.1 | 32.6 | 0.08 | 12 | 4.1 | 0.08 | 12 | 3.5 | 0.09 | 6 |
| LYD538 | 72839.2 | 31.8 | 0.15 | 9 | 4.0 | 0.15 | 9 | — | — | — |
| LYD537 | 73630.3 | — | — | — | — | — | — | 3.5 | 0.12 | 8 |
| LYD521 | 72611.1 | 32.0 | 0.21 | 10 | 4.0 | 0.21 | 10 | — | — | — |
| LYD521 | 72611.3 | 33.0 | 0.28 | 13 | 4.1 | 0.28 | 13 | 3.5 | 0.19 | 7 |
| CONT. | — | 29.1 | — | — | 3.6 | — | — | 3.3 | — | — |
| LYD689 | 72711.2 | 58.6 | 0.29 | 10 | 7.3 | 0.29 | 10 | — | — | — |
| LYD689 | 72713.1 | 64.0 | 0.03 | 20 | 8.0 | 0.03 | 20 | 5.0 | 0.02 | 8 |
| LYD682 | 72566.2 | 60.5 | 0.24 | 14 | 7.6 | 0.24 | 14 | — | — | — |
| LYD677 | 72223.6 | 64.3 | 0.03 | 21 | 8.0 | 0.03 | 21 | 4.9 | 0.05 | 7 |
| LYD669 | 72217.2 | 61.8 | 0.06 | 16 | 7.7 | 0.06 | 16 | 4.9 | 0.04 | 8 |
| LYD669 | 73330.1 | 64.3 | 0.29 | 21 | 8.0 | 0.29 | 21 | — | — | — |
| LYD666 | 72394.3 | 64.7 | L | 22 | 8.1 | L | 22 | 5.0 | 0.02 | 9 |
| LYD666 | 72396.2 | 60.8 | 0.04 | 14 | 7.6 | 0.04 | 14 | 4.8 | 0.15 | 6 |
| LYD650 | 72640.1 | 57.3 | 0.18 | 8 | 7.2 | 0.18 | 8 | 4.7 | 0.26 | 3 |
| LYD620 | 73066.3 | 65.2 | 0.12 | 23 | 8.1 | 0.12 | 23 | 5.1 | 0.08 | 11 |
| LYD620 | 73068.2 | 58.0 | 0.14 | 9 | 7.3 | 0.14 | 9 | — | — | — |
| LYD602 | 72613.1 | 58.5 | 0.10 | 10 | 7.3 | 0.10 | 10 | 4.8 | 0.14 | 5 |
| LYD598 | 72421.1 | 62.7 | 0.01 | 18 | 7.8 | 0.01 | 18 | 4.9 | 0.09 | 8 |
| LYD598 | 72445.1 | 62.0 | 0.13 | 17 | 7.8 | 0.13 | 17 | 4.9 | 0.14 | 6 |
| LYD598 | 72446.4 | 61.4 | 0.02 | 16 | 7.7 | 0.02 | 16 | 4.9 | 0.05 | 7 |
| LYD574 | 73118.4 | — | — | — | — | — | — | 5.0 | 0.05 | 9 |
| LYD574 | 73119.1 | 67.1 | 0.04 | 26 | 8.4 | 0.04 | 26 | 5.0 | 0.07 | 9 |
| LYD562 | 73484.2 | 62.5 | 0.27 | 18 | 7.8 | 0.27 | 18 | — | — | — |
| LYD562 | 73489.4 | 65.4 | L | 23 | 8.2 | L | 23 | 5.0 | 0.28 | 8 |
| LYD549 | 73029.4 | 63.4 | 0.06 | 19 | 7.9 | 0.06 | 19 | 4.9 | 0.06 | 6 |
| CONT. | — | 53.1 | — | — | 6.6 | — | — | 4.6 | — | — |
| LYD688 | 73129.1 | — | — | — | — | — | — | 4.6 | 0.27 | 9 |
| LYD688 | 73133.1 | 68.7 | L | 45 | 8.6 | L | 45 | 5.2 | L | 24 |
| LYD688 | 73134.6 | 62.9 | 0.13 | 33 | 7.9 | 0.13 | 33 | 4.9 | L | 16 |
| LYD681 | 73184.1 | 58.5 | L | 24 | 7.3 | L | 24 | 4.7 | L | 11 |
| LYD681 | 73184.2 | 56.7 | 0.27 | 20 | 7.1 | 0.27 | 20 | 4.7 | 0.09 | 12 |
| LYD681 | 73184.3 | 55.2 | 0.02 | 17 | 6.9 | 0.02 | 17 | 4.5 | 0.04 | 7 |

TABLE 62-continued

Genes showing improved plant performance at Normal growth conditions under regulation of At6669 promoter

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | %Incr. |
|---|---|---|---|---|---|---|---|---|---|---|
| LYD681 | 73186.2 | 58.5 | 0.21 | 24 | 7.3 | 0.21 | 24 | 4.8 | 0.19 | 13 |
| LYD681 | 73188.3 | 54.6 | 0.20 | 15 | 6.8 | 0.20 | 15 | 4.6 | 0.04 | 8 |
| LYD675 | 72644.1 | 64.2 | 0.12 | 36 | 8.0 | 0.12 | 36 | 4.9 | 0.07 | 16 |
| LYD675 | 72644.3 | 59.0 | L | 25 | 7.4 | L | 25 | 4.7 | 0.01 | 12 |
| LYD671 | 72878.2 | 54.3 | 0.16 | 15 | 6.8 | 0.16 | 15 | 4.6 | 0.09 | 8 |
| LYD665 | 72216.5 | — | — | — | — | — | — | 4.6 | 0.07 | 8 |
| LYD652 | 72559.1 | 53.6 | 0.05 | 13 | 6.7 | 0.05 | 13 | 4.7 | 0.14 | 11 |
| LYD652 | 72560.1 | 53.6 | 0.05 | 13 | 6.7 | 0.05 | 13 | 4.5 | 0.12 | 6 |
| LYD652 | 72563.1 | 51.9 | 0.26 | 10 | 6.5 | 0.26 | 10 | 4.4 | 0.16 | 5 |
| LYD651 | 73021.3 | 57.4 | L | 21 | 7.2 | L | 21 | 4.7 | L | 11 |
| LYD651 | 73021.5 | 55.3 | 0.02 | 17 | 6.9 | 0.02 | 17 | 4.6 | 0.01 | 9 |
| LYD651 | 73026.4 | 55.9 | 0.18 | 18 | 7.0 | 0.18 | 18 | 4.6 | 0.09 | 10 |
| LYD648 | 72834.1 | — | — | — | — | — | — | 4.4 | 0.22 | 5 |
| LYD644 | 72775.1 | 55.7 | 0.10 | 18 | 7.0 | 0.10 | 18 | 4.6 | 0.02 | 9 |
| LYD639 | 72548.4 | — | — | — | — | — | — | 4.7 | 0.22 | 11 |
| LYD639 | 72549.3 | 52.6 | 0.10 | 11 | 6.6 | 0.10 | 11 | 4.5 | 0.11 | 7 |
| LYD596 | 73635.1 | — | — | — | — | — | — | 4.4 | 0.22 | 4 |
| LYD596 | 73637.1 | 50.7 | 0.26 | 7 | 6.3 | 0.26 | 7 | 4.6 | 0.02 | 9 |
| LYD594 | 73307.1 | 57.6 | 0.19 | 22 | 7.2 | 0.19 | 22 | 4.9 | 0.18 | 15 |
| LYD594 | 73307.4 | 56.0 | 0.12 | 19 | 7.0 | 0.12 | 19 | 4.6 | 0.06 | 8 |
| LYD577 | 72745.4 | — | — | — | — | — | — | 4.5 | 0.17 | 7 |
| LYD577 | 72748.3 | 57.1 | 0.11 | 21 | 7.1 | 0.11 | 21 | 4.8 | 0.14 | 13 |
| LYD545 | 72506.2 | — | — | — | — | — | — | 4.6 | 0.13 | 8 |
| LYD545 | 72508.5 | 50.6 | 0.25 | 7 | 6.3 | 0.25 | 7 | 4.4 | 0.21 | 4 |
| LYD541 | 72729.1 | 52.6 | 0.18 | 11 | 6.6 | 0.18 | 11 | 4.5 | 0.06 | 7 |
| LYD534 | 72409.1 | 59.7 | 0.29 | 26 | 7.5 | 0.29 | 26 | 4.9 | 0.11 | 16 |
| LYD534 | 72414.3 | 55.1 | 0.06 | 17 | 6.9 | 0.06 | 17 | 4.6 | 0.15 | 8 |
| LYD524 | 72859.3 | 57.6 | L | 22 | 7.2 | L | 22 | 4.8 | L | 14 |
| LYD524 | 72864.4 | — | — | — | — | — | — | 4.5 | 0.11 | 5 |
| LYD522 | 72716.2 | — | — | — | — | — | — | 4.7 | 0.10 | 11 |
| CONT. | — | 47.3 | — | — | 5.9 | — | — | 4.2 | — | — |

Table 62. "CONT."—Control; "Ave."—Average; "% Incr." = % increment; "p-val." —p-value, L—p < 0.01. The transgenes were under the transcriptional regulation of the new At6669 promoter (SEQ ID NO: 4111). "—" = results are still unavailable.

TABLE 63

Genes showing improved plant performance at Normal growth conditions under regulation of At6669 promoter

| Gene Name | Event # | RGR Of Leaf Number (number/day) Ave. | P-Val. | % Incr. | RGR Of Plot Coverage (cm²/day) Ave. | P-Val. | % Incr. | RGR Of Rosette Diameter (cm/day) Ave. | P-Val. | % Incr. |
|---|---|---|---|---|---|---|---|---|---|---|
| LYD684 | 72274.1 | — | — | — | 8.6 | 0.02 | 39 | 0.4 | 0.17 | 15 |
| LYD681 | 73186.2 | — | — | — | 7.6 | 0.16 | 23 | — | — | — |
| LYD681 | 73188.3 | — | — | — | 7.2 | 0.23 | 18 | — | — | — |
| LYD672 | 72347.3 | — | — | — | 7.6 | 0.20 | 24 | — | — | — |
| LYD667 | 72030.1 | — | — | — | 7.2 | 0.26 | 17 | — | — | — |
| LYD661 | 72325.1 | 0.7 | 0.13 | 21 | 7.3 | 0.19 | 19 | — | — | — |
| LYD661 | 72328.1 | — | — | — | 8.4 | 0.02 | 37 | 0.4 | 0.23 | 13 |
| LYD661 | 72328.2 | — | — | — | 7.8 | 0.08 | 27 | — | — | — |
| LYD626 | 72002.1 | 0.7 | 0.29 | 16 | — | — | — | — | — | — |
| LYD626 | 72003.1 | — | — | — | — | — | — | 0.4 | 0.27 | 13 |
| LYD620 | 73066.3 | 0.7 | 0.25 | 15 | 7.8 | 0.07 | 27 | 0.4 | 0.21 | 13 |
| LYD620 | 73066.5 | 0.7 | 0.10 | 22 | — | — | — | — | — | — |
| LYD617 | 71966.6 | 0.7 | 0.11 | 21 | 8.2 | 0.03 | 34 | 0.4 | 0.24 | 13 |
| LYD617 | 71967.1 | 0.7 | 0.23 | 16 | — | — | — | — | — | — |
| LYD609 | 73124.4 | 0.7 | 0.28 | 15 | 8.0 | 0.08 | 29 | 0.4 | 0.29 | 12 |
| LYD609 | 73125.3 | — | — | — | 7.3 | 0.24 | 18 | — | — | — |
| LYD609 | 73125.4 | 0.7 | 0.18 | 18 | 7.2 | 0.25 | 17 | — | — | — |
| LYD596 | 73639.1 | — | — | — | 7.2 | 0.22 | 18 | — | — | — |
| LYD593 | 71952.1 | — | — | — | 7.3 | 0.21 | 19 | — | — | — |
| LYD593 | 71952.2 | 0.7 | 0.27 | 15 | — | — | — | — | — | — |
| LYD574 | 73118.3 | — | — | — | 7.3 | 0.24 | 19 | — | — | — |
| LYD574 | 73118.4 | — | — | — | 8.2 | 0.03 | 33 | — | — | — |
| LYD574 | 73122.3 | — | — | — | 7.2 | 0.28 | 17 | — | — | — |
| LYD564 | 72182.4 | — | — | — | 7.1 | 0.28 | 16 | — | — | — |
| LYD564 | 72184.1 | — | — | — | 7.8 | 0.17 | 26 | — | — | — |
| LYD558 | 73112.3 | — | — | — | 8.2 | 0.03 | 33 | 0.4 | 0.25 | 13 |

TABLE 63-continued

Genes showing improved plant performance at Normal growth conditions under regulation of At6669 promoter

| Gene Name | Event # | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LYD558 | 73113.1 | — | — | — | 7.1 | 0.26 | 16 | — | — | — |
| LYD558 | 73114.3 | 0.7 | 0.12 | 21 | — | — | — | — | — | — |
| LYD527 | 72246.3 | — | — | — | 7.8 | 0.09 | 26 | — | — | — |
| LYD526 | 72164.5 | — | — | — | 7.3 | 0.22 | 18 | — | — | — |
| LYD526 | 72167.4 | — | — | — | 8.1 | 0.03 | 31 | — | — | — |
| LYD526 | 72168.1 | 0.7 | 0.19 | 17 | — | — | — | — | — | — |
| LYD526 | 72168.4 | — | — | — | 7.4 | 0.16 | 21 | — | — | — |
| CONT. | — | 0.6 | — | — | 6.2 | — | — | 0.4 | — | — |
| LYD680 | 72232.1 | 0.7 | 0.28 | 13 | 6.6 | 0.19 | 15 | 0.4 | 0.12 | 13 |
| LYD668 | 72023.3 | — | — | — | 7.1 | 0.07 | 24 | — | — | — |
| LYD664 | 72012.1 | — | — | — | 6.5 | 0.27 | 12 | — | — | — |
| LYD664 | 72015.2 | — | — | — | 6.7 | 0.14 | 17 | 0.4 | 0.16 | 11 |
| LYD661 | 72325.1 | — | — | — | 6.7 | 0.17 | 16 | — | — | — |
| LYD661 | 72328.2 | — | — | — | 7.2 | 0.04 | 24 | — | — | — |
| LYD642 | 71820.2 | — | — | — | — | — | — | 0.4 | 0.26 | 9 |
| LYD642 | 71821.4 | 0.7 | 0.23 | 14 | — | — | — | 0.4 | 0.11 | 12 |
| LYD642 | 71824.5 | 0.7 | 0.09 | 21 | 8.0 | L | 38 | 0.4 | 0.01 | 20 |
| LYD642 | 71825.1 | 0.7 | 0.16 | 17 | — | — | — | — | — | — |
| LYD631 | 72544.4 | — | — | — | 6.6 | 0.18 | 15 | — | — | — |
| LYD621 | 72571.1 | — | — | — | 6.5 | 0.22 | 13 | 0.4 | 0.21 | 10 |
| LYD621 | 72574.3 | 0.7 | 0.29 | 13 | — | — | — | — | — | — |
| LYD618 | 72621.2 | — | — | — | 7.1 | 0.04 | 24 | 0.4 | 0.10 | 13 |
| LYD572 | 72390.3 | — | — | — | 6.8 | 0.13 | 17 | 0.4 | 0.09 | 13 |
| LYD568 | 71930.1 | — | — | — | 7.2 | 0.04 | 25 | 0.4 | 0.03 | 17 |
| LYD568 | 71931.4 | — | — | — | 6.7 | 0.15 | 16 | 0.4 | 0.27 | 8 |
| LYD568 | 71932.2 | 0.7 | 0.27 | 13 | — | — | — | — | — | — |
| LYD561 | 72175.4 | — | — | — | 6.7 | 0.15 | 17 | — | — | — |
| LYD561 | 72177.1 | 0.7 | 0.27 | 13 | — | — | — | — | — | — |
| LYD561 | 72177.2 | — | — | — | 6.8 | 0.12 | 19 | 0.4 | 0.25 | 9 |
| LYD561 | 72179.1 | — | — | — | 6.6 | 0.19 | 15 | — | — | — |
| LYD551 | 71986.9 | — | — | — | 6.6 | 0.18 | 14 | 0.4 | 0.26 | 8 |
| LYD531 | 71916.3 | 0.7 | 0.29 | 13 | — | — | — | — | — | — |
| LYD531 | 71917.1 | — | — | — | 6.4 | 0.29 | 12 | 0.4 | 0.07 | 14 |
| LYD531 | 71918.1 | — | — | — | 7.3 | 0.03 | 27 | 0.4 | 0.08 | 13 |
| LYD531 | 71921.2 | — | — | — | 6.4 | 0.30 | 12 | — | — | — |
| LYD528 | 72312.4 | 0.7 | 0.22 | 15 | — | — | — | — | — | — |
| LYD522 | 72715.2 | — | — | — | — | — | — | 0.4 | 0.24 | 8 |
| LYD522 | 72716.6 | — | — | — | 6.6 | 0.23 | 14 | 0.4 | 0.18 | 11 |
| LYD522 | 72720.1 | — | — | — | — | — | — | 0.4 | 0.27 | 8 |
| LYD522 | 72720.2 | 0.7 | 0.21 | 15 | 6.7 | 0.15 | 16 | — | — | — |
| CONT. | — | 0.6 | — | — | 5.8 | — | — | 0.3 | — | — |
| LYD688 | 73129.1 | — | — | — | 8.7 | 0.27 | 22 | — | — | — |
| LYD688 | 73133.1 | — | — | — | 8.8 | 0.23 | 24 | — | — | — |
| LYD670 | 73348.1 | — | — | — | 9.1 | 0.19 | 27 | — | — | — |
| LYD662 | 72008.3 | — | — | — | 8.7 | 0.26 | 22 | — | — | — |
| LYD646 | 73042.4 | — | — | — | 8.7 | 0.30 | 21 | — | — | — |
| LYD599 | 72266.2 | — | — | — | 9.4 | 0.13 | 31 | — | — | — |
| LYD562 | 73484.2 | — | — | — | 8.8 | 0.25 | 23 | — | — | — |
| CONT. | — | — | — | — | 7.2 | — | — | — | — | — |
| LYD660 | 73929.2 | 0.8 | 0.09 | 21 | 8.5 | 0.14 | 21 | — | — | — |
| LYD660 | 73933.5 | 0.8 | 0.30 | 14 | 9.4 | 0.03 | 34 | 0.4 | 0.18 | 15 |
| LYD629 | 72195.1 | 0.8 | 0.13 | 20 | 8.2 | 0.22 | 18 | — | — | — |
| LYD629 | 72198.3 | — | — | — | 8.7 | 0.09 | 25 | — | — | — |
| LYD614 | 73916.4 | — | — | — | 8.1 | 0.27 | 16 | — | — | — |
| LYD614 | 73916.5 | — | — | — | 8.2 | 0.26 | 17 | 0.4 | 0.18 | 16 |
| LYD609 | 73128.5 | — | — | — | 8.4 | 0.21 | 19 | 0.4 | 0.13 | 19 |
| LYD584 | 73915.4 | — | — | — | 8.1 | 0.25 | 16 | — | — | — |
| LYD570 | 71937.3 | 0.8 | 0.16 | 18 | 8.5 | 0.15 | 21 | — | — | — |
| LYD561 | 72177.2 | — | — | — | — | — | — | 0.4 | 0.28 | 13 |
| CONT. | — | 0.7 | — | — | 7.0 | — | — | 0.3 | — | — |
| LYD672 | 72348.2 | — | — | — | — | — | — | 0.3 | 0.18 | 10 |
| LYD635 | 72626.2 | — | — | — | 5.5 | 0.17 | 14 | 0.3 | 0.07 | 12 |
| LYD632 | 72770.2 | — | — | — | 5.7 | 0.10 | 19 | 0.3 | 0.17 | 11 |
| LYD632 | 72771.1 | — | — | — | 5.6 | 0.11 | 17 | 0.3 | 0.07 | 13 |
| LYD632 | 72774.4 | — | — | — | 5.3 | 0.27 | 11 | — | — | — |
| LYD627 | 72765.1 | — | — | — | 6.0 | 0.04 | 25 | — | — | — |
| LYD627 | 72766.1 | — | — | — | 5.4 | 0.20 | 13 | — | — | — |
| LYD627 | 72767.1 | — | — | — | 5.8 | 0.06 | 22 | 0.3 | 0.08 | 14 |
| LYD623 | 71970.2 | 0.7 | 0.21 | 21 | — | — | — | — | — | — |
| LYD623 | 71974.3 | 0.7 | 0.28 | 18 | — | — | — | — | — | — |
| LYD580 | 72188.2 | — | — | — | 5.4 | 0.24 | 12 | — | — | — |
| LYD580 | 72189.2 | — | — | — | 5.5 | 0.16 | 15 | 0.3 | 0.06 | 14 |

TABLE 63-continued

Genes showing improved plant performance at Normal growth
conditions under regulation of At6669 promoter

| Gene | | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD571 | 72357.5 | — | — | — | 5.9 | 0.04 | 23 | 0.3 | 0.09 | 11 |
| LYD571 | 72358.1 | — | — | — | 5.9 | 0.04 | 22 | 0.3 | 0.05 | 14 |
| LYD571 | 72358.3 | — | — | — | 6.7 | L | 39 | 0.4 | 0.02 | 18 |
| LYD571 | 72358.4 | — | — | — | 5.7 | 0.06 | 20 | 0.3 | 0.29 | 7 |
| LYD560 | 71925.1 | — | — | — | 6.2 | 0.02 | 28 | 0.3 | 0.16 | 12 |
| LYD554 | 72174.4 | — | — | — | 5.6 | 0.11 | 17 | — | — | — |
| LYD553 | 72741.2 | — | — | — | 5.4 | 0.20 | 13 | 0.3 | 0.22 | 8 |
| LYD553 | 72741.3 | — | — | — | — | — | — | 0.3 | 0.22 | 10 |
| LYD548 | 72656.1 | — | — | — | 5.7 | 0.07 | 19 | 0.3 | 0.13 | 12 |
| LYD548 | 72677.1 | — | — | — | 5.4 | 0.20 | 13 | — | — | — |
| LYD547 | 71980.1 | — | — | — | 5.8 | 0.04 | 21 | — | — | — |
| LYD538 | 72835.2 | — | — | — | 6.4 | L | 33 | 0.4 | L | 20 |
| LYD527 | 72241.3 | — | — | — | 5.4 | 0.21 | 13 | — | — | — |
| LYD527 | 72245.2 | — | — | — | 5.5 | 0.19 | 14 | — | — | — |
| LYD527 | 72246.3 | — | — | — | 5.4 | 0.24 | 12 | 0.3 | 0.06 | 14 |
| LYD521 | 72610.1 | — | — | — | 5.8 | 0.07 | 20 | 0.3 | 0.22 | 10 |
| CONT. | — | 0.6 | — | — | 4.8 | — | — | 0.3 | — | — |
| LYD678 | 72790.1 | — | — | — | 4.2 | 0.27 | 16 | — | — | — |
| LYD664 | 72017.7 | — | — | — | 4.4 | 0.17 | 21 | — | — | — |
| LYD641 | 72633.4 | — | — | — | 5.0 | 0.01 | 39 | 0.3 | 0.15 | 14 |
| LYD641 | 72635.2 | 0.7 | 0.23 | 14 | — | — | — | — | — | — |
| LYD624 | 73382.4 | — | — | — | — | — | — | 0.3 | 0.27 | 10 |
| LYD616 | 73058.4 | — | — | — | 4.5 | 0.09 | 25 | — | — | — |
| LYD588 | 73855.2 | — | — | — | 4.4 | 0.18 | 21 | — | — | — |
| LYD567 | 72495.4 | 0.7 | 0.29 | 14 | — | — | — | — | — | — |
| LYD559 | 73624.1 | 0.7 | 0.22 | 14 | — | — | — | — | — | — |
| LYD538 | 72835.4 | 0.7 | 0.28 | 13 | — | — | — | 0.3 | 0.25 | 11 |
| LYD537 | 73630.3 | — | — | — | — | — | — | 0.3 | 0.22 | 12 |
| LYD521 | 72607.1 | — | — | — | 4.3 | 0.21 | 19 | — | — | — |
| CONT. | — | 0.6 | — | — | 3.6 | — | — | 0.3 | — | — |
| LYD689 | 72713.1 | — | — | — | 7.5 | 0.23 | 19 | — | — | — |
| LYD682 | 72568.2 | 0.7 | 0.28 | 14 | — | — | — | — | — | — |
| LYD677 | 72223.6 | — | — | — | 7.6 | 0.19 | 21 | — | — | — |
| LYD669 | 72217.2 | — | — | — | 7.4 | 0.24 | 18 | — | — | — |
| LYD669 | 73327.1 | 0.7 | 0.14 | 21 | — | — | — | — | — | — |
| LYD669 | 73330.1 | — | — | — | 7.8 | 0.15 | 24 | 0.4 | 0.20 | 12 |
| LYD666 | 72394.3 | — | — | — | 7.6 | 0.20 | 21 | 0.4 | 0.28 | 9 |
| LYD650 | 72642.5 | 0.7 | 0.11 | 21 | — | — | — | — | — | — |
| LYD620 | 73066.3 | — | — | — | 7.7 | 0.15 | 22 | 0.4 | 0.26 | 10 |
| LYD598 | 72421.1 | — | — | — | 7.3 | 0.27 | 17 | 0.4 | 0.30 | 9 |
| LYD598 | 72445.1 | — | — | — | 7.4 | 0.27 | 18 | — | — | — |
| LYD574 | 73119.1 | 0.7 | 0.29 | 14 | 8.0 | 0.10 | 27 | — | — | — |
| LYD574 | 73121.2 | 0.7 | 0.26 | 15 | — | — | — | — | — | — |
| LYD562 | 73484.2 | 0.7 | 0.27 | 15 | 7.4 | 0.26 | 18 | — | — | — |
| LYD562 | 73489.4 | — | — | — | 7.8 | 0.13 | 24 | — | — | — |
| LYD549 | 73029.4 | — | — | — | 7.5 | 0.21 | 20 | — | — | — |
| LYD542 | 72733.2 | 0.7 | 0.24 | 17 | 7.4 | 0.27 | 18 | — | — | — |
| LYD542 | 72735.4 | 0.7 | 0.19 | 18 | — | — | — | — | — | — |
| LYD542 | 72736.4 | 0.7 | 0.21 | 16 | — | — | — | — | — | — |
| LYD536 | 72531.3 | 0.7 | 0.09 | 23 | — | — | — | — | — | — |
| CONT. | — | 0.6 | — | — | 6.3 | — | — | 0.4 | — | — |
| LYD688 | 73133.1 | — | — | — | 8.1 | 0.01 | 44 | 0.4 | 0.03 | 25 |
| LYD688 | 73134.6 | — | — | — | 7.4 | 0.05 | 33 | 0.4 | 0.12 | 17 |
| LYD681 | 73184.1 | — | — | — | 6.8 | 0.18 | 22 | 0.4 | 0.16 | 15 |
| LYD681 | 73184.2 | — | — | — | 6.7 | 0.23 | 20 | 0.4 | 0.21 | 14 |
| LYD681 | 73186.2 | — | — | — | 6.9 | 0.16 | 24 | — | — | — |
| LYD675 | 72644.1 | — | — | — | 7.6 | 0.04 | 36 | 0.4 | 0.14 | 16 |
| LYD675 | 72644.3 | 0.7 | 0.22 | 17 | 6.9 | 0.15 | 24 | 0.4 | 0.23 | 13 |
| LYD675 | 72648.1 | 0.7 | 0.20 | 18 | 6.9 | 0.20 | 24 | — | — | — |
| LYD671 | 72882.3 | 0.7 | 0.14 | 19 | — | — | — | — | — | — |
| LYD651 | 73021.3 | — | — | — | 6.7 | 0.22 | 20 | — | — | — |
| LYD651 | 73026.4 | — | — | — | 6.6 | 0.27 | 18 | 0.4 | 0.27 | 12 |
| LYD644 | 72775.1 | 0.7 | 0.25 | 16 | 6.5 | 0.29 | 17 | — | — | — |
| LYD639 | 72548.4 | — | — | — | 6.6 | 0.28 | 19 | 0.4 | 0.23 | 13 |
| LYD594 | 73307.1 | — | — | — | 6.8 | 0.18 | 22 | 0.4 | 0.20 | 15 |
| LYD594 | 73307.3 | — | — | — | 6.6 | 0.28 | 19 | — | — | — |
| LYD594 | 73307.4 | — | — | — | 6.6 | 0.26 | 18 | — | — | — |
| LYD577 | 72748.3 | — | — | — | 6.7 | 0.21 | 21 | 0.4 | 0.24 | 13 |
| LYD545 | 72508.2 | 0.7 | 0.30 | 13 | — | — | — | — | — | — |
| LYD534 | 72409.1 | — | — | — | 7.0 | 0.15 | 25 | 0.4 | 0.15 | 16 |
| LYD534 | 72414.3 | — | — | — | 6.6 | 0.28 | 18 | — | — | — |
| LYD524 | 72859.3 | — | — | — | 6.8 | 0.20 | 21 | 0.4 | 0.21 | 13 |

TABLE 63-continued

Genes showing improved plant performance at Normal growth conditions under regulation of At6669 promoter

| Gene | | RGR Of Leaf Number (number/day) | | | RGR Of Plot Coverage (cm$^2$/day) | | | RGR Of Rosette Diameter (cm/day) | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD524 | 72859.4 | 0.7 | 0.12 | 20 | — | — | — | — | — | — |
| LYD522 | 72720.1 | 0.7 | 0.27 | 14 | — | — | — | — | — | — |
| CONT. | — | 0.6 | — | — | 5.6 | — | — | 0.3 | — | — |

Table 63. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

Example 17

Evaluating Transgenic *Arabidopsis* Under Normal Conditions Using In Vitro Assays [Tissue Culture T2 and T1 Plants, TC-T2 and TC-T1 Assays]

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N). For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F). An image analysis system was used, which consists of a personal desktop computer (Intel P4 3.0 GHz processor) and a public domain program -ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following formulas XV (RGR leaf area), and XVI (RGR root length).

Relative growth rate of leaf area=Regression coefficient of leaf area along time course.   Formula XV Relative growth rate of root length=Regression coefficient of root length along time course.   Formula XVI At the end of the experiment, plantlets were removed from the media and weighed for the determination of plant fresh weight. Plantlets were then dried for 24 hours at 60° C., and weighed again to measure plant dry weight for later statistical analysis. The fresh and dry weights are provided for each *Arabidopsis* plant. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results:

Results from T2 Plants

Tables 64-66 summarize the observed phenotypes of transgenic plants expressing the gene constructs using the TC-T2 Assays.

The genes presented in Table 64 showed a significant improvement as they produced larger plant biomass (plant fresh and dry weight) in T2 generation when grown under normal growth conditions, as compared to control plants grown under identical growth conditions. The genes were cloned under the regulation of a constitutive promoter (At6669, SEQ ID NO:4111).

The evaluation of each gene was carried out by testing the performance of different number of events. Some of the genes were evaluated in more than one tissue culture assay. The results obtained in these second experiments were significantly positive as well.

TABLE 64

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYD686 | 72796.2 | 6.6 | L | 83 | 119.8 | 0.01 | 51 |
| LYD686 | 72798.1 | 6.8 | L | 88 | 127.7 | L | 61 |
| LYD685 | 72458.3 | 5.8 | 0.22 | 61 | — | — | — |
| LYD685 | 72458.5 | 6.5 | 0.06 | 80 | 116.9 | 0.09 | 48 |
| LYD685 | 72459.1 | 5.5 | 0.11 | 52 | 125.7 | 0.27 | 59 |
| LYD685 | 72462.4 | — | — | — | 105.5 | 0.09 | 33 |
| LYD685 | 72462.5 | 4.8 | 0.14 | 33 | 103.3 | 0.12 | 30 |
| LYD673 | 72662.2 | 5.2 | 0.02 | 44 | — | — | — |
| LYD673 | 72664.1 | 4.8 | 0.24 | 33 | — | — | — |
| LYD673 | 72666.1 | 4.5 | 0.23 | 23 | — | — | — |
| LYD663 | 72856.3 | 5.4 | L | 48 | 102.2 | 0.29 | 29 |
| LYD663 | 72856.5 | 5.6 | 0.01 | 54 | 106.3 | 0.03 | 34 |
| LYD663 | 72858.1 | 5.6 | L | 55 | 98.7 | 0.07 | 25 |
| LYD663 | 72858.3 | 4.9 | 0.07 | 34 | — | — | — |
| LYD655 | 72209.1 | — | — | — | 106.5 | 0.21 | 34 |
| LYD655 | 72210.1 | 4.8 | 0.26 | 33 | — | — | — |
| LYD640 | 72556.3 | 6.6 | 0.01 | 81 | 106.2 | 0.07 | 34 |
| LYD640 | 72557.2 | 4.6 | 0.07 | 27 | — | — | — |
| LYD640 | 72558.2 | 6.2 | L | 71 | 105.2 | 0.04 | 33 |
| LYD638 | 72451.1 | 6.3 | L | 73 | 109.6 | 0.02 | 38 |
| LYD638 | 72456.2 | 4.2 | 0.25 | 17 | — | — | — |
| LYD615 | 72260.1 | 6.1 | 0.06 | 68 | 104.8 | 0.17 | 32 |
| LYD615 | 72264.2 | 5.3 | 0.02 | 46 | 92.9 | 0.22 | 17 |
| LYD613 | 72512.3 | 5.0 | 0.08 | 37 | — | — | — |
| LYD613 | 72514.2 | 6.1 | 0.16 | 68 | 109.0 | 0.29 | 38 |
| LYD613 | 72515.4 | 4.9 | 0.13 | 34 | 99.0 | 0.24 | 25 |
| LYD608 | 72883.2 | 5.9 | L | 63 | 95.7 | 0.12 | 21 |
| LYD608 | 72888.2 | 6.4 | L | 77 | 119.5 | L | 51 |
| LYD607 | 71961.1 | 7.3 | L | 103 | 133.1 | L | 68 |
| LYD607 | 71963.1 | 6.3 | 0.02 | 73 | 119.2 | 0.04 | 51 |
| LYD607 | 71963.2 | 5.7 | 0.09 | 58 | 128.8 | 0.11 | 63 |
| LYD607 | 71963.4 | 5.1 | 0.08 | 40 | — | — | — |
| LYD597 | 72419.1 | 5.1 | 0.18 | 41 | — | — | — |
| LYD597 | 72419.2 | 4.1 | 0.17 | 13 | — | — | — |
| LYD597 | 72419.3 | 6.6 | L | 81 | 106.7 | 0.01 | 35 |
| LYD597 | 72420.1 | 4.9 | L | 34 | — | — | — |
| LYD597 | 72443.4 | 5.8 | 0.23 | 59 | — | — | — |
| LYD583 | 71943.1 | 4.7 | 0.04 | 30 | — | — | — |
| LYD579 | 72350.3 | 5.1 | 0.03 | 40 | 92.1 | 0.23 | 16 |
| LYD579 | 72354.1 | 5.7 | 0.14 | 57 | 104.6 | 0.15 | 32 |
| LYD563 | 72319.2 | 4.1 | 0.19 | 13 | — | — | — |
| LYD563 | 72319.4 | 6.5 | 0.02 | 78 | 110.3 | 0.12 | 39 |
| LYD563 | 72321.2 | 4.8 | 0.17 | 32 | — | — | — |
| LYD563 | 72323.1 | 5.0 | 0.07 | 38 | — | — | — |
| CONT. | — | 3.6 | — | — | 79.2 | — | — |
| LYD676 | 73880.1 | 4.9 | 0.17 | 43 | 97.8 | 0.17 | 41 |
| LYD676 | 73884.1 | — | — | — | 85.6 | 0.16 | 23 |
| LYD660 | 73932.1 | 5.1 | 0.03 | 49 | 107.4 | L | 54 |
| LYD654 | 73924.4 | 4.7 | 0.06 | 36 | 96.9 | 0.05 | 39 |
| LYD654 | 73926.3 | 4.3 | 0.17 | 25 | 84.0 | 0.20 | 21 |
| LYD647 | 72784.3 | 5.6 | 0.09 | 64 | 116.9 | 0.07 | 68 |
| LYD647 | 72785.2 | 4.8 | 0.04 | 38 | 103.7 | L | 49 |
| LYD628 | 73678.3 | 4.5 | 0.25 | 30 | 92.9 | 0.15 | 34 |
| LYD628 | 73679.2 | 7.6 | 0.11 | 120 | 136.4 | 0.11 | 96 |
| LYD614 | 73917.1 | 4.8 | 0.04 | 38 | 106.8 | 0.04 | 54 |
| LYD614 | 73919.3 | 6.2 | 0.04 | 78 | 128.1 | 0.05 | 84 |
| LYD611 | 71988.3 | 4.6 | 0.07 | 35 | 93.1 | 0.04 | 34 |
| LYD611 | 71992.5 | 5.2 | 0.02 | 51 | 104.8 | 0.13 | 51 |
| LYD611 | 71992.6 | 5.7 | 0.07 | 66 | 92.1 | 0.13 | 32 |
| LYD605 | 73643.1 | 5.8 | 0.05 | 67 | 104.0 | 0.07 | 50 |
| LYD605 | 73644.2 | 5.1 | 0.04 | 47 | 106.8 | 0.07 | 54 |
| LYD605 | 73645.2 | — | — | — | 79.8 | 0.29 | 15 |
| LYD598 | 72421.2 | 5.8 | L | 67 | 104.4 | 0.04 | 50 |
| LYD598 | 72423.2 | 4.6 | 0.07 | 33 | — | — | — |
| LYD598 | 72423.3 | 4.8 | 0.16 | 38 | 92.8 | 0.04 | 33 |
| LYD591 | 73907.3 | 5.0 | 0.04 | 46 | 91.2 | 0.24 | 31 |
| LYD589 | 73898.1 | 5.5 | L | 61 | 119.7 | 0.08 | 72 |
| LYD589 | 73902.3 | 4.6 | 0.24 | 35 | — | — | — |
| LYD589 | 73903.5 | 5.5 | L | 61 | 111.2 | 0.02 | 60 |
| LYD588 | 73852.2 | 4.7 | 0.22 | 37 | — | — | — |
| LYD588 | 73854.1 | 5.2 | 0.10 | 51 | 111.9 | 0.03 | 61 |
| LYD588 | 73855.3 | 5.8 | 0.03 | 69 | 115.6 | 0.04 | 66 |
| LYD584 | 73910.2 | 4.5 | 0.08 | 30 | 99.5 | 0.01 | 43 |
| LYD584 | 73915.4 | — | — | — | 84.7 | 0.24 | 22 |
| LYD566 | 73482.4 | 6.4 | L | 85 | 127.5 | L | 83 |
| LYD566 | 73483.5 | 4.8 | 0.13 | 40 | 101.1 | 0.11 | 45 |
| LYD535 | 72850.5 | 5.0 | 0.21 | 45 | 95.7 | 0.29 | 38 |
| LYD535 | 72851.6 | 4.9 | 0.04 | 43 | 98.1 | 0.06 | 41 |
| LYD535 | 72852.1 | 6.2 | L | 79 | 121.1 | L | 74 |
| CONT. | — | 3.4 | — | — | 69.5 | — | — |
| LYD682 | 72565.2 | — | — | — | 83.8 | 0.10 | 23 |
| LYD682 | 72566.1 | — | — | — | 91.7 | 0.02 | 35 |
| LYD665 | 72215.2 | 4.5 | 0.22 | 18 | — | — | — |
| LYD665 | 72216.4 | 5.3 | 0.18 | 39 | 95.8 | 0.03 | 41 |
| LYD650 | 72641.2 | — | — | — | 86.2 | 0.21 | 27 |
| LYD644 | 72775.1 | — | — | — | 96.4 | 0.03 | 41 |
| LYD644 | 72780.2 | — | — | — | 92.4 | 0.11 | 36 |
| LYD626 | 72001.1 | — | — | — | 82.2 | 0.10 | 21 |
| LYD626 | 72001.3 | 5.1 | 0.15 | 35 | 96.4 | 0.09 | 42 |
| LYD626 | 72002.1 | — | — | — | 102.3 | L | 50 |
| LYD555 | 74193.5 | — | — | — | 92.1 | 0.02 | 35 |
| LYD555 | 74194.1 | 4.8 | 0.17 | 26 | 100.6 | L | 48 |
| LYD555 | 74197.1 | — | — | — | 95.5 | L | 40 |
| LYD542 | 72733.1 | 4.9 | 0.17 | 28 | 96.4 | 0.15 | 41 |
| LYD542 | 72733.2 | — | — | — | 99.1 | 0.15 | 45 |
| LYD542 | 72736.4 | — | — | — | 101.3 | 0.14 | 49 |
| LYD540 | 74182.4 | — | — | — | 84.0 | 0.18 | 23 |
| LYD540 | 74183.3 | — | — | — | 91.9 | 0.23 | 35 |
| LYD536 | 72529.5 | — | — | — | 90.3 | 0.03 | 33 |
| LYD536 | 72532.2 | 4.8 | 0.06 | 26 | — | — | — |
| LYD533 | 72721.1 | 5.0 | 0.23 | 30 | 97.7 | 0.19 | 43 |
| LYD533 | 72721.2 | 4.7 | 0.20 | 23 | 95.2 | 0.02 | 40 |
| LYD533 | 72722.1 | — | — | — | 89.2 | 0.29 | 31 |
| LYD533 | 72723.1 | 5.8 | 0.29 | 51 | 117.9 | 0.07 | 73 |
| LYD526 | 72164.4 | 4.7 | 0.11 | 24 | 96.3 | 0.12 | 41 |
| CONT. | — | 3.8 | — | — | 68.1 | — | — |
| LYD679 | 72650.6 | 8.6 | 0.03 | 56 | 151.9 | 0.09 | 33 |
| LYD645 | 72339.2 | 10.2 | 0.01 | 85 | 192.3 | 0.02 | 68 |
| LYD636 | 72200.3 | 9.2 | 0.02 | 68 | 160.6 | 0.05 | 40 |
| LYD634 | 71998.2 | 9.9 | 0.03 | 80 | 197.9 | 0.05 | 73 |
| LYD634 | 71999.3 | 7.5 | 0.24 | 36 | 137.0 | 0.30 | 20 |
| LYD567 | 72496.3 | 8.8 | 0.21 | 59 | — | — | — |
| LYD556 | 72904.3 | 9.1 | 0.06 | 65 | 184.3 | 0.09 | 61 |
| LYD552 | 72983.2 | 9.5 | 0.01 | 73 | 170.6 | 0.02 | 49 |
| CONT. | — | 5.5 | — | — | 114.7 | — | — |
| LYD689 | 72712.3 | 5.5 | 0.24 | 37 | — | — | — |
| LYD689 | 72713.1 | 9.6 | 0.05 | 141 | 174.7 | L | 118 |
| LYD675 | 72643.1 | 7.3 | 0.08 | 82 | 142.2 | 0.08 | 77 |
| LYD675 | 72644.3 | 8.7 | 0.01 | 119 | 174.8 | L | 118 |
| LYD675 | 72646.1 | 9.6 | L | 140 | 165.4 | 0.01 | 106 |
| LYD671 | 72877.1 | — | — | — | 100.3 | 0.12 | 25 |
| LYD671 | 72878.2 | 6.8 | 0.02 | 69 | 119.2 | 0.16 | 49 |
| LYD671 | 72880.1 | — | — | — | 104.4 | 0.05 | 30 |
| LYD654 | 73922.3 | 6.6 | L | 65 | 119.5 | 0.03 | 49 |
| LYD654 | 73924.5 | 5.7 | 0.16 | 44 | — | — | — |
| LYD652 | 72560.2 | 7.3 | 0.03 | 83 | 141.0 | 0.04 | 76 |
| LYD652 | 72561.5 | 7.4 | 0.02 | 86 | 161.3 | 0.06 | 101 |
| LYD652 | 72563.1 | 9.1 | 0.06 | 129 | 163.1 | 0.02 | 103 |
| LYD648 | 72834.2 | 7.2 | L | 130 | 177.1 | L | 121 |
| LYD641 | 72633.4 | 5.8 | 0.22 | 44 | 116.2 | 0.22 | 45 |
| LYD641 | 72635.2 | 7.4 | 0.06 | 86 | 142.4 | 0.03 | 78 |
| LYD636 | 72199.3 | 7.8 | 0.10 | 95 | 135.9 | 0.08 | 69 |
| LYD636 | 72202.3 | 6.0 | 0.28 | 49 | — | — | — |
| LYD602 | 72613.1 | 6.1 | 0.19 | 52 | 134.4 | 0.13 | 68 |
| LYD602 | 72614.2 | 7.5 | L | 87 | 158.5 | L | 98 |
| LYD599 | 72265.3 | 6.3 | 0.07 | 59 | — | — | — |
| LYD599 | 72266.4 | 7.8 | 0.03 | 96 | 131.4 | L | 64 |
| LYD599 | 72270.4 | 8.8 | L | 121 | 157.8 | L | 97 |
| LYD555 | 74194.1 | 6.7 | 0.01 | 67 | 131.9 | 0.01 | 64 |
| LYD555 | 74197.1 | 7.9 | L | 98 | 137.4 | 0.03 | 71 |
| LYD555 | 74197.4 | 7.9 | 0.03 | 97 | 158.8 | 0.02 | 98 |
| LYD555 | 74197.6 | 5.0 | 0.09 | 27 | 94.8 | 0.06 | 18 |
| LYD548 | 72655.3 | 8.9 | 0.03 | 123 | 152.2 | 0.07 | 90 |
| LYD548 | 72656.2 | 5.3 | 0.14 | 34 | 97.7 | 0.20 | 22 |
| LYD541 | 72729.2 | 6.8 | 0.06 | 71 | 136.9 | 0.12 | 71 |
| LYD541 | 72729.7 | 5.2 | 0.29 | 32 | — | — | — |

TABLE 64-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYD541 | 72731.4 | 6.5 | 0.14 | 62 | 109.5 | 0.27 | 37 |
| LYD540 | 74182.2 | 5.0 | 0.20 | 26 | 98.0 | 0.17 | 22 |
| LYD540 | 74182.7 | 6.8 | L | 71 | 133.2 | 0.03 | 66 |
| LYD524 | 72859.1 | 9.6 | L | 141 | 178.9 | L | 123 |
| LYD524 | 72859.4 | 8.0 | 0.06 | 100 | 129.9 | 0.09 | 62 |
| CONT. | — | 4.0 | — | — | 80.2 | — | — |
| LYD683 | 72866.4 | 11.2 | L | 159 | 211.9 | L | 147 |
| LYD683 | 72870.1 | 6.9 | 0.10 | 59 | 117.4 | 0.12 | 37 |
| LYD683 | 72870.4 | 5.5 | 0.12 | 28 | — | — | — |
| LYD654 | 73922.4 | 5.2 | 0.26 | 20 | 107.6 | 0.16 | 25 |
| LYD654 | 73924.4 | 6.6 | 0.21 | 53 | 120.2 | 0.30 | 40 |
| LYD654 | 73924.5 | 5.8 | 0.08 | 33 | 114.2 | 0.01 | 33 |
| LYD654 | 73926.3 | 7.9 | 0.01 | 82 | 146.8 | L | 71 |
| LYD628 | 73679.2 | 5.8 | 0.22 | 34 | 114.2 | 0.23 | 33 |
| LYD628 | 73680.2 | 5.5 | 0.21 | 26 | — | — | — |
| LYD628 | 73681.5 | 8.7 | 0.06 | 100 | 152.2 | 0.06 | 77 |
| LYD624 | 73181.3 | 5.8 | 0.15 | 34 | 114.2 | 0.22 | 33 |
| LYD624 | 73382.3 | 5.9 | 0.30 | 36 | 116.6 | 0.22 | 36 |
| LYD624 | 73383.1 | 6.3 | L | 45 | 124.5 | 0.01 | 45 |
| LYD624 | 73385.3 | 5.6 | 0.22 | 29 | 117.8 | 0.11 | 37 |
| LYD605 | 73642.3 | 6.2 | L | 44 | 114.7 | 0.09 | 33 |
| LYD604 | 73045.1 | 6.9 | 0.17 | 60 | 125.7 | 0.22 | 46 |
| LYD604 | 73045.4 | 6.5 | L | 49 | 120.0 | 0.04 | 40 |
| LYD604 | 73048.2 | 6.6 | 0.26 | 51 | 119.3 | 0.28 | 39 |
| LYD598 | 72421.1 | 6.2 | 0.26 | 42 | — | — | — |
| LYD598 | 72445.1 | 6.0 | 0.01 | 39 | 112.0 | 0.07 | 30 |
| LYD581 | 73107.1 | 5.9 | 0.03 | 37 | 108.6 | 0.10 | 27 |
| LYD581 | 73107.5 | 5.5 | 0.27 | 27 | — | — | — |
| LYD581 | 73109.2 | 7.7 | 0.04 | 78 | 144.2 | L | 68 |
| LYD581 | 73109.3 | 8.5 | L | 95 | 142.1 | 0.04 | 65 |
| LYD581 | 73110.1 | 7.8 | L | 81 | 135.5 | L | 58 |
| LYD566 | 73480.4 | 7.7 | 0.03 | 78 | 143.1 | 0.07 | 67 |
| LYD566 | 73482.4 | 7.2 | L | 65 | 123.7 | L | 44 |
| LYD566 | 73483.6 | 5.0 | 0.26 | 15 | — | — | — |
| LYD554 | 72171.1 | 9.1 | 0.01 | 109 | 153.4 | 0.01 | 79 |
| LYD554 | 72174.4 | 7.2 | 0.17 | 65 | 126.6 | 0.20 | 47 |
| LYD550 | 74186.3 | 6.5 | 0.14 | 50 | — | — | — |
| LYD550 | 74187.1 | 6.2 | L | 44 | 110.1 | 0.11 | 28 |
| LYD550 | 74187.2 | 6.3 | 0.12 | 45 | 121.3 | 0.13 | 41 |
| LYD548 | 72655.3 | 6.1 | 0.03 | 41 | 109.7 | 0.10 | 28 |
| LYD548 | 72673.3 | 5.2 | 0.28 | 20 | 106.8 | 0.26 | 24 |
| LYD540 | 74181.2 | 8.7 | L | 101 | 157.3 | L | 83 |
| LYD540 | 74182.2 | 7.2 | L | 67 | 134.2 | L | 56 |
| LYD540 | 74182.4 | 7.0 | 0.05 | 61 | 129.8 | 0.01 | 51 |
| LYD540 | 74182.7 | 5.9 | 0.27 | 35 | 117.9 | 0.10 | 37 |
| LYD535 | 72850.5 | 6.8 | 0.07 | 57 | 116.6 | 0.14 | 36 |
| LYD535 | 72851.4 | 6.1 | 0.15 | 40 | — | — | — |
| LYD535 | 72852.2 | 5.2 | 0.25 | 21 | — | — | — |
| LYD530 | 73052.3 | 9.5 | L | 120 | 153.3 | L | 79 |
| LYD530 | 73053.3 | 9.0 | L | 107 | 152.0 | L | 77 |
| LYD530 | 73053.5 | 7.1 | 0.03 | 64 | 127.7 | 0.07 | 49 |
| LYD530 | 73054.3 | 5.3 | 0.22 | 22 | 108.0 | 0.21 | 26 |
| CONT. | — | 4.3 | — | — | 85.9 | — | — |
| LYD637 | 73685.1 | 9.0 | 0.15 | 42 | 173.7 | 0.13 | 53 |
| LYD637 | 73685.2 | 8.0 | 0.18 | 26 | 142.9 | 0.25 | 26 |
| LYD637 | 73685.3 | 9.8 | 0.03 | 54 | 183.6 | 0.05 | 62 |
| LYD605 | 73642.3 | — | — | — | 149.8 | 0.17 | 32 |
| LYD605 | 73644.2 | 8.2 | 0.14 | 29 | 142.8 | 0.22 | 26 |
| LYD605 | 73645.2 | 10.2 | 0.03 | 60 | 168.6 | 0.12 | 49 |
| LYD585 | 72986.1 | 8.5 | 0.13 | 34 | 167.2 | 0.08 | 48 |
| LYD585 | 72986.4 | 9.1 | 0.09 | 44 | 161.4 | 0.09 | 42 |
| LYD573 | 72977.1 | — | — | — | 151.0 | 0.24 | 33 |
| LYD573 | 72978.2 | — | — | — | 151.0 | 0.24 | 33 |
| LYD559 | 73627.2 | 8.3 | 0.24 | 31 | 140.9 | 0.28 | 24 |
| LYD537 | 73633.4 | 8.8 | 0.24 | 39 | — | — | — |
| LYD537 | 73633.5 | — | — | — | 136.2 | 0.29 | 20 |
| CONT. | — | 6.3 | — | — | 113.3 | — | — |
| LYD683 | 72868.1 | 7.2 | 0.28 | 24 | — | — | — |
| LYD647 | 72785.3 | 8.2 | 0.11 | 41 | 161.8 | 0.10 | 35 |
| LYD611 | 71992.5 | 9.7 | 0.02 | 65 | 188.8 | L | 57 |
| LYD611 | 71992.6 | 8.2 | 0.11 | 40 | 149.9 | 0.21 | 25 |
| LYD585 | 72987.2 | 7.5 | 0.29 | 27 | — | — | — |
| LYD573 | 72973.2 | 8.4 | 0.11 | 44 | 161.1 | 0.11 | 34 |
| LYD550 | 74188.2 | 7.6 | 0.07 | 30 | 152.9 | 0.07 | 27 |
| CONT. | — | 5.9 | — | — | 120.2 | — | — |
| LYD686 | 72796.2 | 5.3 | 0.28 | 26 | — | — | — |
| LYD673 | 72662.2 | 6.5 | 0.03 | 55 | 130.2 | 0.04 | 42 |
| LYD663 | 72853.5 | 6.5 | 0.17 | 55 | — | — | — |
| LYD655 | 72209.1 | 7.1 | 0.11 | 70 | 141.0 | 0.07 | 54 |
| LYD638 | 72432.2 | 6.5 | 0.19 | 55 | 117.7 | 0.20 | 29 |
| LYD638 | 72451.1 | — | — | — | 128.8 | 0.23 | 41 |
| LYD615 | 72262.1 | 6.0 | 0.06 | 44 | 140.9 | 0.06 | 54 |
| LYD613 | 72512.1 | — | — | — | 120.1 | 0.21 | 31 |
| LYD608 | 72885.3 | 6.7 | 0.08 | 59 | 124.6 | 0.08 | 36 |
| LYD608 | 72887.1 | 8.8 | 0.03 | 110 | 174.5 | 0.05 | 91 |
| LYD608 | 72888.2 | 5.3 | 0.28 | 27 | 112.6 | 0.24 | 23 |
| LYD607 | 71961.1 | 5.9 | 0.08 | 40 | 125.3 | 0.09 | 37 |
| LYD607 | 71963.2 | 5.9 | 0.08 | 40 | 116.2 | 0.22 | 27 |
| LYD597 | 72419.2 | 7.8 | 0.02 | 85 | 151.2 | 0.04 | 65 |
| LYD597 | 72419.3 | 7.2 | 0.08 | 73 | 121.1 | 0.17 | 32 |
| LYD597 | 72420.1 | 8.0 | L | 91 | 158.4 | 0.02 | 73 |
| LYD583 | 71943.1 | 5.8 | 0.23 | 39 | 116.7 | 0.24 | 28 |
| LYD583 | 71943.5 | 5.5 | 0.28 | 30 | — | — | — |
| LYD579 | 72350.3 | 6.9 | 0.05 | 64 | 162.1 | 0.02 | 77 |
| LYD579 | 72354.1 | 8.3 | 0.02 | 98 | 169.3 | 0.05 | 85 |
| LYD563 | 72319.2 | 6.9 | 0.01 | 65 | 124.5 | 0.06 | 36 |
| LYD563 | 72324.2 | 8.0 | 0.12 | 90 | 182.8 | 0.04 | 100 |
| CONT. | — | 4.2 | — | — | 91.5 | — | — |
| LYD592 | 74348.3 | — | — | — | 157.0 | 0.27 | 29 |
| LYD592 | 74350.1 | — | — | — | 212.2 | 0.13 | 75 |
| LYD592 | 74351.1 | — | — | — | 153.7 | 0.14 | 26 |
| LYD592 | 74353.3 | — | — | — | 230.9 | L | 90 |
| CONT. | — | — | — | — | 121.6 | — | — |
| LYD676 | 73881.2 | 5.8 | 0.15 | 16 | 131.1 | 0.29 | 51 |
| LYD591 | 73905.1 | 5.9 | 0.13 | 16 | 97.4 | 0.24 | 12 |
| CONT. | — | 5.0 | — | — | 86.9 | — | — |
| LYD665 | 72211.2 | 6.8 | L | 97 | 127.0 | L | 82 |
| LYD665 | 72216.4 | 5.0 | 0.11 | 45 | 97.7 | 0.14 | 40 |
| LYD665 | 72216.5 | 6.3 | 0.13 | 84 | 120.8 | 0.17 | 74 |
| LYD665 | 72216.6 | 5.3 | 0.13 | 54 | 100.8 | 0.25 | 45 |
| LYD592 | 74348.3 | 6.6 | 0.02 | 93 | 122.9 | 0.02 | 77 |
| LYD592 | 74348.4 | 8.3 | 0.02 | 143 | 149.5 | 0.02 | 115 |
| LYD592 | 74349.2 | 6.2 | 0.06 | 80 | 112.5 | 0.07 | 62 |
| LYD592 | 74350.1 | 9.6 | L | 179 | 175.3 | L | 152 |
| LYD592 | 74351.1 | 9.8 | 0.10 | 185 | 196.6 | 0.09 | 183 |
| LYD532 | 74343.2 | 5.6 | L | 64 | 108.0 | L | 55 |
| LYD532 | 74344.2 | 4.8 | 0.20 | 40 | 84.0 | 0.26 | 21 |
| LYD532 | 74345.1 | 4.7 | 0.08 | 36 | 89.0 | 0.05 | 28 |
| LYD532 | 74345.3 | 6.5 | 0.01 | 90 | 135.9 | 0.01 | 95 |
| LYD525 | 74229.2 | 6.4 | 0.04 | 87 | 117.9 | 0.02 | 69 |
| LYD525 | 74230.2 | 7.8 | 0.09 | 128 | 141.5 | 0.09 | 103 |
| LYD525 | 74233.1 | 4.3 | 0.16 | 25 | 81.1 | 0.28 | 17 |
| CONT. | — | 3.4 | — | — | 69.6 | — | — |
| LYD679 | 72652.3 | 6.7 | 0.03 | 55 | 153.5 | 0.11 | 41 |
| LYD670 | 73346.2 | 4.9 | 0.20 | 13 | — | — | — |
| LYD670 | 73348.1 | 5.7 | 0.04 | 33 | — | — | — |
| LYD646 | 73040.3 | 6.5 | 0.19 | 52 | 143.2 | 0.26 | 32 |
| LYD646 | 73040.4 | 5.6 | L | 31 | 134.8 | 0.17 | 24 |
| LYD646 | 73042.4 | 5.1 | 0.23 | 19 | — | — | — |
| LYD616 | 73057.4 | 5.1 | 0.20 | 19 | — | — | — |
| LYD609 | 73124.2 | 8.7 | 0.04 | 101 | 200.8 | 0.07 | 85 |
| LYD609 | 73128.5 | 5.4 | 0.23 | 26 | — | — | — |
| LYD604 | 73047.3 | 5.8 | 0.08 | 34 | — | — | — |
| LYD596 | 73634.2 | 5.4 | 0.09 | 26 | 127.1 | 0.26 | 17 |
| LYD581 | 73107.1 | 7.2 | L | 67 | 164.9 | 0.07 | 52 |
| LYD558 | 73112.3 | 5.5 | 0.01 | 28 | 137.2 | 0.12 | 26 |
| LYD558 | 73113.1 | 5.1 | 0.13 | 18 | — | — | — |
| LYD558 | 73114.3 | 6.5 | 0.21 | 51 | 163.2 | 0.26 | 50 |
| LYD552 | 72981.3 | 6.9 | L | 60 | 168.9 | L | 56 |
| LYD552 | 72981.4 | 5.9 | 0.17 | 37 | 145.5 | 0.05 | 34 |
| LYD530 | 73052.3 | 5.2 | 0.06 | 21 | — | — | — |

TABLE 64-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYD529 | 72899.7 | 6.4 | L | 48 | 135.5 | 0.08 | 25 |
| CONT. | — | 4.3 | — | — | 108.5 | — | — |

Table 64. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

The genes presented in Tables 65 and 66 show a significant improvement in plant performance since they produced a larger leaf biomass (leaf area) and root biomass (root length and root coverage) (Table 65) and a higher relative growth rate of leaf area, root coverage and root length (Table 66) when grown under normal growth conditions, as compared to control plants grown under identical growth conditions. Plants producing larger root biomass have better possibilities to absorb larger amount of nitrogen from soil. Plants producing larger leaf biomass have better ability to produce assimilates. The genes were cloned under the regulation of a constitutive promoter (At6669). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

TABLE 65

Genes showing improved plant performance at Normal growth conditions under regulation of At6669 promoter

| Gene Name | Event # | Leaf Area [cm$^2$] Ave. | P-Val. | % Incr. | Roots Coverage [cm$^2$] Ave. | P-Val. | % Incr. | Roots Length [cm] Ave. | P-Val. | % Incr. |
|---|---|---|---|---|---|---|---|---|---|---|
| LYD686 | 72796.2 | 0.5 | L | 56 | 10.9 | 0.03 | 48 | 7.8 | 0.23 | 6 |
| LYD686 | 72798.1 | 0.5 | L | 59 | — | — | — | — | — | — |
| LYD685 | 72458.3 | 0.5 | 0.10 | 46 | — | — | — | — | — | — |
| LYD685 | 72458.5 | 0.5 | L | 58 | 12.4 | 0.02 | 67 | 8.4 | L | 15 |
| LYD685 | 72459.1 | 0.4 | 0.08 | 33 | 8.8 | 0.18 | 19 | — | — | — |
| LYD685 | 72462.4 | 0.5 | 0.08 | 45 | — | — | — | — | — | — |
| LYD685 | 72462.5 | 0.5 | 0.05 | 43 | 10.0 | 0.18 | 36 | — | — | — |
| LYD673 | 72662.2 | 0.4 | 0.06 | 29 | 9.3 | 0.17 | 25 | 8.0 | L | 9 |
| LYD673 | 72663.3 | 0.4 | 0.07 | 27 | — | — | — | — | — | — |
| LYD673 | 72664.1 | 0.4 | 0.15 | 26 | — | — | — | — | — | — |
| LYD673 | 72666.1 | 0.4 | 0.14 | 25 | 8.8 | 0.23 | 20 | 7.8 | 0.19 | 6 |
| LYD663 | 72856.3 | 0.5 | 0.04 | 43 | 10.6 | 0.07 | 43 | — | — | — |
| LYD663 | 72856.5 | 0.5 | 0.01 | 44 | 10.4 | L | 40 | — | — | — |
| LYD663 | 72858.1 | 0.5 | L | 42 | 9.9 | 0.07 | 33 | — | — | — |
| LYD663 | 72858.3 | 0.4 | 0.12 | 22 | 9.9 | 0.03 | 33 | — | — | — |
| LYD655 | 72210.1 | 0.4 | 0.21 | 34 | 9.5 | 0.21 | 29 | — | — | — |
| LYD640 | 72556.3 | 0.5 | 0.02 | 57 | 11.3 | 0.03 | 53 | — | — | — |
| LYD640 | 72557.2 | 0.4 | L | 30 | 9.2 | 0.05 | 24 | — | — | — |
| LYD640 | 72558.2 | 0.5 | L | 55 | 11.4 | 0.04 | 54 | 8.1 | 0.05 | 10 |
| LYD638 | 72432.2 | — | — | — | 8.1 | 0.18 | 10 | 7.8 | 0.11 | 7 |
| LYD638 | 72451.1 | 0.5 | L | 66 | 12.0 | L | 63 | 8.1 | L | 10 |
| LYD615 | 72259.2 | 0.4 | 0.19 | 32 | — | — | — | — | — | — |
| LYD615 | 72260.1 | 0.5 | 0.05 | 58 | 11.1 | 0.01 | 50 | 8.3 | L | 13 |
| LYD615 | 72264.2 | 0.4 | 0.02 | 32 | — | — | — | — | — | — |
| LYD613 | 72512.3 | 0.4 | 0.05 | 28 | 8.7 | 0.11 | 18 | — | — | — |
| LYD613 | 72514.2 | 0.5 | 0.11 | 53 | — | — | — | — | — | — |
| LYD613 | 72515.4 | 0.4 | 0.01 | 24 | — | — | — | — | — | — |
| LYD608 | 72883.2 | 0.5 | L | 40 | 9.9 | L | 34 | — | — | — |
| LYD608 | 72888.2 | 0.5 | 0.01 | 44 | 12.9 | L | 74 | 8.1 | 0.01 | 11 |
| LYD607 | 71961.1 | 0.6 | L | 73 | 11.5 | L | 56 | — | — | — |
| LYD607 | 71963.1 | 0.5 | 0.02 | 59 | 9.7 | 0.23 | 32 | — | — | — |
| LYD607 | 71963.2 | 0.5 | 0.02 | 43 | 11.6 | L | 57 | — | — | — |
| LYD607 | 71963.4 | 0.4 | 0.05 | 32 | — | — | — | — | — | — |
| LYD597 | 72419.3 | 0.5 | L | 37 | 8.6 | 0.19 | 16 | — | — | — |
| LYD597 | 72420.1 | 0.4 | 0.16 | 11 | — | — | — | — | — | — |
| LYD583 | 71943.1 | 0.4 | 0.10 | 13 | — | — | — | — | — | — |
| LYD579 | 72350.2 | 0.4 | 0.03 | 18 | 8.0 | 0.15 | 8 | — | — | — |
| LYD579 | 72350.3 | 0.5 | L | 37 | 10.9 | 0.06 | 47 | 7.8 | 0.19 | 6 |
| LYD579 | 72354.1 | 0.5 | 0.02 | 43 | 11.2 | 0.01 | 51 | 8.0 | 0.03 | 9 |
| LYD563 | 72319.2 | 0.4 | 0.02 | 20 | 8.8 | 0.19 | 19 | — | — | — |
| LYD563 | 72319.4 | 0.5 | 0.04 | 54 | 11.4 | 0.01 | 54 | 7.8 | 0.17 | 6 |
| LYD563 | 72321.2 | 0.4 | 0.24 | 25 | — | — | — | — | — | — |
| LYD563 | 72323.1 | 0.4 | 0.04 | 33 | 11.8 | 0.08 | 59 | — | — | — |
| LYD563 | 72324.2 | — | — | — | — | — | — | 7.8 | 0.15 | 7 |
| CONT. | — | 0.3 | — | — | 7.4 | — | — | 7.3 | — | — |
| LYD676 | 73880.1 | 0.5 | 0.18 | 26 | — | — | — | — | — | — |
| LYD676 | 73884.1 | — | — | — | — | — | — | 7.7 | 0.23 | 5 |
| LYD660 | 73932.1 | 0.5 | 0.20 | 18 | — | — | — | — | — | — |
| LYD654 | 73924.4 | 0.5 | 0.11 | 21 | 7.5 | 0.24 | 25 | 7.7 | 0.15 | 6 |
| LYD647 | 72784.3 | 0.6 | 0.13 | 45 | 10.3 | 0.08 | 71 | 8.2 | 0.01 | 12 |
| LYD647 | 72785.2 | 0.5 | 0.04 | 28 | 7.5 | 0.19 | 25 | — | — | — |

TABLE 65-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD628 | 73678.3 | 0.5 | 0.27 | 20 | — | — | — | — | — | — |
| LYD628 | 73679.2 | 0.6 | 0.10 | 54 | 10.7 | 0.08 | 77 | 8.0 | 0.04 | 9 |
| LYD628 | 73681.1 | — | — | — | — | — | — | 7.8 | 0.12 | 7 |
| LYD614 | 73917.1 | 0.5 | 0.09 | 35 | — | — | — | — | — | — |
| LYD614 | 73919.3 | 0.6 | 0.09 | 60 | — | — | — | — | — | — |
| LYD611 | 71988.3 | — | — | — | 7.4 | 0.22 | 23 | 7.8 | 0.18 | 7 |
| LYD611 | 71992.3 | — | — | — | — | — | — | 7.9 | 0.08 | 8 |
| LYD611 | 71992.5 | 0.5 | 0.05 | 33 | — | — | — | 7.8 | 0.18 | 7 |
| LYD611 | 71992.6 | 0.6 | 0.03 | 43 | 9.0 | 0.12 | 49 | 8.0 | 0.07 | 9 |
| LYD605 | 73643.1 | 0.5 | 0.17 | 26 | — | — | — | — | — | — |
| LYD605 | 73644.2 | 0.5 | 0.05 | 30 | 7.3 | 0.25 | 21 | — | — | — |
| LYD598 | 72421.2 | 0.5 | 0.01 | 38 | 7.6 | 0.27 | 27 | 8.1 | 0.02 | 11 |
| LYD598 | 72423.3 | — | — | — | 8.9 | 0.03 | 47 | 7.8 | 0.12 | 7 |
| LYD591 | 73907.3 | 0.5 | 0.09 | 27 | 8.1 | 0.09 | 34 | 7.9 | 0.18 | 9 |
| LYD591 | 73907.4 | — | — | — | — | — | — | 7.8 | 0.13 | 7 |
| LYD589 | 73898.1 | 0.6 | 0.01 | 43 | 8.3 | 0.09 | 37 | 7.7 | 0.19 | 6 |
| LYD589 | 73903.3 | 0.5 | 0.08 | 35 | — | — | — | 7.8 | 0.11 | 7 |
| LYD588 | 73854.1 | 0.6 | 0.01 | 52 | 8.5 | 0.12 | 40 | 8.5 | L | 16 |
| LYD588 | 73855.3 | 0.5 | 0.03 | 37 | 8.6 | 0.08 | 42 | 7.6 | 0.28 | 5 |
| LYD584 | 73910.2 | 0.4 | 0.26 | 14 | — | — | — | — | — | — |
| LYD584 | 73915.4 | — | — | — | — | — | — | 7.8 | 0.11 | 8 |
| LYD566 | 73480.4 | — | — | — | — | — | — | 7.8 | 0.21 | 7 |
| LYD566 | 73482.4 | 0.6 | L | 59 | 8.7 | 0.07 | 44 | 7.8 | 0.18 | 7 |
| LYD566 | 73483.5 | 0.5 | 0.22 | 21 | 7.6 | 0.16 | 26 | — | — | — |
| LYD535 | 72851.6 | 0.5 | 0.06 | 26 | — | — | — | 7.8 | 0.09 | 7 |
| LYD535 | 72852.1 | 0.6 | L | 42 | 9.4 | 0.01 | 56 | — | — | — |
| CONT. | — | 0.4 | — | — | 6.0 | — | — | 7.3 | — | — |
| LYD682 | 72566.1 | 0.5 | 0.12 | 13 | — | — | — | — | — | — |
| LYD665 | 72215.2 | 0.5 | 0.08 | 27 | 8.5 | 0.09 | 19 | 7.9 | 0.07 | 8 |
| LYD665 | 72216.4 | 0.5 | 0.11 | 29 | 9.6 | 0.10 | 33 | 8.0 | 0.04 | 10 |
| LYD650 | 72639.4 | — | — | — | — | — | — | 8.1 | L | 10 |
| LYD650 | 72641.2 | 0.5 | 0.19 | 17 | 8.7 | 0.06 | 21 | 7.7 | 0.17 | 5 |
| LYD644 | 72775.1 | 0.5 | L | 27 | 9.3 | 0.11 | 29 | — | — | — |
| LYD644 | 72778.1 | — | — | — | — | — | — | 7.9 | 0.03 | 7 |
| LYD644 | 72780.2 | 0.5 | 0.18 | 20 | 9.1 | 0.11 | 27 | 7.8 | 0.14 | 7 |
| LYD639 | 72548.6 | — | — | — | — | — | — | 7.7 | 0.18 | 5 |
| LYD639 | 72549.3 | — | — | — | — | — | — | 8.2 | L | 12 |
| LYD639 | 72551.1 | 0.5 | 0.14 | 16 | 8.8 | 0.20 | 23 | 8.0 | 0.05 | 9 |
| LYD626 | 72001.3 | 0.5 | 0.02 | 28 | — | — | — | — | — | — |
| LYD626 | 72002.1 | 0.6 | L | 37 | 11.1 | L | 54 | 8.3 | 0.03 | 13 |
| LYD626 | 72004.4 | — | — | — | 8.5 | 0.15 | 19 | 8.0 | 0.07 | 9 |
| LYD606 | 72500.3 | — | — | — | — | — | — | 7.9 | 0.02 | 8 |
| LYD555 | 74193.5 | 0.5 | 0.13 | 13 | 9.7 | 0.09 | 35 | 8.0 | 0.05 | 8 |
| LYD555 | 74194.1 | 0.5 | 0.09 | 24 | — | — | — | 7.7 | 0.21 | 5 |
| LYD555 | 74197.1 | 0.5 | 0.05 | 17 | — | — | — | — | — | — |
| LYD542 | 72733.1 | 0.5 | 0.08 | 24 | — | — | — | — | — | — |
| LYD542 | 72733.2 | 0.5 | 0.29 | 14 | — | — | — | — | — | — |
| LYD542 | 72736.1 | — | — | — | — | — | — | 7.9 | 0.02 | 8 |
| LYD542 | 72736.4 | 0.5 | 0.16 | 26 | 8.9 | 0.15 | 24 | 7.9 | 0.15 | 8 |
| LYD540 | 74182.2 | 0.5 | 0.10 | 26 | — | — | — | — | — | — |
| LYD540 | 74182.4 | — | — | — | 8.2 | 0.14 | 14 | — | — | — |
| LYD536 | 72529.5 | 0.5 | 0.18 | 16 | — | — | — | — | — | — |
| LYD536 | 72532.2 | 0.5 | 0.06 | 21 | 8.6 | 0.20 | 20 | 8.0 | 0.09 | 8 |
| LYD533 | 72721.1 | 0.5 | 0.06 | 27 | 9.5 | 0.08 | 33 | 8.4 | L | 14 |
| LYD533 | 72721.2 | 0.5 | 0.05 | 21 | 9.0 | 0.03 | 25 | — | — | — |
| LYD533 | 72722.1 | 0.5 | 0.17 | 15 | — | — | — | — | — | — |
| LYD533 | 72723.1 | 0.5 | 0.09 | 34 | 9.8 | 0.14 | 36 | 7.9 | 0.06 | 8 |
| LYD526 | 72164.4 | — | — | — | 8.2 | 0.25 | 15 | — | — | — |
| LYD526 | 72168.4 | — | — | — | — | — | — | 7.6 | 0.29 | 4 |
| CONT. | — | 0.4 | — | — | 7.2 | — | — | 7.3 | — | — |
| LYD679 | 72650.6 | 0.7 | 0.01 | 39 | 11.6 | 0.17 | 29 | — | — | — |
| LYD679 | 72652.3 | 0.6 | 0.25 | 25 | 11.4 | 0.29 | 27 | — | — | — |
| LYD645 | 72339.2 | 0.7 | 0.01 | 47 | 11.8 | 0.13 | 31 | — | — | — |
| LYD636 | 72200.3 | 0.7 | 0.03 | 33 | 11.8 | 0.10 | 31 | — | — | — |
| LYD634 | 71998.2 | 0.7 | 0.03 | 45 | 15.0 | 0.06 | 67 | 8.2 | 0.16 | 5 |
| LYD634 | 71999.3 | 0.6 | 0.20 | 18 | — | — | — | — | — | — |
| LYD567 | 72496.3 | 0.7 | 0.15 | 37 | — | — | — | — | — | — |
| LYD556 | 72904.3 | 0.7 | 0.03 | 44 | 12.9 | 0.03 | 44 | — | — | — |
| LYD552 | 72979.3 | — | — | — | — | — | — | 8.1 | 0.15 | 4 |
| LYD552 | 72983.2 | 0.6 | 0.03 | 32 | 12.2 | 0.04 | 36 | — | — | — |
| LYD529 | 72898.2 | 0.6 | 0.21 | 27 | — | — | — | — | — | — |

TABLE 65-continued

Genes showing improved plant performance at Normal growth conditions under regulation of At6669 promoter

| | | Leaf Area [cm²] | | | Roots Coverage [cm²] | | | Roots Length [cm] | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| CONT. | — | 0.5 | — | — | 9.0 | — | — | 7.8 | — | — |
| LYD689 | 72711.2 | — | — | — | — | — | — | 7.5 | 0.18 | 6 |
| LYD689 | 72712.3 | — | — | — | 8.2 | 0.21 | 31 | — | — | — |
| LYD689 | 72713.1 | 0.7 | 0.01 | 72 | 12.6 | L | 101 | 8.4 | L | 20 |
| LYD675 | 72643.1 | 0.6 | 0.14 | 43 | 11.6 | 0.06 | 86 | 7.7 | 0.19 | 9 |
| LYD675 | 72644.1 | — | — | — | — | — | — | 7.7 | 0.13 | 10 |
| LYD675 | 72644.3 | 0.7 | L | 86 | 13.3 | L | 113 | 8.3 | L | 18 |
| LYD675 | 72646.1 | 0.7 | L | 68 | 12.5 | 0.02 | 100 | 7.7 | 0.15 | 10 |
| LYD671 | 72877.1 | 0.5 | 0.06 | 29 | 9.1 | 0.09 | 46 | 8.0 | L | 14 |
| LYD671 | 72878.2 | 0.6 | 0.05 | 50 | 11.4 | 0.09 | 82 | 8.1 | 0.02 | 16 |
| LYD671 | 72880.1 | 0.5 | 0.19 | 28 | 9.8 | 0.12 | 58 | 8.1 | 0.03 | 15 |
| LYD654 | 73922.3 | 0.6 | L | 54 | 9.8 | L | 56 | 7.9 | L | 13 |
| LYD654 | 73924.4 | — | — | — | — | — | — | 7.7 | 0.29 | 10 |
| LYD654 | 73924.5 | 0.5 | 0.20 | 18 | 9.2 | 0.01 | 47 | 8.0 | L | 14 |
| LYD652 | 72560.1 | — | — | — | — | — | — | 7.8 | 0.06 | 12 |
| LYD652 | 72560.2 | 0.6 | 0.04 | 48 | 12.2 | L | 96 | 8.4 | L | 19 |
| LYD652 | 72561.5 | 0.6 | 0.02 | 52 | 9.7 | 0.03 | 56 | 7.8 | 0.06 | 11 |
| LYD652 | 72563.1 | 0.6 | 0.02 | 64 | 12.4 | 0.04 | 98 | 8.5 | L | 21 |
| LYD648 | 72831.3 | — | — | — | — | — | — | 7.3 | 0.28 | 4 |
| LYD648 | 72834.1 | — | — | — | 8.6 | 0.16 | 38 | 8.1 | L | 15 |
| LYD648 | 72834.2 | 0.7 | L | 73 | 14.8 | L | 136 | 8.0 | 0.09 | 14 |
| LYD641 | 72632.2 | — | — | — | — | — | — | 7.4 | 0.27 | 6 |
| LYD641 | 72633.4 | 0.5 | 0.11 | 28 | 9.6 | 0.02 | 54 | 8.2 | L | 17 |
| LYD641 | 72635.2 | 0.6 | 0.04 | 41 | 10.6 | 0.13 | 70 | 8.0 | 0.16 | 13 |
| LYD636 | 72199.3 | 0.6 | 0.09 | 54 | 10.7 | 0.11 | 71 | — | — | — |
| LYD636 | 72200.3 | — | — | — | — | — | — | 7.6 | 0.11 | 9 |
| LYD636 | 72202.3 | — | — | — | 8.6 | 0.15 | 38 | 7.4 | 0.18 | 6 |
| LYD602 | 72613.1 | 0.5 | 0.19 | 34 | 8.6 | 0.19 | 37 | — | — | — |
| LYD602 | 72614.2 | 0.6 | L | 51 | 11.3 | 0.04 | 81 | 7.9 | 0.01 | 13 |
| LYD599 | 72265.3 | 0.5 | 0.24 | 23 | — | — | — | — | — | — |
| LYD599 | 72266.4 | 0.5 | 0.06 | 38 | — | — | — | — | — | — |
| LYD599 | 72270.4 | 0.7 | L | 72 | 8.0 | 0.05 | 29 | — | — | — |
| LYD555 | 74193.1 | 0.5 | 0.28 | 15 | — | — | — | 7.7 | 0.15 | 10 |
| LYD555 | 74194.1 | 0.6 | L | 56 | 13.0 | L | 109 | 8.4 | L | 20 |
| LYD555 | 74197.1 | 0.7 | L | 80 | 9.6 | 0.04 | 54 | 7.6 | 0.12 | 9 |
| LYD555 | 74197.4 | 0.7 | L | 66 | 11.8 | 0.01 | 89 | 7.9 | 0.01 | 12 |
| LYD555 | 74197.6 | 0.5 | 0.08 | 28 | 8.5 | 0.02 | 36 | 7.9 | 0.10 | 12 |
| LYD548 | 72655.3 | 0.7 | 0.01 | 84 | 11.6 | 0.02 | 85 | 8.2 | 0.03 | 17 |
| LYD548 | 72656.2 | 0.5 | 0.27 | 17 | 8.9 | 0.04 | 42 | 7.8 | 0.04 | 11 |
| LYD548 | 72673.3 | — | — | — | 7.8 | 0.10 | 24 | 7.6 | 0.06 | 8 |
| LYD548 | 72677.1 | — | — | — | 7.1 | 0.24 | 14 | 7.5 | 0.06 | 8 |
| LYD541 | 72729.2 | 0.6 | 0.07 | 55 | 10.4 | 0.12 | 67 | 7.6 | 0.26 | 9 |
| LYD541 | 72729.7 | 0.5 | 0.16 | 28 | — | — | — | 8.0 | 0.02 | 14 |
| LYD541 | 72731.4 | 0.6 | 0.03 | 45 | 7.9 | 0.26 | 26 | — | — | — |
| LYD541 | 72732.1 | 0.4 | 0.15 | 9 | — | — | — | 7.7 | 0.06 | 9 |
| LYD540 | 74182.2 | 0.5 | 0.17 | 30 | — | — | — | — | — | — |
| LYD540 | 74182.7 | 0.6 | L | 54 | 10.1 | 0.03 | 61 | 7.7 | 0.02 | 10 |
| LYD524 | 72859.1 | 0.7 | 0.01 | 68 | 9.9 | 0.01 | 59 | — | — | — |
| LYD524 | 72859.4 | 0.6 | 0.02 | 63 | 9.9 | 0.11 | 58 | 7.7 | 0.22 | 10 |
| LYD524 | 72864.4 | — | — | — | — | — | — | 7.7 | 0.05 | 10 |
| CONT. | — | 0.4 | — | — | 6.2 | — | — | 7.0 | — | — |
| LYD683 | 72866.4 | 0.7 | L | 75 | 13.8 | L | 79 | — | — | — |
| LYD683 | 72870.1 | 0.5 | 0.12 | 27 | 11.3 | L | 47 | 7.9 | 0.20 | 7 |
| LYD683 | 72870.4 | 0.5 | 0.05 | 24 | 11.0 | 0.05 | 44 | 7.9 | 0.27 | 6 |
| LYD654 | 73922.4 | 0.5 | 0.22 | 14 | 9.1 | 0.21 | 19 | — | — | — |
| LYD654 | 73924.4 | 0.5 | 0.20 | 25 | 11.4 | 0.09 | 49 | 8.0 | 0.19 | 8 |
| LYD654 | 73924.5 | 0.5 | 0.05 | 19 | 12.0 | L | 57 | 8.4 | 0.02 | 13 |
| LYD654 | 73926.3 | 0.6 | L | 50 | 12.4 | L | 62 | 8.2 | 0.05 | 11 |
| LYD628 | 73678.3 | — | — | — | 9.7 | 0.24 | 27 | — | — | — |
| LYD628 | 73679.2 | — | — | — | 10.7 | 0.17 | 39 | 8.1 | 0.19 | 9 |
| LYD628 | 73681.5 | 0.6 | 0.02 | 46 | 11.9 | 0.05 | 56 | 7.9 | 0.28 | 7 |
| LYD624 | 73181.3 | 0.6 | 0.08 | 32 | 10.0 | 0.10 | 31 | 8.1 | 0.10 | 9 |
| LYD624 | 73383.1 | 0.6 | L | 34 | 9.1 | 0.06 | 19 | — | — | — |
| LYD624 | 73385.1 | 0.5 | 0.22 | 24 | — | — | — | — | — | — |
| LYD624 | 73385.3 | 0.5 | 0.07 | 29 | 11.0 | L | 43 | 8.1 | 0.12 | 9 |
| LYD605 | 73642.3 | 0.5 | 0.06 | 28 | 8.7 | 0.19 | 14 | — | — | — |
| LYD604 | 73045.1 | 0.6 | 0.23 | 31 | 10.2 | 0.22 | 33 | 8.1 | 0.10 | 9 |
| LYD604 | 73045.4 | 0.6 | L | 31 | 9.4 | L | 22 | — | — | — |
| LYD604 | 73048.2 | — | — | — | 9.9 | 0.11 | 29 | 7.9 | 0.28 | 6 |
| LYD598 | 72421.2 | — | — | — | — | — | — | 8.0 | 0.21 | 8 |
| LYD598 | 72445.1 | 0.5 | 0.27 | 14 | 10.7 | 0.24 | 39 | 8.1 | 0.18 | 9 |

TABLE 65-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD581 | 73107.1 | 0.5 | 0.06 | 22 | — | — | — | — | — | — |
| LYD581 | 73109.2 | 0.5 | 0.07 | 30 | 11.2 | 0.03 | 46 | 8.1 | 0.10 | 8 |
| LYD581 | 73109.3 | 0.6 | 0.02 | 49 | 10.2 | 0.08 | 33 | — | — | — |
| LYD581 | 73110.1 | 0.6 | L | 51 | 12.7 | L | 66 | 8.0 | 0.22 | 7 |
| LYD566 | 73480.4 | 0.7 | 0.02 | 56 | 9.0 | 0.14 | 17 | — | — | — |
| LYD566 | 73482.4 | 0.7 | L | 56 | 10.5 | 0.03 | 37 | 8.0 | 0.17 | 8 |
| LYD566 | 73483.6 | — | — | — | 9.2 | 0.14 | 20 | 8.0 | 0.10 | 8 |
| LYD554 | 72171.1 | 0.6 | 0.02 | 51 | 12.1 | 0.09 | 57 | 8.2 | 0.15 | 11 |
| LYD554 | 72174.4 | — | — | — | 11.7 | 0.12 | 52 | 8.0 | 0.26 | 8 |
| LYD550 | 74186.3 | 0.6 | 0.16 | 36 | — | — | — | — | — | — |
| LYD550 | 74187.1 | 0.5 | L | 29 | — | — | — | — | — | — |
| LYD550 | 74187.2 | 0.6 | 0.09 | 42 | 10.7 | 0.10 | 39 | 8.0 | 0.26 | 7 |
| LYD548 | 72655.3 | 0.5 | 0.05 | 20 | 10.3 | 0.04 | 35 | — | — | — |
| LYD548 | 72673.3 | 0.5 | 0.25 | 11 | 9.2 | 0.28 | 20 | 8.3 | 0.04 | 12 |
| LYD540 | 74181.2 | 0.7 | L | 58 | 13.0 | L | 69 | 8.5 | 0.02 | 14 |
| LYD540 | 74182.2 | 0.6 | L | 36 | 10.6 | L | 38 | — | — | — |
| LYD540 | 74182.4 | 0.5 | 0.06 | 20 | 10.8 | 0.03 | 41 | 8.3 | 0.05 | 11 |
| LYD540 | 74182.7 | 0.5 | 0.25 | 25 | 10.0 | 0.20 | 30 | — | — | — |
| LYD535 | 72850.5 | 0.6 | 0.02 | 33 | 9.3 | 0.14 | 22 | — | — | — |
| LYD535 | 72851.4 | 0.5 | 0.18 | 23 | — | — | — | — | — | — |
| LYD535 | 72852.2 | — | — | — | — | — | — | 7.9 | 0.28 | 7 |
| LYD530 | 73052.3 | 0.7 | L | 63 | 13.5 | L | 76 | 8.2 | 0.04 | 11 |
| LYD530 | 73053.3 | 0.7 | L | 61 | 13.1 | L | 71 | 8.1 | 0.11 | 9 |
| LYD530 | 73053.4 | — | — | — | 10.1 | 0.16 | 32 | 8.1 | 0.12 | 9 |
| LYD530 | 73053.5 | 0.6 | 0.05 | 40 | 12.5 | L | 63 | 8.2 | 0.05 | 11 |
| LYD530 | 73054.3 | — | — | — | 9.1 | 0.21 | 19 | 8.1 | 0.09 | 9 |
| CONT. | — | 0.4 | — | — | 7.7 | — | — | 7.4 | — | — |
| LYD677 | 72223.1 | — | — | — | 13.3 | 0.25 | 15 | 8.6 | 0.02 | 5 |
| LYD677 | 72223.6 | 0.7 | 0.04 | 27 | 14.2 | 0.13 | 23 | 8.6 | 0.10 | 5 |
| LYD677 | 72223.7 | — | — | — | — | — | — | 8.5 | 0.23 | 4 |
| LYD637 | 73685.1 | 0.7 | 0.08 | 44 | 14.3 | 0.23 | 24 | 8.6 | 0.10 | 5 |
| LYD637 | 73685.2 | 0.7 | 0.03 | 30 | — | — | — | — | — | — |
| LYD637 | 73685.3 | 0.8 | 0.02 | 47 | 13.9 | 0.25 | 21 | — | — | — |
| LYD625 | 72756.1 | 0.6 | 0.16 | 23 | — | — | — | — | — | — |
| LYD605 | 73641.1 | 0.6 | 0.19 | 21 | — | — | — | — | — | — |
| LYD605 | 73642.3 | 0.7 | 0.15 | 34 | — | — | — | — | — | — |
| LYD605 | 73644.2 | 0.7 | 0.02 | 33 | — | — | — | — | — | — |
| LYD605 | 73645.2 | 0.8 | L | 62 | 14.8 | 0.08 | 28 | — | — | — |
| LYD585 | 72986.1 | 0.7 | 0.04 | 38 | 14.5 | 0.06 | 26 | 8.8 | 0.03 | 7 |
| LYD585 | 72986.4 | 0.7 | 0.01 | 45 | 13.9 | 0.11 | 21 | 8.7 | 0.14 | 6 |
| LYD585 | 72988.3 | 0.7 | 0.10 | 38 | — | — | — | — | — | — |
| LYD573 | 72974.2 | 0.6 | 0.25 | 15 | 14.2 | 0.09 | 23 | 8.4 | 0.20 | 2 |
| LYD573 | 72977.1 | 0.6 | 0.26 | 20 | — | — | — | — | — | — |
| LYD573 | 72978.2 | 0.7 | 0.12 | 35 | — | — | — | — | — | — |
| LYD566 | 73481.2 | 0.6 | 0.10 | 24 | — | — | — | — | — | — |
| LYD566 | 73483.6 | — | — | — | — | — | — | 8.4 | 0.21 | 3 |
| LYD559 | 73627.2 | 0.7 | 0.06 | 34 | — | — | — | 8.7 | 0.01 | 7 |
| LYD537 | 73628.1 | 0.6 | 0.28 | 20 | — | — | — | — | — | — |
| LYD537 | 73633.1 | 0.6 | 0.12 | 26 | — | — | — | 8.7 | 0.13 | 6 |
| LYD537 | 73633.4 | 0.7 | 0.13 | 36 | 15.3 | 0.10 | 33 | 8.6 | 0.08 | 5 |
| LYD537 | 73633.5 | 0.7 | 0.05 | 28 | 13.1 | 0.24 | 14 | — | — | — |
| CONT. | — | 0.5 | — | — | 11.5 | — | — | 8.2 | — | — |
| LYD683 | 72866.4 | — | — | — | — | — | — | 7.9 | 0.15 | 6 |
| LYD647 | 72784.3 | — | — | — | — | — | — | 7.9 | 0.15 | 6 |
| LYD647 | 72785.3 | 0.7 | 0.05 | 29 | 12.9 | 0.15 | 21 | — | — | — |
| LYD647 | 72785.4 | — | — | — | — | — | — | 8.0 | 0.23 | 7 |
| LYD647 | 72786.1 | — | — | — | — | — | — | 8.2 | 0.01 | 10 |
| LYD611 | 71991.5 | — | — | — | — | — | — | 7.9 | 0.05 | 7 |
| LYD611 | 71992.5 | 0.8 | L | 55 | 13.0 | 0.17 | 22 | — | — | — |
| LYD611 | 71992.6 | 0.7 | 0.02 | 29 | — | — | — | — | — | — |
| LYD585 | 72986.1 | — | — | — | — | — | — | 7.9 | 0.11 | 7 |
| LYD585 | 72986.4 | — | — | — | — | — | — | 8.2 | 0.06 | 10 |
| LYD585 | 72987.2 | — | — | — | — | — | — | 7.9 | 0.22 | 6 |
| LYD585 | 72988.1 | 0.7 | L | 29 | 14.3 | L | 34 | 7.9 | 0.10 | 6 |
| LYD573 | 72973.2 | 0.6 | 0.06 | 26 | 13.0 | 0.19 | 22 | 7.9 | 0.17 | 7 |
| LYD573 | 72974.2 | — | — | — | — | — | — | 7.8 | 0.22 | 6 |
| LYD573 | 72978.1 | 0.6 | 0.18 | 18 | — | — | — | 8.2 | L | 11 |
| LYD550 | 74188.2 | 0.6 | 0.04 | 25 | — | — | — | — | — | — |
| CONT. | — | 0.5 | — | — | 10.7 | — | — | 7.4 | — | — |
| LYD686 | 72796.2 | 0.5 | 0.28 | 12 | — | — | — | — | — | — |
| LYD673 | 72662.2 | 0.6 | 0.03 | 29 | 10.5 | 0.13 | 25 | — | — | — |

TABLE 65-continued

Genes showing improved plant performance at Normal growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LYD663 | 72858.1 | 0.6 | 0.25 | 29 | — | — | — | 7.9 | 0.27 | 4 |
| LYD655 | 72209.1 | 0.6 | 0.08 | 41 | 10.3 | 0.11 | 23 | 7.8 | 0.14 | 4 |
| LYD655 | 72210.1 | 0.6 | 0.17 | 40 | 11.5 | 0.02 | 36 | — | — | — |
| LYD640 | 72557.2 | 0.6 | L | 40 | 11.8 | 0.07 | 40 | 7.9 | 0.27 | 4 |
| LYD640 | 72558.3 | 0.5 | 0.10 | 20 | 10.0 | 0.19 | 19 | — | — | — |
| LYD638 | 72432.2 | 0.6 | 0.12 | 28 | — | — | — | — | — | — |
| LYD638 | 72451.1 | 0.6 | L | 42 | 11.9 | 0.05 | 42 | 8.0 | 0.05 | 6 |
| LYD615 | 72262.1 | 0.6 | 0.07 | 35 | 12.2 | 0.05 | 46 | 8.2 | 0.13 | 8 |
| LYD613 | 72515.1 | 0.6 | 0.07 | 44 | — | — | — | — | — | — |
| LYD613 | 72516.1 | 0.6 | 0.06 | 26 | — | — | — | — | — | — |
| LYD608 | 72885.3 | — | — | — | — | — | — | 8.1 | 0.02 | 7 |
| LYD608 | 72887.1 | 0.7 | 0.04 | 60 | 12.4 | 0.02 | 47 | — | — | — |
| LYD608 | 72888.1 | — | — | — | — | — | — | 7.9 | 0.10 | 4 |
| LYD608 | 72888.2 | 0.5 | 0.17 | 17 | 9.9 | 0.20 | 17 | 8.2 | 0.06 | 8 |
| LYD607 | 71961.1 | 0.5 | 0.12 | 22 | 10.5 | 0.13 | 25 | — | — | — |
| LYD607 | 71963.2 | 0.5 | 0.08 | 23 | 10.3 | 0.19 | 23 | 7.8 | 0.19 | 4 |
| LYD607 | 71963.4 | — | — | — | — | — | — | 7.8 | 0.20 | 3 |
| LYD597 | 72419.2 | 0.6 | 0.06 | 28 | — | — | — | — | — | — |
| LYD597 | 72420.1 | 0.7 | L | 48 | 11.1 | 0.04 | 32 | — | — | — |
| LYD583 | 71943.1 | — | — | — | — | — | — | 7.8 | 0.25 | 3 |
| LYD579 | 72350.3 | 0.6 | 0.05 | 42 | 11.4 | 0.04 | 35 | 8.1 | L | 7 |
| LYD579 | 72354.1 | 0.7 | 0.03 | 62 | 12.1 | 0.05 | 44 | 8.2 | 0.01 | 8 |
| LYD563 | 72319.2 | 0.6 | 0.01 | 37 | 11.5 | 0.02 | 37 | 8.1 | 0.05 | 7 |
| LYD563 | 72319.4 | — | — | — | — | — | — | 7.8 | 0.21 | 4 |
| LYD563 | 72324.2 | 0.7 | 0.10 | 63 | — | — | — | 8.4 | 0.01 | 11 |
| CONT. | — | 0.4 | — | — | 8.4 | — | — | 7.6 | — | — |
| LYD592 | 74348.3 | 0.7 | 0.15 | 29 | — | — | — | 8.6 | 0.12 | 8 |
| LYD592 | 74349.2 | 0.7 | 0.29 | 15 | — | — | — | — | — | — |
| LYD592 | 74350.1 | 0.8 | 0.08 | 40 | 13.6 | 0.13 | 27 | — | — | — |
| LYD592 | 74351.1 | 0.7 | 0.02 | 28 | 13.6 | 0.04 | 27 | 8.3 | 0.20 | 4 |
| LYD592 | 74353.3 | 0.9 | L | 65 | 16.3 | L | 52 | 8.8 | L | 10 |
| LYD525 | 74230.2 | 0.7 | 0.19 | 15 | — | — | — | 8.4 | 0.30 | 5 |
| CONT. | — | 0.6 | — | — | 10.7 | — | — | 8.0 | — | — |
| LYD676 | 73881.2 | 0.6 | 0.14 | 22 | 10.4 | 0.19 | 32 | — | — | — |
| LYD591 | 73905.1 | — | — | — | 10.3 | L | 29 | 8.2 | L | 11 |
| CONT. | — | 0.5 | — | — | 7.9 | — | — | 7.4 | — | — |
| LYD665 | 72211.2 | 0.6 | L | 72 | 10.5 | 0.02 | 39 | 8.3 | 0.02 | 13 |
| LYD665 | 72216.4 | 0.5 | 0.16 | 32 | — | — | — | 7.7 | 0.30 | 5 |
| LYD665 | 72216.5 | 0.5 | 0.18 | 31 | — | — | — | — | — | — |
| LYD665 | 72216.6 | 0.4 | 0.27 | 24 | 9.1 | 0.30 | 20 | 7.9 | 0.21 | 8 |
| LYD592 | 74348.3 | 0.6 | L | 70 | 11.2 | L | 49 | 8.0 | 0.06 | 9 |
| LYD592 | 74348.4 | 0.6 | L | 86 | 14.8 | L | 97 | 8.8 | L | 19 |
| LYD592 | 74349.2 | 0.6 | 0.04 | 58 | — | — | — | — | — | — |
| LYD592 | 74350.1 | 0.7 | L | 109 | 14.3 | L | 90 | 8.3 | 0.03 | 13 |
| LYD592 | 74351.1 | 0.7 | 0.07 | 96 | 13.3 | 0.09 | 76 | 8.2 | 0.05 | 12 |
| LYD532 | 74343.2 | 0.5 | L | 51 | 9.5 | 0.05 | 25 | — | — | — |
| LYD532 | 74345.1 | 0.4 | 0.06 | 23 | 9.2 | 0.12 | 22 | — | — | — |
| LYD532 | 74345.3 | 0.6 | L | 78 | 11.7 | L | 55 | 8.0 | 0.09 | 8 |
| LYD525 | 74229.2 | 0.5 | 0.01 | 56 | — | — | — | — | — | — |
| LYD525 | 74230.2 | 0.6 | 0.05 | 83 | 12.1 | 0.18 | 61 | 8.3 | 0.05 | 13 |
| LYD525 | 74233.1 | 0.4 | 0.13 | 17 | — | — | — | — | — | — |
| CONT. | — | 0.3 | — | — | 7.5 | — | — | 7.3 | — | — |
| LYD679 | 72652.3 | 0.6 | 0.06 | 27 | 13.1 | L | 36 | — | — | — |
| LYD670 | 73348.1 | 0.5 | 0.21 | 9 | — | — | — | — | — | — |
| LYD646 | 73040.3 | 0.6 | 0.17 | 29 | — | — | — | — | — | — |
| LYD646 | 73040.4 | 0.6 | L | 26 | 12.8 | L | 33 | 8.4 | L | 8 |
| LYD624 | 73181.3 | 0.5 | 0.12 | 9 | — | — | — | — | — | — |
| LYD616 | 73057.4 | 0.5 | 0.26 | 9 | — | — | — | — | — | — |
| LYD616 | 73058.4 | — | — | — | — | — | — | 8.3 | 0.09 | 7 |
| LYD609 | 73124.2 | 0.7 | 0.06 | 50 | 12.1 | 0.19 | 26 | — | — | — |
| LYD609 | 73128.5 | 0.6 | 0.16 | 18 | — | — | — | — | — | — |
| LYD604 | 73045.4 | 0.6 | 0.10 | 19 | — | — | — | — | — | — |
| LYD604 | 73047.3 | 0.6 | L | 24 | 10.7 | 0.24 | 11 | — | — | — |
| LYD581 | 73107.1 | 0.6 | L | 29 | 13.3 | L | 38 | — | — | — |
| LYD558 | 73112.3 | 0.6 | 0.23 | 18 | — | — | — | — | — | — |
| LYD558 | 73114.3 | 0.7 | 0.11 | 46 | — | — | — | 8.2 | 0.02 | 6 |
| LYD552 | 72981.3 | 0.7 | L | 36 | 11.4 | 0.17 | 18 | — | — | — |
| LYD552 | 72981.4 | 0.6 | 0.03 | 31 | 11.8 | 0.08 | 22 | — | — | — |
| LYD552 | 72983.1 | 0.6 | 0.17 | 26 | — | — | — | — | — | — |
| LYD530 | 73052.3 | 0.6 | 0.11 | 21 | — | — | — | — | — | — |

TABLE 65-continued

Genes showing improved plant performance at Normal growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LYD529 | 72899.7 | 0.6 | 0.03 | 25 | 11.5 | 0.06 | 20 | 8.1 | 0.06 | 4 |
| CONT. | — | 0.5 | — | — | 9.6 | — | — | 7.8 | — | — |

Table 65. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

TABLE 66

Genes showing improved plant performance at Normal growth conditions under regulation of At6669 promoter

| Gene Name | Event # | RGR Of Leaf Area (cm²/day) Ave. | P-Val. | % Incr. | RGR Of Roots Coverage (cm²/day) Ave. | P-Val. | % Incr. | RGR Of Root Length (cm/day) Ave. | P-Val. | % Incr. |
|---|---|---|---|---|---|---|---|---|---|---|
| LYD686 | 72796.2 | 0.1 | L | 67 | 1.3 | L | 49 | 0.8 | 0.16 | 8 |
| LYD686 | 72798.1 | 0.1 | L | 61 | — | — | — | — | — | — |
| LYD685 | 72458.3 | 0.0 | 0.02 | 45 | — | — | — | — | — | — |
| LYD685 | 72458.5 | 0.1 | L | 65 | 1.5 | L | 68 | 0.8 | 0.06 | 11 |
| LYD685 | 72459.1 | 0.0 | 0.03 | 32 | 1.1 | 0.17 | 18 | — | — | — |
| LYD685 | 72462.4 | 0.0 | L | 46 | 1.2 | 0.12 | 31 | — | — | — |
| LYD685 | 72462.5 | 0.0 | L | 48 | 1.2 | 0.03 | 36 | — | — | — |
| LYD673 | 72662.2 | 0.0 | 0.01 | 36 | 1.1 | 0.09 | 26 | 0.8 | 0.01 | 13 |
| LYD673 | 72663.3 | 0.0 | 0.04 | 28 | — | — | — | — | — | — |
| LYD673 | 72664.1 | 0.0 | 0.06 | 28 | — | — | — | — | — | — |
| LYD673 | 72666.1 | 0.0 | 0.05 | 30 | 1.1 | 0.16 | 20 | 0.8 | 0.23 | 7 |
| LYD663 | 72856.3 | 0.0 | L | 43 | 1.3 | L | 44 | — | — | — |
| LYD663 | 72856.5 | 0.0 | L | 49 | 1.3 | L | 41 | — | — | — |
| LYD663 | 72858.1 | 0.0 | L | 46 | 1.2 | 0.02 | 34 | — | — | — |
| LYD663 | 72858.3 | 0.0 | 0.05 | 25 | 1.2 | 0.02 | 34 | — | — | — |
| LYD655 | 72207.3 | 0.0 | 0.21 | 17 | — | — | — | — | — | — |
| LYD655 | 72210.1 | 0.0 | 0.05 | 37 | 1.2 | 0.08 | 30 | — | — | — |
| LYD640 | 72556.3 | 0.1 | L | 60 | 1.4 | L | 54 | — | — | — |
| LYD640 | 72557.2 | 0.0 | L | 32 | 1.1 | 0.06 | 25 | — | — | — |
| LYD640 | 72557.4 | 0.0 | 0.30 | 20 | — | — | — | — | — | — |
| LYD640 | 72558.2 | 0.1 | L | 64 | 1.4 | L | 54 | 0.8 | 0.24 | 7 |
| LYD640 | 72558.3 | 0.0 | 0.30 | 15 | — | — | — | — | — | — |
| LYD638 | 72432.2 | — | — | — | — | — | — | 0.8 | 0.18 | 7 |
| LYD638 | 72451.1 | 0.1 | L | 63 | 1.5 | L | 64 | 0.8 | 0.19 | 7 |
| LYD615 | 72259.2 | 0.0 | 0.07 | 33 | — | — | — | — | — | — |
| LYD615 | 72260.1 | 0.1 | L | 66 | 1.4 | L | 51 | 0.8 | 0.02 | 14 |
| LYD615 | 72264.2 | 0.0 | 0.01 | 31 | — | — | — | — | — | — |
| LYD613 | 72512.3 | 0.0 | 0.03 | 31 | 1.1 | 0.15 | 18 | — | — | — |
| LYD613 | 72514.2 | 0.1 | 0.01 | 55 | 1.1 | 0.17 | 23 | — | — | — |
| LYD613 | 72515.4 | 0.0 | 0.02 | 28 | — | — | — | — | — | — |
| LYD608 | 72883.2 | 0.0 | L | 46 | 1.2 | L | 35 | — | — | — |
| LYD608 | 72888.2 | 0.0 | L | 48 | 1.6 | L | 75 | 0.8 | 0.19 | 7 |
| LYD607 | 71961.1 | 0.1 | L | 80 | 1.4 | L | 54 | — | — | — |
| LYD607 | 71963.1 | 0.1 | L | 64 | 1.2 | 0.07 | 31 | — | — | — |
| LYD607 | 71963.2 | 0.0 | L | 46 | 1.4 | L | 57 | — | — | — |
| LYD607 | 71963.4 | 0.0 | L | 37 | — | — | — | — | — | — |
| LYD597 | 72419.3 | 0.0 | L | 35 | 1.1 | 0.20 | 17 | 0.8 | 0.21 | 7 |
| LYD597 | 72420.1 | 0.0 | 0.27 | 13 | — | — | — | — | — | — |
| LYD597 | 72443.4 | 0.0 | 0.19 | 26 | — | — | — | — | — | — |
| LYD583 | 71943.1 | 0.0 | 0.29 | 12 | — | — | — | — | — | — |
| LYD579 | 72350.2 | 0.0 | 0.10 | 19 | — | — | — | — | — | — |
| LYD579 | 72350.3 | 0.0 | L | 41 | 1.3 | L | 48 | — | — | — |
| LYD579 | 72354.1 | 0.0 | L | 42 | 1.4 | L | 52 | 0.8 | 0.19 | 7 |
| LYD563 | 72319.2 | 0.0 | 0.29 | 12 | 1.1 | 0.16 | 19 | — | — | — |
| LYD563 | 72319.4 | 0.1 | L | 62 | 1.4 | L | 55 | — | — | — |
| LYD563 | 72321.2 | 0.0 | 0.15 | 24 | 1.1 | 0.18 | 21 | — | — | — |
| LYD563 | 72323.1 | 0.0 | L | 40 | 1.4 | L | 60 | — | — | — |
| CONT. | — | 0.0 | — | — | 0.9 | — | — | 0.7 | — | — |
| LYD676 | 73880.1 | 0.0 | 0.21 | 27 | — | — | — | 0.8 | 0.28 | 8 |
| LYD676 | 73884.1 | — | — | — | — | — | — | 0.8 | 0.12 | 12 |
| LYD654 | 73924.4 | 0.0 | 0.18 | 25 | 0.9 | 0.23 | 28 | 0.8 | 0.05 | 15 |

TABLE 66-continued

Genes showing improved plant performance at Normal growth conditions under regulation of At6669 promoter

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LYD647 | 72784.3 | 0.1 | 0.05 | 49 | 1.3 | 0.01 | 74 | 0.8 | 0.12 | 13 |
| LYD647 | 72785.2 | 0.1 | 0.09 | 33 | 0.9 | 0.24 | 26 | — | — | — |
| LYD628 | 73679.2 | 0.1 | 0.01 | 68 | 1.3 | L | 79 | — | — | — |
| LYD628 | 73681.1 | — | — | — | — | — | — | 0.8 | 0.17 | 10 |
| LYD614 | 73917.1 | 0.1 | 0.05 | 42 | — | — | — | — | — | — |
| LYD614 | 73919.3 | 0.1 | 0.04 | 55 | — | — | — | — | — | — |
| LYD611 | 71988.3 | — | — | — | 0.9 | 0.26 | 25 | 0.8 | 0.12 | 12 |
| LYD611 | 71992.3 | — | — | — | — | — | — | 0.8 | 0.03 | 16 |
| LYD611 | 71992.5 | 0.1 | 0.10 | 32 | — | — | — | 0.8 | 0.28 | 8 |
| LYD611 | 71992.6 | 0.1 | 0.04 | 44 | 1.1 | 0.05 | 51 | 0.8 | 0.08 | 14 |
| LYD605 | 73643.1 | 0.1 | 0.14 | 31 | — | — | — | — | — | — |
| LYD605 | 73644.2 | 0.1 | 0.13 | 29 | 0.9 | 0.30 | 23 | — | — | — |
| LYD598 | 72421.2 | 0.1 | 0.06 | 37 | 0.9 | 0.25 | 27 | 0.8 | 0.13 | 12 |
| LYD598 | 72423.3 | — | — | — | 1.1 | 0.03 | 50 | 0.7 | 0.30 | 8 |
| LYD591 | 73907.3 | 0.1 | 0.14 | 29 | 1.0 | 0.11 | 36 | 0.8 | 0.21 | 11 |
| LYD591 | 73907.4 | — | — | — | — | — | — | 0.8 | 0.04 | 15 |
| LYD589 | 73898.1 | 0.1 | 0.04 | 45 | 1.0 | 0.09 | 40 | 0.8 | 0.18 | 11 |
| LYD589 | 73903.3 | 0.1 | 0.08 | 38 | — | — | — | 0.8 | 0.19 | 11 |
| LYD588 | 73851.2 | — | — | — | — | — | — | 0.8 | 0.19 | 11 |
| LYD588 | 73852.1 | — | — | — | — | — | — | 0.8 | 0.10 | 13 |
| LYD588 | 73852.2 | 0.0 | 0.28 | 25 | — | — | — | 0.8 | 0.20 | 12 |
| LYD588 | 73854.1 | 0.1 | 0.02 | 51 | 1.0 | 0.08 | 42 | 0.8 | 0.01 | 20 |
| LYD588 | 73855.3 | 0.1 | 0.04 | 40 | 1.0 | 0.06 | 44 | 0.8 | 0.25 | 9 |
| LYD584 | 73915.4 | — | — | — | — | — | — | 0.8 | 0.10 | 12 |
| LYD566 | 73480.4 | — | — | — | — | — | — | 0.8 | 0.02 | 20 |
| LYD566 | 73481.2 | — | — | — | — | — | — | 0.8 | 0.09 | 13 |
| LYD566 | 73482.4 | 0.1 | L | 59 | 1.1 | 0.05 | 47 | 0.8 | 0.28 | 9 |
| LYD566 | 73483.5 | 0.0 | 0.28 | 22 | 0.9 | 0.20 | 28 | — | — | — |
| LYD566 | 73483.6 | — | — | — | — | — | — | 0.8 | 0.08 | 13 |
| LYD535 | 72851.6 | 0.0 | 0.22 | 23 | — | — | — | 0.8 | 0.22 | 10 |
| LYD535 | 72852.1 | 0.1 | 0.02 | 45 | 1.2 | 0.01 | 59 | 0.8 | 0.20 | 11 |
| CONT. | — | 0.0 | — | — | 0.7 | — | — | 0.7 | — | — |
| LYD682 | 72566.1 | 0.0 | 0.30 | 15 | — | — | — | — | — | — |
| LYD665 | 72215.2 | 0.1 | 0.07 | 29 | 1.0 | 0.18 | 20 | 0.8 | 0.13 | 9 |
| LYD665 | 72216.4 | 0.1 | 0.08 | 30 | 1.2 | 0.05 | 34 | 0.8 | 0.15 | 9 |
| LYD650 | 72639.4 | — | — | — | — | — | — | 0.8 | 0.06 | 11 |
| LYD650 | 72641.2 | 0.0 | 0.16 | 22 | 1.1 | 0.14 | 22 | 0.8 | 0.10 | 10 |
| LYD644 | 72775.1 | 0.1 | 0.03 | 32 | 1.1 | 0.07 | 29 | — | — | — |
| LYD644 | 72778.1 | — | — | — | — | — | — | 0.8 | 0.29 | 6 |
| LYD644 | 72780.2 | 0.0 | 0.22 | 20 | 1.1 | 0.09 | 27 | — | — | — |
| LYD639 | 72549.3 | — | — | — | — | — | — | 0.8 | 0.21 | 7 |
| LYD639 | 72551.1 | 0.1 | 0.13 | 22 | 1.1 | 0.15 | 24 | 0.9 | 0.02 | 15 |
| LYD626 | 72001.1 | — | — | — | — | — | — | 0.8 | 0.28 | 7 |
| LYD626 | 72001.3 | 0.1 | 0.06 | 29 | — | — | — | — | — | — |
| LYD626 | 72002.1 | 0.1 | 0.03 | 35 | 1.4 | L | 55 | — | — | — |
| LYD626 | 72004.4 | — | — | — | 1.0 | 0.22 | 19 | 0.8 | 0.18 | 8 |
| LYD555 | 74193.5 | — | — | — | 1.2 | 0.04 | 35 | — | — | — |
| LYD555 | 74194.1 | 0.1 | 0.08 | 27 | — | — | — | — | — | — |
| LYD555 | 74197.1 | 0.0 | 0.28 | 15 | — | — | — | — | — | — |
| LYD542 | 72733.1 | 0.0 | 0.17 | 21 | — | — | — | — | — | — |
| LYD542 | 72736.4 | 0.1 | 0.14 | 25 | 1.1 | 0.13 | 24 | 0.8 | 0.19 | 9 |
| LYD540 | 74182.2 | 0.1 | 0.09 | 28 | — | — | — | — | — | — |
| LYD536 | 72532.2 | 0.0 | 0.16 | 21 | 1.1 | 0.19 | 21 | 0.8 | 0.05 | 13 |
| LYD533 | 72721.1 | 0.1 | 0.06 | 31 | 1.2 | 0.05 | 32 | 0.8 | 0.06 | 11 |
| LYD533 | 72721.2 | 0.1 | 0.10 | 24 | 1.1 | 0.09 | 25 | — | — | — |
| LYD533 | 72722.1 | 0.0 | 0.28 | 15 | — | — | — | — | — | — |
| LYD533 | 72723.1 | 0.1 | 0.02 | 41 | 1.2 | 0.05 | 37 | 0.8 | 0.08 | 10 |
| CONT. | — | 0.0 | — | — | 0.9 | — | — | 0.7 | — | — |
| LYD679 | 72650.6 | 0.1 | 0.06 | 38 | 1.4 | 0.17 | 29 | — | — | — |
| LYD679 | 72652.3 | 0.1 | 0.18 | 30 | 1.4 | 0.23 | 27 | — | — | — |
| LYD645 | 72339.2 | 0.1 | L | 55 | 1.4 | 0.14 | 31 | — | — | — |
| LYD636 | 72200.3 | 0.1 | 0.06 | 37 | 1.4 | 0.13 | 30 | — | — | — |
| LYD634 | 71998.2 | 0.1 | 0.01 | 55 | 1.8 | L | 67 | — | — | — |
| LYD567 | 72496.3 | 0.1 | 0.10 | 39 | — | — | — | — | — | — |
| LYD556 | 72903.5 | — | — | — | 1.4 | 0.28 | 24 | — | — | — |
| LYD556 | 72904.3 | 0.1 | 0.04 | 44 | 1.6 | 0.04 | 45 | — | — | — |
| LYD552 | 72979.3 | — | — | — | — | — | — | 0.8 | 0.29 | 7 |
| LYD552 | 72983.2 | 0.1 | 0.04 | 40 | 1.5 | 0.07 | 36 | — | — | — |
| LYD529 | 72898.2 | 0.1 | 0.17 | 31 | — | — | — | — | — | — |
| CONT. | — | 0.1 | — | — | 1.1 | — | — | 0.7 | — | — |

TABLE 66-continued

Genes showing improved plant performance at Normal growth conditions under regulation of At6669 promoter

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LYD689 | 72712.3 | 0.0 | 0.17 | 19 | 1.0 | 0.09 | 32 | — | — | — |
| LYD689 | 72713.1 | 0.1 | L | 82 | 1.5 | L | 99 | 0.8 | 0.08 | 16 |
| LYD675 | 72643.1 | 0.1 | L | 54 | 1.4 | L | 87 | — | — | — |
| LYD675 | 72644.1 | — | — | — | — | — | — | 0.7 | 0.27 | 10 |
| LYD675 | 72644.3 | 0.1 | L | 99 | 1.6 | L | 114 | — | — | — |
| LYD675 | 72646.1 | 0.1 | L | 82 | 1.5 | L | 102 | — | — | — |
| LYD671 | 72877.1 | 0.01 | L | 34 | 1.1 | 0.01 | 48 | 0.8 | 0.03 | 19 |
| LYD671 | 72878.2 | 0.1 | L | 62 | 1.3 | L | 80 | 0.7 | 0.20 | 12 |
| LYD671 | 72880.1 | 0.1 | 0.02 | 34 | 1.2 | 0.01 | 59 | 0.8 | 0.15 | 14 |
| LYD654 | 73922.3 | 0.1 | L | 65 | 1.2 | L | 54 | 0.8 | 0.10 | 14 |
| LYD654 | 73924.4 | 0.0 | 0.13 | 29 | 1.0 | 0.14 | 40 | — | — | — |
| LYD654 | 73924.5 | 0.0 | 0.07 | 22 | 1.1 | 0.01 | 44 | — | — | — |
| LYD652 | 72560.1 | — | — | — | — | — | — | 0.8 | 0.14 | 14 |
| LYD652 | 72560.2 | 0.1 | L | 60 | 1.5 | L | 97 | — | — | — |
| LYD652 | 72561.5 | 0.1 | L | 63 | 1.2 | L | 56 | — | — | — |
| LYD652 | 72563.1 | 0.1 | L | 75 | 1.5 | L | 97 | 0.8 | 0.04 | 20 |
| LYD648 | 72832.2 | 0.1 | 0.02 | 33 | 1.0 | 0.15 | 33 | — | — | — |
| LYD648 | 72834.1 | 0.0 | 0.18 | 16 | 1.0 | 0.06 | 38 | 0.7 | 0.21 | 11 |
| LYD648 | 72834.2 | 0.1 | L | 91 | 1.8 | L | 139 | — | — | — |
| LYD641 | 72633.4 | 0.1 | 0.01 | 33 | 1.1 | L | 52 | — | — | — |
| LYD641 | 72635.2 | 0.1 | L | 49 | 1.2 | 0.01 | 67 | — | — | — |
| LYD636 | 72199.3 | 0.1 | L | 63 | 1.3 | L | 69 | — | — | — |
| LYD636 | 72202.3 | 0.1 | 0.05 | 35 | 1.0 | 0.08 | 34 | — | — | — |
| LYD602 | 72613.1 | 0.1 | L | 45 | 1.0 | 0.06 | 38 | — | — | — |
| LYD602 | 72613.3 | 0.0 | 0.30 | 15 | — | — | — | — | — | — |
| LYD602 | 72614.2 | 0.1 | L | 66 | 1.4 | L | 82 | — | — | — |
| LYD602 | 72617.3 | 0.0 | 0.11 | 22 | — | — | — | — | — | — |
| LYD599 | 72265.3 | 0.1 | 0.01 | 36 | — | — | — | 0.8 | 0.03 | 23 |
| LYD599 | 72266.4 | 0.1 | L | 50 | — | — | — | — | — | — |
| LYD599 | 72270.4 | 0.1 | L | 91 | 1.0 | 0.07 | 29 | — | — | — |
| LYD555 | 74193.1 | 0.0 | 0.27 | 12 | — | — | — | 0.7 | 0.24 | 11 |
| LYD555 | 74194.1 | 0.1 | L | 72 | 1.5 | L | 107 | 0.7 | 0.23 | 11 |
| LYD555 | 74197.1 | 0.1 | L | 86 | 1.1 | L | 53 | — | — | — |
| LYD555 | 74197.4 | 0.1 | L | 70 | 1.4 | L | 89 | — | — | — |
| LYD555 | 74197.6 | 0.1 | L | 34 | 1.0 | 0.04 | 33 | — | — | — |
| LYD548 | 72655.3 | 0.1 | L | 101 | 1.4 | L | 81 | — | — | — |
| LYD548 | 72656.2 | 0.1 | 0.01 | 30 | 1.1 | 0.02 | 42 | — | — | — |
| LYD548 | 72673.3 | 0.0 | 0.18 | 16 | 0.9 | 0.13 | 23 | — | — | — |
| LYD541 | 72729.2 | 0.1 | L | 67 | 1.3 | L | 70 | 0.8 | 0.17 | 13 |
| LYD541 | 72729.7 | 0.1 | L | 42 | 0.9 | 0.26 | 25 | 0.7 | 0.29 | 10 |
| LYD541 | 72731.4 | 0.1 | L | 48 | 0.9 | 0.18 | 24 | — | — | — |
| LYD541 | 72732.1 | 0.0 | 0.03 | 19 | — | — | — | — | — | — |
| LYD540 | 74182.2 | 0.1 | 0.03 | 32 | — | — | — | — | — | — |
| LYD540 | 74182.7 | 0.1 | L | 60 | 1.2 | L | 60 | — | — | — |
| LYD524 | 72859.1 | 0.1 | L | 77 | 1.2 | L | 59 | — | — | — |
| LYD524 | 72859.4 | 0.1 | L | 70 | 1.2 | 0.01 | 57 | — | — | — |
| LYD524 | 72864.4 | — | — | — | — | — | — | 0.7 | 0.20 | 11 |
| CONT. | — | 0.0 | — | — | 0.7 | — | — | 0.7 | — | — |
| LYD683 | 72866.3 | — | — | — | 1.1 | 0.26 | 20 | — | — | — |
| LYD683 | 72866.4 | 0.1 | L | 79 | 1.7 | L | 80 | — | — | — |
| LYD683 | 72870.1 | 0.1 | 0.05 | 32 | 1.4 | L | 49 | 0.8 | 0.27 | 9 |
| LYD683 | 72870.4 | 0.1 | 0.09 | 25 | 1.3 | L | 45 | — | — | — |
| LYD654 | 73922.4 | — | — | — | 1.1 | 0.21 | 19 | — | — | — |
| LYD654 | 73924.4 | 0.1 | 0.10 | 29 | 1.4 | 0.01 | 48 | — | — | — |
| LYD654 | 73924.5 | 0.1 | 0.09 | 23 | 1.5 | L | 57 | — | — | — |
| LYD654 | 73926.3 | 0.1 | L | 53 | 1.5 | L | 64 | 0.8 | 0.13 | 13 |
| LYD628 | 73678.3 | 0.1 | 0.24 | 26 | 1.2 | 0.13 | 28 | 0.8 | 0.13 | 17 |
| LYD628 | 73679.2 | 0.1 | 0.16 | 25 | 1.3 | 0.05 | 38 | — | — | — |
| LYD628 | 73680.2 | — | — | — | 1.1 | 0.30 | 15 | — | — | — |
| LYD628 | 73681.5 | 0.1 | L | 50 | 1.5 | L | 56 | — | — | — |
| LYD624 | 73181.3 | 0.1 | 0.04 | 35 | 1.2 | 0.06 | 31 | 0.8 | 0.28 | 9 |
| LYD624 | 73383.1 | 0.1 | 0.02 | 34 | 1.1 | 0.15 | 19 | — | — | — |
| LYD624 | 73385.1 | 0.1 | 0.10 | 29 | — | — | — | — | — | — |
| LYD624 | 73385.3 | 0.1 | 0.06 | 30 | 1.3 | L | 45 | 0.8 | 0.16 | 12 |
| LYD605 | 73642.3 | 0.1 | 0.08 | 27 | 1.1 | 0.29 | 15 | — | — | — |
| LYD604 | 73045.1 | 0.1 | 0.08 | 36 | 1.2 | 0.08 | 32 | — | — | — |
| LYD604 | 73045.4 | 0.1 | 0.06 | 29 | 1.1 | 0.10 | 23 | 0.8 | 0.22 | 11 |
| LYD604 | 73048.2 | 0.1 | 0.23 | 24 | 1.2 | 0.07 | 29 | — | — | — |
| LYD598 | 72421.2 | — | — | — | 1.1 | 0.29 | 17 | — | — | — |
| LYD598 | 72445.1 | 0.1 | 0.18 | 20 | 1.3 | 0.08 | 37 | — | — | — |

TABLE 66-continued

Genes showing improved plant performance at Normal growth conditions under regulation of At6669 promoter

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LYD581 | 73107.1 | 0.1 | 0.09 | 24 | — | — | — | — | — | — |
| LYD581 | 73107.5 | — | — | — | 1.1 | 0.21 | 22 | — | — | — |
| LYD581 | 73109.2 | 0.1 | 0.02 | 37 | 1.4 | L | 46 | — | — | — |
| LYD581 | 73109.3 | 0.1 | L | 56 | 1.2 | 0.04 | 31 | — | — | — |
| LYD581 | 73110.1 | 0.1 | L | 52 | 1.6 | L | 67 | — | — | — |
| LYD566 | 73480.4 | 0.1 | L | 52 | 1.1 | 0.21 | 18 | — | — | — |
| LYD566 | 73482.4 | 0.1 | L | 59 | 1.3 | 0.02 | 39 | 0.8 | 0.08 | 16 |
| LYD566 | 73483.6 | — | — | — | 1.1 | 0.19 | 19 | — | — | — |
| LYD554 | 72171.1 | 0.1 | L | 54 | 1.5 | L | 56 | 0.8 | 0.28 | 11 |
| LYD554 | 72174.4 | 0.1 | 0.17 | 28 | 1.4 | 0.01 | 52 | — | — | — |
| LYD550 | 74186.3 | 0.1 | 0.08 | 34 | — | — | — | — | — | — |
| LYD550 | 74187.1 | 0.1 | 0.02 | 34 | — | — | — | — | — | — |
| LYD550 | 74187.2 | 0.1 | 0.03 | 42 | 1.3 | 0.03 | 41 | 0.8 | 0.15 | 14 |
| LYD548 | 72655.3 | 0.1 | 0.17 | 20 | 1.3 | 0.02 | 35 | — | — | — |
| LYD548 | 72656.2 | — | — | — | — | — | — | 0.8 | 0.11 | 15 |
| LYD548 | 72673.3 | — | — | — | 1.1 | 0.20 | 20 | 0.8 | 0.06 | 16 |
| LYD540 | 74181.2 | 0.1 | L | 57 | 1.6 | L | 69 | 0.8 | 0.11 | 15 |
| LYD540 | 74182.2 | 0.1 | L | 42 | 1.3 | 0.01 | 37 | — | — | — |
| LYD540 | 74182.4 | 0.1 | 0.10 | 23 | 1.3 | L | 42 | — | — | — |
| LYD540 | 74182.7 | 0.1 | 0.21 | 23 | 1.2 | 0.08 | 31 | — | — | — |
| LYD535 | 72850.5 | 0.1 | 0.03 | 33 | 1.1 | 0.12 | 23 | — | — | — |
| LYD535 | 72851.4 | 0.1 | 0.13 | 24 | — | — | — | — | — | — |
| LYD530 | 73052.3 | 0.1 | L | 69 | 1.6 | L | 76 | 0.8 | 0.19 | 11 |
| LYD530 | 73053.3 | 0.1 | L | 74 | 1.6 | L | 71 | 0.8 | 0.08 | 16 |
| LYD530 | 73053.4 | — | — | — | 1.2 | 0.08 | 32 | 0.8 | 0.25 | 11 |
| LYD530 | 73053.5 | 0.1 | 0.02 | 42 | 1.5 | L | 64 | 0.8 | 0.16 | 12 |
| LYD530 | 73054.3 | — | — | — | 1.1 | 0.22 | 18 | — | — | — |
| CONT. | — | 0.0 | — | — | 0.9 | — | — | 0.7 | — | — |
| LYD677 | 72223.1 | — | — | — | — | — | — | 0.8 | 0.26 | 7 |
| LYD677 | 72223.6 | 0.1 | 0.04 | 34 | 1.7 | 0.14 | 23 | — | — | — |
| LYD637 | 73684.1 | — | — | — | — | — | — | 0.8 | 0.26 | 8 |
| LYD637 | 73685.1 | 0.1 | 0.05 | 40 | 1.7 | 0.18 | 24 | — | — | — |
| LYD637 | 73685.2 | 0.1 | 0.06 | 31 | — | — | — | 0.8 | 0.26 | 7 |
| LYD637 | 73685.3 | 0.1 | 0.02 | 47 | 1.7 | 0.22 | 21 | — | — | — |
| LYD625 | 72756.1 | 0.1 | 0.16 | 25 | — | — | — | — | — | — |
| LYD605 | 73641.1 | 0.1 | 0.24 | 20 | — | — | — | 0.9 | 0.03 | 14 |
| LYD605 | 73642.3 | 0.1 | 0.16 | 28 | — | — | — | — | — | — |
| LYD605 | 73644.2 | 0.1 | 0.06 | 32 | — | — | — | — | — | — |
| LYD605 | 73645.2 | 0.1 | L | 65 | 1.8 | 0.08 | 29 | 0.8 | 0.27 | 8 |
| LYD585 | 72986.1 | 0.1 | 0.04 | 37 | 1.7 | 0.11 | 25 | — | — | — |
| LYD585 | 72986.4 | 0.1 | 0.02 | 45 | 1.7 | 0.20 | 20 | 0.8 | 0.29 | 8 |
| LYD585 | 72988.3 | 0.1 | 0.06 | 38 | — | — | — | — | — | — |
| LYD573 | 72974.2 | 0.1 | 0.29 | 18 | 1.7 | 0.15 | 22 | — | — | — |
| LYD573 | 72977.1 | 0.1 | 0.24 | 21 | — | — | — | — | — | — |
| LYD573 | 72978.2 | 0.1 | 0.08 | 35 | — | — | — | — | — | — |
| LYD566 | 73481.2 | 0.1 | 0.20 | 22 | — | — | — | — | — | — |
| LYD559 | 73627.2 | 0.1 | 0.03 | 39 | — | — | — | 0.9 | 0.03 | 16 |
| LYD537 | 73628.1 | 0.1 | 0.26 | 21 | — | — | — | — | — | — |
| LYD537 | 73633.1 | 0.1 | 0.12 | 28 | — | — | — | — | — | — |
| LYD537 | 73633.4 | 0.1 | 0.06 | 39 | 1.9 | 0.06 | 33 | — | — | — |
| LYD537 | 73633.5 | 0.1 | 0.08 | 29 | — | — | — | — | — | — |
| CONT. | — | 0.1 | — | — | 1.4 | — | — | 0.7 | — | — |
| LYD683 | 72866.4 | — | — | — | — | — | — | 0.8 | 0.07 | 15 |
| LYD683 | 72867.4 | — | — | — | — | — | — | 0.8 | 0.20 | 11 |
| LYD683 | 72868.1 | 0.1 | 0.27 | 18 | — | — | — | — | — | — |
| LYD647 | 72784.3 | — | — | — | — | — | — | 0.8 | 0.25 | 9 |
| LYD647 | 72785.3 | 0.1 | 0.03 | 37 | 1.6 | 0.17 | 21 | — | — | — |
| LYD647 | 72786.1 | — | — | — | — | — | — | 0.8 | 0.12 | 12 |
| LYD611 | 71991.5 | — | — | — | — | — | — | 0.8 | 0.22 | 9 |
| LYD611 | 71992.2 | — | — | — | — | — | — | 0.8 | 0.19 | 11 |
| LYD611 | 71992.5 | 0.1 | L | 66 | 1.6 | 0.14 | 23 | 0.8 | 0.11 | 12 |
| LYD611 | 71992.6 | 0.1 | 0.02 | 36 | — | — | — | 0.8 | 0.27 | 9 |
| LYD585 | 72986.4 | 0.1 | 0.26 | 17 | — | — | — | — | — | — |
| LYD585 | 72987.2 | 0.1 | 0.26 | 20 | — | — | — | — | — | — |
| LYD585 | 72988.1 | 0.1 | 0.02 | 33 | 1.7 | 0.02 | 34 | — | — | — |
| LYD573 | 72973.2 | 0.1 | 0.04 | 33 | 1.6 | 0.17 | 21 | 0.8 | 0.07 | 14 |
| LYD573 | 72974.2 | — | — | — | — | — | — | 0.8 | 0.11 | 13 |
| LYD573 | 72978.1 | 0.1 | 0.22 | 19 | — | — | — | 0.8 | 0.06 | 15 |
| LYD550 | 74188.2 | 0.1 | 0.07 | 28 | — | — | — | — | — | — |
| CONT. | — | 0.1 | — | — | 1.3 | — | — | 0.7 | — | — |

TABLE 66-continued

Genes showing improved plant performance at Normal growth conditions under regulation of At6669 promoter

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LYD686 | 72796.2 | 0.1 | 0.29 | 17 | — | — | — | — | — | — |
| LYD673 | 72662.2 | 0.1 | 0.08 | 29 | 1.3 | 0.16 | 25 | — | — | — |
| LYD673 | 72663.3 | 0.1 | 0.27 | 20 | — | — | — | — | — | — |
| LYD663 | 72853.5 | 0.1 | 0.28 | 22 | — | — | — | — | — | — |
| LYD663 | 72858.1 | 0.1 | 0.15 | 32 | — | — | — | — | — | — |
| LYD655 | 72209.1 | 0.1 | 0.03 | 46 | 1.3 | 0.17 | 24 | 0.8 | 0.15 | 10 |
| LYD655 | 72210.1 | 0.1 | 0.05 | 47 | 1.4 | 0.04 | 38 | — | — | — |
| LYD640 | 72557.2 | 0.1 | 0.02 | 40 | 1.4 | 0.04 | 41 | — | — | — |
| LYD640 | 72558.3 | 0.1 | 0.14 | 25 | 1.2 | 0.24 | 21 | — | — | — |
| LYD638 | 72432.2 | 0.1 | 0.11 | 31 | — | — | — | — | — | — |
| LYD638 | 72451.1 | 0.1 | 0.01 | 45 | 1.4 | 0.04 | 40 | — | — | — |
| LYD615 | 72260.1 | 0.1 | 0.29 | 20 | — | — | — | — | — | — |
| LYD615 | 72262.1 | 0.1 | 0.03 | 45 | 1.5 | 0.02 | 47 | — | — | — |
| LYD613 | 72512.1 | — | — | — | — | — | — | 0.8 | 0.13 | 12 |
| LYD613 | 72515.1 | 0.1 | 0.02 | 52 | — | — | — | — | — | — |
| LYD613 | 72516.1 | 0.1 | 0.14 | 26 | — | — | — | — | — | — |
| LYD608 | 72887.1 | 0.1 | L | 65 | 1.5 | 0.01 | 49 | — | — | — |
| LYD608 | 72888.2 | 0.1 | 0.29 | 18 | 1.2 | 0.29 | 19 | 0.8 | 0.09 | 14 |
| LYD607 | 71961.1 | 0.1 | 0.15 | 25 | 1.3 | 0.15 | 26 | — | — | — |
| LYD607 | 71963.2 | 0.1 | 0.05 | 34 | 1.2 | 0.20 | 23 | — | — | — |
| LYD597 | 72419.2 | 0.1 | 0.07 | 32 | — | — | — | — | — | — |
| LYD597 | 72420.1 | 0.1 | L | 60 | 1.4 | 0.06 | 34 | — | — | — |
| LYD583 | 71943.2 | 0.1 | 0.29 | 21 | 1.3 | 0.22 | 25 | — | — | — |
| LYD579 | 72350.3 | 0.1 | 0.02 | 48 | 1.4 | 0.05 | 36 | — | — | — |
| LYD579 | 72354.1 | 0.1 | L | 72 | 1.5 | 0.03 | 45 | — | — | — |
| LYD563 | 72319.2 | 0.1 | 0.02 | 42 | 1.4 | 0.04 | 37 | — | — | — |
| LYD563 | 72324.2 | 0.1 | 0.04 | 56 | 1.3 | 0.20 | 33 | — | — | — |
| CONT. | — | 0.0 | — | — | 1.0 | — | — | 0.7 | — | — |
| LYD592 | 74348.3 | 0.1 | 0.13 | 29 | — | — | — | — | — | — |
| LYD592 | 74350.1 | 0.1 | 0.04 | 42 | 1.6 | 0.17 | 25 | — | — | — |
| LYD592 | 74351.1 | 0.1 | 0.08 | 29 | 1.6 | 0.13 | 25 | — | — | — |
| LYD592 | 74353.3 | 0.1 | L | 66 | 2.0 | L | 51 | — | — | — |
| CONT. | — | 0.1 | — | — | 1.3 | — | — | — | — | — |
| LYD676 | 73881.2 | 0.1 | 0.06 | 27 | 1.3 | 0.05 | 33 | 0.8 | 0.27 | 10 |
| LYD591 | 73905.1 | — | — | — | 1.3 | 0.02 | 30 | 0.8 | 0.03 | 13 |
| CONT. | — | 0.0 | — | — | 1.0 | — | — | 0.7 | — | — |
| LYD665 | 72211.2 | 0.1 | L | 78 | 1.3 | 0.02 | 38 | 0.9 | 0.15 | 10 |
| LYD665 | 72216.4 | 0.0 | 0.03 | 39 | 1.1 | 0.28 | 19 | — | — | — |
| LYD665 | 72216.5 | 0.1 | 0.02 | 43 | 1.1 | 0.25 | 23 | — | — | — |
| LYD665 | 72216.6 | 0.0 | 0.08 | 31 | 1.1 | 0.24 | 20 | 0.9 | 0.23 | 9 |
| LYD592 | 74348.3 | 0.1 | L | 79 | 1.4 | L | 47 | 0.9 | 0.21 | 8 |
| LYD592 | 74348.4 | 0.1 | L | 95 | 1.8 | L | 96 | 0.9 | 0.16 | 10 |
| LYD592 | 74349.2 | 0.1 | L | 59 | 1.1 | 0.26 | 20 | — | — | — |
| LYD592 | 74350.1 | 0.1 | L | 116 | 1.7 | L | 86 | — | — | — |
| LYD592 | 74351.1 | 0.1 | L | 103 | 1.6 | L | 72 | — | — | — |
| LYD532 | 74343.2 | 0.1 | L | 51 | 1.2 | 0.11 | 26 | — | — | — |
| LYD532 | 74345.1 | 0.0 | 0.04 | 28 | 1.1 | 0.21 | 20 | — | — | — |
| LYD532 | 74345.3 | 0.1 | L | 84 | 1.4 | L | 51 | — | — | — |
| LYD525 | 74229.2 | 0.1 | L | 53 | — | — | — | — | — | — |
| LYD525 | 74230.2 | 0.1 | L | 90 | 1.5 | 0.03 | 58 | — | — | — |
| CONT. | — | 0.0 | — | — | 0.9 | — | — | 0.8 | — | — |
| LYD679 | 72652.3 | 0.1 | L | 32 | 1.6 | L | 37 | — | — | — |
| LYD670 | 73347.4 | 0.1 | 0.21 | 14 | — | — | — | — | — | — |
| LYD670 | 73348.1 | 0.1 | 0.20 | 11 | — | — | — | — | — | — |
| LYD646 | 73040.3 | 0.1 | 0.04 | 31 | 1.3 | 0.26 | 14 | — | — | — |
| LYD646 | 73040.4 | 0.1 | L | 29 | 1.5 | L | 33 | 0.8 | 0.18 | 10 |
| LYD646 | 73042.3 | 0.1 | 0.22 | 14 | — | — | — | — | — | — |
| LYD624 | 73181.3 | 0.1 | 0.21 | 10 | — | — | — | — | — | — |
| LYD624 | 73382.4 | 0.1 | 0.22 | 17 | — | — | — | — | — | — |
| LYD609 | 73124.2 | 0.1 | L | 55 | 1.5 | 0.06 | 26 | — | — | — |
| LYD609 | 73128.5 | 0.1 | 0.22 | 13 | — | — | — | — | — | — |
| LYD604 | 73045.4 | 0.1 | 0.05 | 20 | — | — | — | — | — | — |
| LYD604 | 73047.3 | 0.1 | L | 29 | 1.3 | 0.28 | 12 | — | — | — |
| LYD581 | 73107.1 | 0.1 | L | 31 | 1.6 | L | 38 | — | — | — |
| LYD581 | 73107.5 | 0.1 | 0.13 | 17 | — | — | — | — | — | — |
| LYD558 | 73112.3 | 0.1 | 0.13 | 18 | — | — | — | — | — | — |
| LYD558 | 73114.3 | 0.1 | L | 52 | 1.4 | 0.14 | 23 | — | — | — |
| LYD552 | 72981.3 | 0.1 | L | 38 | 1.4 | 0.14 | 17 | — | — | — |
| LYD552 | 72981.4 | 0.1 | L | 31 | 1.4 | 0.06 | 22 | — | — | — |
| LYD552 | 72983.1 | 0.1 | 0.05 | 26 | — | — | — | — | — | — |

TABLE 66-continued

Genes showing improved plant performance at Normal growth conditions under regulation of At6669 promoter

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LYD530 | 73052.3 | 0.1 | 0.02 | 27 | — | — | — | — | — | — |
| LYD529 | 72897.1 | — | — | — | — | — | — | 0.8 | 0.15 | 9 |
| LYD529 | 72899.7 | 0.1 | L | 30 | 1.4 | 0.08 | 20 | — | — | — |
| LYD529 | 72900.2 | — | — | — | — | — | — | 0.8 | 0.28 | 7 |
| CONT. | — | 0.0 | — | — | 1.2 | — | — | 0.7 | — | — |

Table 66. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

Results from T1 Plants

The genes presented in Tables 67-69 showed a significant improvement in plant biomass and root development since they produced a higher biomass (dry and fresh weight, Table 67), a larger leaf and root biomass (leaf area, root length and root coverage) (Table 68), and a higher relative growth rate of leaf area, root coverage and root length (Table 69) when grown under normal growth conditions, as compared to control plants grown under identical growth conditions. Plants producing larger root biomass have better possibilities to absorb larger amount of nitrogen from soil. Plants producing larger leaf biomass has better ability to produce assimilates). The genes were cloned under the regulation of a constitutive promoter (At6669; SEQ ID NO:4111). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

Tables 67-69 summarize the observed phenotypes of transgenic plants expressing the gene constructs using the TC-T1 Assays.

TABLE 67

Genes showing improved plant performance at Normal growth conditions under regulation of A6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LYD690 | 4.6 | 0.01 | 26 | 108.9 | L | 26 |
| LYD550 | 4.8 | L | 30 | 121.0 | L | 40 |

TABLE 67-continued

Genes showing improved plant performance at Normal growth conditions under regulation of A6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LYD525 | 4.6 | 0.09 | 24 | 108.4 | 0.17 | 26 |
| CONT. | 3.7 | — | — | 86.3 | — | — |
| LYD592 | 4.9 | 0.02 | 37 | 99.6 | L | 42 |
| CONT. | 3.6 | — | — | 70.2 | — | — |
| LYD633 | 10.6 | L | 25 | 200.2 | 0.06 | 25 |
| LYD619 | 10.8 | 0.03 | 28 | 194.8 | 0.03 | 21 |
| LYD587 | 9.8 | 0.04 | 17 | — | — | — |
| LYD565 | 10.2 | 0.19 | 21 | — | — | — |
| CONT. | 8.4 | — | — | 160.5 | — | — |
| LYD659 | 8.8 | 0.07 | 11 | 160.8 | 0.12 | 12 |
| CONT. | 8.0 | — | — | 143.9 | — | — |
| LYD659 | 5.9 | L | 64 | 136.1 | 0.02 | 64 |
| LYD578 | 4.3 | 0.27 | 20 | 96.3 | 0.18 | 16 |
| LYD532 | 4.6 | 0.15 | 29 | 101.3 | 0.12 | 22 |
| CONT. | 3.6 | — | — | 82.8 | — | — |
| LYD532 | 6.6 | 0.08 | 48 | 205.1 | 0.06 | 80 |
| CONT. | 4.4 | — | — | 114.2 | — | — |
| LYD539_H11 | 7.8 | 0.20 | 25 | — | — | — |
| CONT. | 6.2 | — | — | — | — | — |
| LYD575 | 6.5 | 0.19 | 29 | 159.5 | 0.22 | 27 |
| CONT. | 5.0 | — | — | 125.1 | — | — |

Table 67. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

TABLE 68

Genes showing improved plant performance at Normal growth conditions under regulation of At6669 promoter

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LYD690 | 0.4 | L | 30 | 3.8 | 0.04 | 26 | — | — | — |
| LYD550 | 0.4 | L | 31 | — | — | — | — | — | — |
| LYD525 | 0.4 | 0.15 | 21 | — | — | — | — | — | — |
| CONT. | 0.3 | — | — | 3.0 | — | — | — | — | — |
| LYD592 | 0.5 | 0.05 | 41 | 4.2 | 0.17 | 26 | — | — | — |
| LYD575 | 0.4 | 0.05 | 12 | — | — | — | — | — | — |
| LYD539_H11 | 0.4 | 0.18 | 21 | 4.5 | 0.23 | 34 | 4.9 | 0.26 | 12 |
| CONT. | 0.3 | — | — | 3.4 | — | — | 4.4 | — | — |
| LYD633 | 0.8 | 0.14 | 26 | — | — | — | 7.2 | 0.14 | 20 |

TABLE 68-continued

Genes showing improved plant performance at Normal growth conditions under regulation of At6669 promoter

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LYD619 | 0.7 | 0.01 | 21 | — | — | — | 6.7 | 0.14 | 12 |
| LYD587 | 0.7 | 0.05 | 16 | 7.6 | 0.24 | 17 | 7.1 | 0.08 | 19 |
| LYD565 | 0.7 | 0.23 | 18 | — | — | — | — | — | — |
| CONT. | 0.6 | — | — | 6.5 | — | — | 6.0 | — | — |
| LYD659 | 0.8 | 0.17 | 11 | — | — | — | — | — | — |
| CONT. | 0.7 | — | — | — | — | — | — | — | — |
| LYD659 | 0.5 | L | 34 | 4.5 | 0.12 | 37 | — | — | — |
| LYD578 | 0.5 | 0.21 | 16 | 4.6 | 0.24 | 40 | — | — | — |
| LYD532 | 0.4 | 0.28 | 11 | — | — | — | — | — | — |
| CONT. | 0.4 | — | — | 3.3 | — | — | — | — | — |
| LYD576 | 0.5 | 0.12 | 22 | — | — | — | 6.7 | 0.09 | 11 |
| LYD532 | 0.7 | 0.04 | 54 | 7.4 | 0.13 | 43 | 7.2 | 0.04 | 19 |
| CONT. | 0.4 | — | — | 5.2 | — | — | 6.0 | — | — |
| LYD539_H11 | 0.6 | 0.25 | 19 | — | — | — | — | — | — |
| CONT. | 0.5 | — | — | — | — | — | — | — | — |
| LYD575 | 0.7 | 0.26 | 26 | 10.3 | 0.26 | 20 | — | — | — |
| CONT. | 0.5 | — | — | 8.6 | — | — | — | — | — |

Table 68. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

TABLE 69

Genes showing improved plant performance at Normal growth conditions under regulation of At6669 promoter

| Gene Name | RGR Of Leaf Area (cm²/day) | | | RGR Of Roots Coverage (cm²/day) | | | RGR Of Root Length (cm/day) | | |
|---|---|---|---|---|---|---|---|---|---|
| | Ave. | P-Val. | % Incr. | Ave. | P-Val. | % Incr. | Ave. | P-Val. | % Incr. |
| LYD690 | 0.0 | 0.02 | 25 | 0.5 | L | 28 | — | — | — |
| LYD550 | 0.0 | L | 28 | — | — | — | — | — | — |
| LYD525 | 0.0 | 0.14 | 18 | — | — | — | — | — | — |
| CONT. | 0.0 | — | — | 0.4 | — | — | — | — | — |
| LYD592 | 0.0 | L | 46 | 0.5 | 0.07 | 26 | — | — | — |
| LYD539_H11 | 0.0 | 0.05 | 26 | 0.5 | 0.07 | 34 | 0.5 | 0.27 | 11 |
| CONT. | 0.0 | — | — | 0.4 | — | — | 0.5 | — | — |
| LYD633 | 0.1 | 0.13 | 26 | — | — | — | 0.8 | 0.15 | 22 |
| LYD619 | 0.1 | 0.05 | 24 | — | — | — | 0.8 | 0.15 | 15 |
| LYD587 | 0.1 | 0.15 | 18 | 0.9 | 0.28 | 18 | 0.8 | 0.07 | 20 |
| LYD565 | 0.1 | 0.11 | 24 | — | — | — | — | — | — |
| CONT. | 0.1 | — | — | 0.8 | — | — | 0.7 | — | — |
| LYD659 | 0.1 | L | 39 | 0.6 | 0.02 | 41 | — | — | — |
| LYD578 | 0.0 | 0.13 | 18 | 0.6 | 0.04 | 41 | — | — | — |
| LYD532 | 0.0 | 0.20 | 14 | — | — | — | — | — | — |
| CONT. | 0.0 | — | — | 0.4 | — | — | — | — | — |
| LYD576 | 0.1 | 0.14 | 21 | — | — | — | 0.7 | 0.09 | 16 |
| LYD532 | 0.1 | L | 56 | 0.9 | 0.03 | 45 | 0.8 | 0.02 | 25 |
| CONT. | 0.0 | — | — | 0.6 | — | — | 0.6 | — | — |
| LYD575 | 0.1 | 0.23 | 22 | — | — | — | — | — | — |
| LYD539_H11 | 0.1 | 0.20 | 21 | — | — | — | — | — | — |
| CONT. | 0.1 | — | — | — | — | — | — | — | — |
| LYD575 | 0.1 | 0.08 | 31 | 1.3 | 0.21 | 20 | — | — | — |
| CONT. | 0.1 | — | — | 1.1 | — | — | — | — | — |

Table 69. "CONT."—Control; "Ave."—Average; "% Incr." = % increment; "p-val."—p-value, L—p < 0.01. The transgenes were under the transcriptional regulation of the new At6669 promoter (SEQ ID NO: 4111). "—" = results are still unavailable.

These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number as demonstrated by the leaf number parameter exhibit a potential to improve biomass yield important for forage crops and improve the plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results from increasing the plant population densities and hence improve land productivity.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (4608 sequences)

SEQ ID NO: 1 - DNA, 2163 bp, Arabidopsis thaliana
gtgtagtcggcggctgacgttttctttaccctaacacttttgaagcaacataacaaacgcgccgcgaatccatttttaagggtttagagacttttagggtttacttgagaacagagagatggggaagagcgaaaagacgtcgttggggcgatcactcgtgaagcaccacaaccatatgatacaagaatccaaagacaaaggcaagtactacaagaatctacagaagaaagttctcgaatctgtgactgaggtcagtgacatcgacgccatcattgagcaagctgaggaggcagagcgtctttacaccattaatcacagctcctccacacctttgtctatcaatctagacacaaattctagctcaagtgttatagcagctgaagaatggagagagcaacagaagatagaggaggctttacacgccagtagtcttcaagtacctcgaagacctccgtggacacctgaaatgtcagtggaagaacttgatgctaatgaaaaacaagcttttctaaattggcgccggatgcttgtgagccttgaggaaaatgaaaagctagtgttgactccattcgaaaagaaccttgacatctggagacagctttggagagtgcttgaacgcagtgatttgattgttatggtagttgatgctagagatccactgttttaccgctgccctgatcttgaggcatatgctcaagaaattgatgagcataaaaaaataatgcttctagtgaacaaggcggatcttttacctactgatgtcagggagaaatgggcagaatatttccgccttaacaacattctgtttgttttctggtcagccatagctgctacagctaccctagaaggtaaagtcttgaaagagcaatggagacaacccgataacttgcagaagacagatgatccagacattatgatatatggcagagacgagctgttgagtcgtttgcaatttgaggctcaagagattgtcaaagtaaggaattctagagcagcatccgtatcatcacagtcatggactggtgaatatcaacgtgatcaagccgtggttggatttgttgggtacccaaatgttggaaagagttctacaatcaatgcattggtgggtcagaagcgaacaggtgtcacctctaccccaggaaaaacaaagcatttccagactttgatcatctctgatgagcttatgctatgcgattgccctggtttagtcttcccttcgttctcaagctcaagatatgaaatgattgcttctggtgtacttccgattgaccggatgacggagcaccgtgaagctattcaggtggtggctgacaaggtccctcgccgtgtaattgagagtgtgtacaacatttctcttcctaaacccaaaacctatgagcgtcagtcccgcccgcctcatgctgcagagctcttaaaaagttactgtgcttctcgtggctatgttgcctcgagtggactaccggatgaaacgaaagctgcaaggctgattctgaaagattacattggaggtaagctgccacattatgcaatgccacctggaatgccccaagctgatgaaccggacatagaagacactcaagaactggaggatattctcgaaggttcagagtccgatgactctgcagtaggagatgagacagaaaacgagcaagttcctggtattgatgatgtgctagatgatctgagctcgtttgatcttgccaatgggcttaagtcttcaaagaaagtgacagcaaagaagcaaaccgcgtcacataaacagcacaaaaagccacagaggaaaaaggatcggacttggagggttcaaaacacagaagatggagatggaatgccttctgttaaagttttccagaaaccagctaacacaggtcctcttacgatgcggtgattatcaaattgtagtccatccaagcaaagatggcaaccgaagctacttaaagtttttttttttttttcaaaaaatgtaacagcagttgaacctgtcgcagtagttctcgagtgtcttgatgtttttgtttttatgattaaagtcttattttggggaaaagtagaaaaaagtgacaactcaaatctggtggaaaatggagaattgtttttgccagttggagatacctatcgctttgttttgagaatataatagccataaatagagttttcatgtaa

SEQ ID NO: 2 - DNA, 2572 bp, Arabidopsis thaliana
gctggaaaaaatagtcgactctgattgtctgtctgaagaaagaaaccgaatcgattcaatttcaacgtctcgtccttcaattttcgttttccgagaaaatttaggaaagaaagagaaagagagggcagagacaaaaatttcttcgccgtctgagtgggaaagatggcggaggatttcgctagagcggtagacgatgggcttaaactcgcgaaacggatttatttcggcaaagaccgagccgttgcggcgccgagaccacctgctccgatggacagatcttccactacgcagccttaccttcctacagcacctatggtttacgccgttatacccgacccgggaattgtggataacccggatttgcctagctatcagcctcacgtgcacggcaggtgcgacccaccggctttgattcctctgcagatgaattcgattgagctggatgttgattgttatctcgacacggctcttgttactgtcaccggatcgtggcgggttcattgtgttatgggaagcaagagatgtgattgccgaattgctattcccatgggagaacagggatcaatactaggtgttgaggttgagattcctagaaaatcgtacacaacgcagttgatcacagcagaagatggaaacgaatttgagaaaacggcactacctgaaactggtggctttttgaaacctaacattttcactcttactataccacaggttgatggaggtaccaatctctctatcaagatgacttggtctcagaagttgacgtataaccaagggcagttttttcttgatattcctttcaactttcctgagtatgtgactcctgcggtaaagaaaatctcaaaaagagaaaagatttacttgagtgttaatgctggtactggaacagaagttctctgcaaaggatgcagtcatcaactaaaggagaaattgcggagtgcagggaagttgaggtttgcatatgaagcagatgttttgaagtggtcgaacactgactttagcttttcttatacggcctcctcaagtaatatagttggtggacttttccttcaatctgcgcctgttcacgatgttgatcagagggacatattttctttctatctttttccaggaaagcagcaaaaaactaaggcattcaagcgggaggtagtatttgttgttgacataagtaaaagtatgactggaaaacctctcgaggatgtaaaaaatgcgatatctacagctctatctaagcttgatcctggagattctttcaatattatcactttcagcaatgatactgctctattttcgacatcaatggagtcagtcacttctgatgctgttgaaagaggcattgagtggatgaacaagaactttgtcgtcgcagatggtacaaacatgctccctcccctagagaaggctgtggaaatgctttcaaatactcgtggctctattcctatgatcttcttcgtaacagatgggtctgttgaagatgagagacacatttgtgatgtaatgaagaaacatctagctagtgctggatcagtgtttcctcggatacacacttttgggttaggtgtattctgtaatcactacttcctgcaaatgcttgcaaatatatcctgtggccagcacgaatcagtttataatacagatcacattgaggaaagaatggacaaactgtttacaaaggctttatccaccattcttgttaatatagcaattgagccccttcagagtctagatgaagttgaggtatacccttcaaatattccggatctgacgtctgcaagtccattgatgatatatggaagataccgaggaaagttccccgagaatgtgatagccaaaggtctgctaggagatttgagcagcttttcgacagacttgactgtacagagtgcaaaagacatgcctcttgataaagtatttgcaaagaatgttattgacttgcttactgctgaggcatggttttctgaagataaacagctaaaagagaagattgctaaactaagcatccaaaccggcgtactatccgagtatactcgaatgatccaattagagaacacagaagaattgaaacccagcgaaactggcggaaagaaaaagacaacaagcaacggcgagaaacagaagatgatatcaagaacgatcccgctacaaagccttgggataggatttggggataaaacagccaccagagagaatgttccgccaggatttggcgagcagaaagctcctgatgctgctgagaagttcgtcaaggctgcttcgagctgttgtgtctccttgtgcaacaaatgttgctgcatgtgttgtgtccaatgctgctctaagctcaatgatcaatgtgtccttgtcttcacacagctcttcacagcgattgcttgcatcgcctgctttgaatgttgctcaactgtttgctgttctggagacgatgggtagttagttaaattataaaaaaaaatcggttttgaattcgagtgtaaagctttaaaagtttcaaagtaagtttgtacattttacatacacactgcatgtaatttctgtacggcctgatcaaatataaaagctgtgggttttctgtata

SEQ ID NO: 3 - DNA, 1825 bp, Arabidopsis thaliana
aaatcaatcagagagagagcttctgagacataaacatcaattcaaatcgacgcaagcaaagaaagcaaaatggaaaatggaagcgggaaggtgttgaagccgatggactcagagcaattgagagagtacggacatctgatggttgatttcattgctgattactacaaaaccatcgaagatttccctgttcttagccaagttcagcctggttatcttcataagcttttgcctgattctgcacctgaccaccctgaaactctggaccaagttcttgatgatgttcgagcaaagatattgcctggagtaacgcattggcaaagcccgagtttctttgcttattatccttctaacagcagtgttgctgggttcttgggtgagatgttgagtgctggtcttggcattgttggttttagttgggttacttctccagctgccacagagctagaaatgatcgttcttgattgggttgctaaacttctcaacctacccgagcagtttatgtccaaaggaaatggaggtggagttatacaagggtcagctagtgaagctgttcttgttgttctgattgctgcacgcgacaaggttttaagaagcgttggcaaaaacgcgcttgagaagctcgttgtctactcctctgaccagactcattcagctttacagaaggcttgccagattgctggaatccatccagagaattgcagggtgctgacaacagactcttctacaaattacgctctgcgtccagaatcgcttcaagaagctgtttctagggatcttgaagctggattgattccattcttcttatgtgctaatgttgggaccacttcttcaaccgcagttgatccattagctgcactggggaagattgctaatagcaatggaatttggtttcacgtggatgcagcatatgctggaagtgcctgtatatgtccagagtatcggcaatacattgacggtgtagaaactgcagactcttttaacatgaatgctcacaaatggttcctcactaacttcgattgttcccttctttgggtaaaggatcaagattctcttacattagctctttcaacaaatccagagtttctcaaaaacaaggcctctcaggcaaacttggttgttgattacaaagattggcaaatccctctcggacgaagattcagatcattgaaactatggatggttttaaggctctatggatctgagaccttgaagagctatataagaaaccatatcaaactggctaaagaattcgaacaacttgtctctcaagatcctaacttcgagattgtcacacctcggatctttgctcttgtctgtttccgcctcgtgcctgtgaaagacgaagaaaagaagtgtaataaccgaaaccgtgaactcctagacgcagtgaactcttcagggaaactcttcatgtcgcacactgctttatcggggaaaatcgtactacgttgcgcaataggagcgccattgacggaggagaagcacgttaaggaggcgtggaagattattcaggaagaagcatcttacttgcttcacaagtaaatatgataaaacagtaaaagaataaaacggtttttgccaacaaaacgaagcacttcggtttggtttggtttaatttgataatataataataaaacagaaaattgcttaagtaagacttatcaacttcggtttgatttcggtacactttagtaaggtgatctttcttgtgtgtattttatcctctattttttttttttaccaattgtgtgtattttatctatttggtttgggtttattttgtggttaattaatgtaagcaatgataataaaatgttctatttta

SEQ ID NO: 4 - DNA, 2543 bp, Arabidopsis thaliana
acaaagaaaagactcaaacccattttcctaaaaccctcgtcgtccatacaaagccatggcgaggtttccgacttctccggcgcctaacctcctcttgagactcttctcgtcgaacaaacgggcgtcatctcctactgccgcgcttttaaccggagattttcatctgattcgtcatttctccgccggaaccgctgctcgtgcggtcaaggatgagaaggagccatggtggaaagaatccatggacaagcttcgcaacatcgggatctcagctcatatagactctggaaagactacgttgactgagcgtgttctgttctataccggtcggatccatgagatccatgaagtcagaggtagagatggcgtcggcgctaaaatggactctatggacttggagcgagagaaaggtatcactatccagtcagccgctacttactgtacttggaaggattacaaggttaatataattgatactcctggtcacgttgacttcaccattgaagtggagagggctttacgtgtactagacggtgcgattctagtcctatgcagtgtgggtggtgtacagagtcagtctattacggtagataggcaaatgaggagatatgaagtcccgagagttgcgtttattaacaagcttgatagaatgggagcagatccatggaaagtcttgaaccaagcaagagctaagcttcgacatcatagtgcagctgtgcaagtgcccattggtctagaagaaaatttccagggtcttatagaccttattcatgtgaaagcttatttctttcatggatcaagcggtgagaatgttgtggctggtgatattcctgctgatatggagggtttggttggggataagaggagagaattgatagagacagtctctgaagttgatgatgtactcgccgagaaatttctgaatgatgaacctgtatctgctgctgagcttgaggaagctattcgtagagctaccatagcacaaaagtttgttcctgtatttatgggtagtgcattcaaaaacaagggagtacaacctctactagatggtgttgtcagttttctcccttctccaaatgaagtcaataactatgctcttgaccagaataataatgaagagagggtaaccttgactggatctccagatggacctcttgtggcgctggctttcaaattagaggagggtcgttttggtcaattgacatatttgagagtttacgaaggtgtgattaagaaaggtgattttatcataaatgtcaacactgggaagagaattaaggttccacgcttggtccgtatgcattcgaatgatatggaggatattcaagaggcacacgctggacaaattgtagctgtgtttggtattgagtgtgcatcaggtgatacatttacggatggatcagtcaagtacacaatgacatcgatgaacgttcctgaacctgttatgtccttagctgttcaaccagtttcaaaagattctggaggacagttctcgaaagcattgaatcgattccagaaagaggatcctactttccgtgtgggtttggatcccgagagtggccagacgattatttctggtatgggggaattgcatttggacatctatgttgaacgcatgcgaagagaatataaggttgatgcgactgtgggcaaaccccgtgtcaattttagggagactattactcagcgggcagagtttgattatttacataagaagcaaagtggaggagcaggtcaatacggtagagttacagggtacgtggaaccgctaccaccaggctctaaagagaagtttgaatttgaaaacatgattgttggacaagcaattccgtctggttttattccagcaattgagaaaggtttcaaagaagctgcaaactcgggctcactaattggtcaccctgtagagaatcttagaatagtattgacagatggagcttcacacgcggtagattccagtgaacttgcgtttaaaatggctgcaatatacgcattcagactgtgttatacagcagctagaccggtgattctagaacctgttatgctggtcgagttgaaagtaccaacagagtttcagggcactgttgctggtgacatcaacaagaggaaaggtataatcgttggaaacgatcaagagggtgatgattcagtaatcactgctaatgtgcctttgaacaacatgtttggctactccacttctctccggtccatgacacaaggaaaaggagaattcacgatggaatacaaagaacattctgctgtgtccaatgaagtccaggctcagctcgtcaatgcttatagcgccagcaaagctactgaataagcaaacccttcaatccaatatattatggtttgttttctcataatgttgacataatttatttatacggttcacacaaccatcaaaatcactcaacataaactgcctaatgggctatgtcagaaaatcacttatgtttattgggccattaggtaggtcacattttttggtatccaccagtcccaatcattttgataatggtaaaccagcatatatctttcttctt

SEQ ID NO: 5 - DNA, 1551 bp, Arabidopsis thaliana
aactaaccaaacataactgcagtctcttcttgtttcgatggaactcaataaggatcagacagtcatgtcggaggataaaaagcctcaagatccaaatcccagatttgcttgcgaaggttgcagcgttctgctcgacatcaacgatggtgaccgtctcgtcttcgctcgtttatctagtggcgctatattaaaaattgggaataagaattattctttaaagccattgatcggagctccgtttggatctctgttccaagtcgaaaccggagaagatggttctttcctctctcgcattcttcccattaaacaagaaagtaacagtaataatgttatggacgattcgagagataatcgagaaatcgtcgacaataatgaagctcagaatcttactggtgaagaaattgaagctatgcggagagagggtgcaaaaggggatgaaattattgaagctctaattgcaaacagcaaaacttttgataagaagtttcagttgtctcaggaaaaatataagcttaaaaagcagaagaaatatgcaccaaagctgcttcttcgacggccttttgctcgaagtatatgtgaagcttatttcaagaaatacccagccagaattggattcttacgagtagatgcgttatctcttctgttaacgatggctaatgtcactgcatactcggatgtgcttgtggtggatatggttggtggccttgtcactggtgcagtggctgaaagattaggaggcactggttatgtttgcaatacatataagggaagttctccttatcctgtggagatggtaaggatgttcaactttagtgacaaggttttaaagaggatcgtgcagtcatcgataaacgagctctcgtcagccaaaactgcgtctactgaaggaaacaatcaacaagaaggagtttgcaaagctgagaacaatattaatgaaacagctacatctgatgttatggttgaagaaatatctgtgacaactgaggctggagtagtagatattgttgtaccagagagcaaaattatcaaagccgcaaaagctggagccaaagcttcaaaagaaacaatagagatgtggcaagaaaacggtttttcgagtctaatcatggctgcgcaagaccaagacccatggatcgtagctaaggatgtattgccactactgtcctactctgctccttttgcaatatatcatcagtatttacagccgctggcgacatgtatgcacaagcttcaacagggtaaaatggcgatcaatctgcaaataacagaaccatggctacgcgaatatcaggtgcttccttcaagatctcaccctcacatgcagatgagttcttttggaggctatgttctgagtggcatcagaatctctaccacttgactgttgttttcataaccagaaactgtggtttgatgtttggtcttttctttcacaacgtctttctggttgttttgttgttgtaacattaagggcttagattatgagaacactgaaaataattgaaaattttgacggatatttgaagttaatactagcatttaccttctaatttt

SEQ ID NO: 6 - DNA, 932 bp, Arabidopsis thaliana
gaaaaacaaatcaacaattggtttattcgtatctttctcatttctctctagtctatatcgctctcagaatacaattggaaaaaagaacaagggaagagaacacaaaaagaaatggttagagaagaggagaaatcgagatggtggtggttcgagagccacaagagctccaaacattctcaatggcttcaatcaacactcgctgagattgatgcaaagacaaaggcaatgttgaagttgttagacggaaacgcagactctttcgctcagcgtgctgagacttactacaagaaacgtcctgagcttatcagctttgtcgaagacttttatcgagctcaccgttccttagccgtgaacttcgaccacctcaagtcttccgaccactatggatctcgctccgctaaggttccccaacaatccatggagtccgttagtgacagcaattctcactttgaagatgccgattctgagattgaagacccccttcaagatgatgcctccgcagctgattgcaaagaagatgagacttggcaattggaacaagaaaggttgaagctgatcgaagagactgatgctctgaggaaacagctcttagacaaggacgaagagaagagagaggtcatcagacagctttctctaacccttgagaccctcaaagacgagaacttgagcctcaagagacgccttgcccaccattctctcaagcaacgcaccgttttggagttcaagccactaaacaagttctttgggaagctgttttacattatgtgcgatggcaacaaggtcctttaggttggctcatctacctcatgagcttagcttcgatattttctgtggttcatttcactgtttatcaagatatatcctgtcctttccgtgctgtattataaccggtaattatcctacttaataatgcatgctgttctgatttgttc

SEQ ID NO: 7 - DNA, 1169 bp, Arabidopsis thaliana
atagtgaatgattcagattcacatttcttttcttttattccttcctctcaccatcacacctccaaatttgctctataaatacacatttcccctcccttaccttctcttatattttccattggtatttcaaacttttaactactatatcacaacaaagtctctaaattgtggtgaaaaaagatcattgaacaacaacaatgagctattctcgtcaaagcatgggttctggtagtagaagtacaaggggctatgagtttgggaggacttatgttgtgaggcctaaaggaaagcaccaagctactattgtttggttgcacggtcttggagacaatggctccagctcgtctcagctattggaaagcctacctcttccaaacatcaaatggatttgtccaactgctccttcgcgtcctgtttcgcttctcggtggatttccttgcactgcctggtttgacgtgggagaaatttctgaggatcttcatgatgatatagaaggcttagatgcttcagctgcacatattgctaacctattatctgctgagccaacagatgtcaaagttgggataggaggtttcagtatgggtgcagcaatagctctctactccacgacgtgctacgctcttggacgttatggaaccggacatgcttatactataaacctacgagctactgtaggacttagcggttggcttcctggttggaggagcttaaggagcaaaatagaaagttcgaatgaggttgcaaggcgcgctgcatcgataccgatcttacttgcacatggaacttcggacgatgtagttccttatagatttggagaaaaatctgctcattcacttgccatggctggattccgacaaactatgttcaaaccatatgaagggcttggtcactatacggttcctaaagaaatggatgaggtggttcactggctcgtctcaaggcttggtctcgagggttcgcgttaaactttacaagcatcttctcagcatctctatagctattatacgatggtgtagaatatttatattatatatataaggggtggggggtttcttggggtatacggtgttctctcatgtttctactgttttgtgatttattcatgcttttctactgttcgattcttgattatgaataataaaataaataaataaggctcgttgggcttc

SEQ ID NO: 8 - DNA, 1809 bp, Arabidopsis thaliana
agtctcgaggatgctaatggaatctttcgagcatctatggtgactgagtagttggtggtggtttcggacacaaatcttggaacacaagcttgatccgaccagcttatgattattctgtctttattcttagagcctcttgatccacactgactaatctcgtgtcagtgggttctggtggagtactccgatcccatcgccagaaaattcaacagaggatgcttgcttgcttcataggttctcatgtcgatactgtgttgtgttcctgtacttgaatgtgtgtactgcttgggttgtacccattggttgtggaagaaatgtttatactcagcaggtcacgagagtgagaattggggattagctacatctgatgagtttgagcctatccctaggatctgccgcttgatcttagccgtctatgaggagaatcttcatgaccctatgtgggcacctcctgatggttatgggattgatccaaatcatgttattctgaagaaagactatgaccagactgagggtcgtgtgacgccttacatgatctacttggatcatgagaatggtgatgtggtcttggctattagagggctgaatttagctaaggagtgtgattatgctgttcttcttgataacaaacttgggcagactaagtttgatggaggttatgtacataacgggttgttaaaggcggccatgtgggtttttgaagaggagcatgtggttctaagggaattactcgaggcaaacccgagctattccttgacgtttgttggacattcgttaggagcaggggttgtttctttgcttgtcttattcgtgattcagaaccgggttaggttggggaacattgagagaaagaggattagatgctttgctattgctcctccaagatgtatgtctctccatctagcagtgacatatgcagatgtcatcaactctgttgttctacaggatgatttcttacctcggactaccacagctctggagaatgtcttcaagtcaattatctgcttgccatgcttgttgtgtctcacatgtttgaaagatacattcacattcgaggagaggaagctcaaagatgcaaggcgtctatatgctcctggtaggttataccatatcgtcgtgcgcaagcccttgagattaggaagatatccacctgttgtgagaacagctgtcccagttgatgggagatttgagcagattgttctctcctgtaatgcaacagcggatcatgccatcatctggattgaaagggaatcacagagagctctcgatttaatggtggaagaggaccaagttatgcagattccggtggagcagaaaattgtacgccagaaatcaattgttgaggatcatgacgaagaatacagagcggctataatgaaagcagcttctctgaacatccccatgtctccatcgccgtcttatggaacattccatgatacagaagaaggagaaagctctgcaggatcaggcatggaaggatccccttccgggtggtccttcaaaggaatgagaagaaaatgggatcaattcatagattgccattttcctgtaaatgacaacagtgaacatatgatcttcaaaaatcaggaatctcaagctttgttgtgtggtcaagaaacatgaaaatcttgttataggtgtaaatgtagaaaataggatatagaatcagagaagcaaagtagatgaaattcattattgagagatttaagaatttctttgttgttatagctctttttgtgtgtaacacagcctgtaatgttgctagcaatttcttctgaaatatcaatggacataccacttatattgttc

SEQ ID NO: 9 - DNA, 1240 bp, Arabidopsis thaliana
ttattatttattatagtttccgtacgaaattaaacttccttaaaaaaaacctagtttccttgtgcttcttcttcatggatcatcaacaaagctccgattcacctatgcatgaatccacaacttcttcttcttcttcttcatggagtttcggcaatctaatcaaaaccctatcgacaaaatccgaatctgtaatcggatcctaccgtcgcgatttggtcgaattcggatccgaattgaagaaagaaacctcaataatccgacgagtagcttcaagattacctgattctctcgaaattggcgcctccgtcgcttcggaatctctcgaatcggtaggtcaagttatcgacgatatcggcgccaccgtgtggaaatcaacggctaagattatttctcgtggtaaggaatctttagaaccgaatcgtgaccgtacaaatcaggttttgtcgttgaaaccttatcgtcgttttgagatgatgttacttgcgttacaatctgataaaggcacgtttgttagagaacctgatgatttaagtgattttgagaattggagtttagggttgaagttagaggagaaaaggaatgagattgttgagttgattaatgggaacaaaggtgttaaagagatctatgaggagattgttcctgttgaagttgatgctgagactttttggagaaggtattattataaagtttataagcttgagcaagtagaggaagctagggttaagcttgtgaagagagctatttctggtgaagaagatgaggatttaagctgggatcttgatgatgagaaggagaaggtagagagcagagatgtttcgtctaaggatagtgattattcggtgatttcgacacagccatcgttacttggtagtgaagatcttgggtgggataagatggaagaagatatcagaagcaatgaggagagattggattggcgaagacgggccggtgtagcggtggaggaagaagaggatttatcttgggatattgaagatgaagatgatgactctgttcaacaatagatagagtatacttgtgttacagaaaaggcaaagatttagtgtgatcatagttattaagtgtgatctatacctatacaacaattcttcgatttgtatagtactctgctttggtaaatttaatccaatatgtttaaattacattagatatgctgcaattcaaaagacaatgcagttctaggaaaaattaatttaagttcttaatctttttctctgta

SEQ ID NO: 10 - DNA, 553 bp, Arabidopsis thaliana
aacgcatacctttttttttatctcaccgtcttttatttcgtcttcctcatctttctcgtctctgaacctcttctctaagaacgaagaagaaaattgacaagtgcaaaaatggcgacggattgcaatagagtcaacgatttcttgttttctcagcagcaagagtctacttctggtgcaaataaatacggaggacttgtgccaaagaaaaagcctctcatctctaaggattccaaacgtgctttctttgattcagcagattgggctttactcaagcaagaagcaagtatagatcagagaacaatagcggcaatagaaaaactaagacccaaattgcagagaacgcctcgcaagcaactttctcctaggagacccacatgtgcgacgggaaatgagaatctgacagagtcgagcttttagggtacaatgaaaagggtttgacgtggaaatggaacgtgattggtttggtagcctactcacgtgtttcatgtttccattaaaaaacttgtatgcagttattgacagttgttcggttattttcactaattggttccta

SEQ ID NO: 11 - DNA, 2810 bp, Arabidopsis thaliana
acatgaaattagaaaaccagaaaaactgagccacaatgatgatacgatgatgatcctaaccgttggcgaggaatgagagactttgttattgtctttggctcctcctccgccataaccaatcctcaccatcaccaccgtcgctgttacgccacagcaccagagtccaaccggaaaactaaatccaattcttctttcaccaagctacttccgtcactaccgcagcaacattcaccttctcctgcttcagtctccgcgactcattctctctctagccacttctccaatgtcgtaagatggattccagatggctcgcttgagtattacgctgattttgcctcgaagctagctgaggatggtcgaattgaggacgtcgctctcatcgccgagactttggctgcagagtccggagctaatgtggctcgtttcgcttccatggttgattatgatctcttatcgaaagggatttcgtcgaatcttcgacaaggtaagattgagagcgtcgtttacactttgaagagaattgagaaggtaggaattgctccattggaccttgtcgatgattcgtctgtgaaattaatgaggaaacagtttcgagcaatggctaactctgtgcaagtggagaaagctattgatctaatggagatacttgccggtctcggattcaaaatcaaagagttggtggatccttttgatgttgtaaagagttgtgttgacatttccaatcctcaattagctattagatacgcatgtcttttgccgcatacagagttattgctttgtagaattattcatggtttcggaaagaaaggagatatggtctctgttatgacagcatatgaagcctgcaaacagattttggatactcctaacatgtatatatgccgaacgatgatagatgtttgtggcctgtgtggtgattacgttaaatcgaggtacatatatgaggatcttctcaaagaaaacattaagccaaatatttatgttattaacagtctaatgaatgttaattcccatgatcttgggtacacactaaaagtatacaagaatatgcagatacttgatgttacagctgacatgacatcctacaacatactactgaaaacatgttgcctggctggacgggttgatcttgcccaggatatatacaaagaagcaaaacgaatggaatcttccggattgttgaagttggacgcctttacatattgtactattataaaggtttttgcagatgcaaagatgtggaaatgggcactcaaagtcaaagatgatatgaaatctgttggtgtaaccccaaatactcatacatggtcatcattaatcagtgcatgtgccaatgcaggtttagtagagcaggcaaatcacctatttgaagaaatgcttgcatctggctgcgagcctaattctcaatgtttcaacatcctactgcatgcttgcgttgaagcttgccagtatgacagagcttttcgtctttttcaatcttggaaaggaagctccgttaatgaatccttatatgcagatgacatagttagtaaaggtcgcacttccagcccaaatatattgaaaaataatggtcctgggtctttggtgaatcgcaattctaattcaccttatatccaagcttcaaagagattttgcttcaagccaacaactgctacatataatatactcttgaaagcctgtggtactgattactatcgaggaaaagaattgatggatgagatgaagagcctaggtctttcacctaatcaaataacatggtcgactttgattgatatgtgtggaggttcaggcgatgtagaaggtgctgtacggattttgagaactatgcattcggctggaaccagacctgatgttgttgcatacacaacagcaatcaagatttgtgcggaaaataaatgtttgaagttggcattttctttgtttgaggagatgaggagatatcagattaagccaaactgggtgacatataatacacttcttaaagcacgaagcaaatatggttctttacttgaagtgcggcaatgcttggctatatatcaggacatgcgaaatgcagggtacaaacctaacgatcactttctcaaggaacttattgaggagtggtgcgaaggagtcatacaggaaaacggtcagagccaagataaaataagcgaccaagaaggagataacgcagggagacctgtaagcctactcattgaaaaagtagctacacacatgcaagagagaacagctggaaaccttgcaattgaccttcaaggacttaccaagattgaggctcgacttgttgttctagcagttttgcgaatgatcaaggaagactatatgcgaggtgacgttgtaatagatgatgtgttgattatcataggaaccgatgaagcaaataccgtttcaggaaagcaagagattactgtgcaagaagcgctagtgaagcttctacgagatgaattgtctcttgtggttcttcctgctggacaaagaaatatcatacaggatgcacactgtgtagatgatgcagaccaagagaacactaagtcatttgttagtatatcctcaacgaggagacctgcgattctggagaggttgatggttacaaaggcgtctctgtatcagtggttgcagcgcagaaagtagctgcctccgactgttacattactaatcagtcatcattgtattttatgctaattcaaaccatatgcagaaaagaatggggaaagattgcatatcatctcaatgcccatcatattgtatacaatcttctaaataaacaaaagagttgtcttctaaataatcatctgacagctatctttcca

SEQ ID NO: 12 - DNA, 2189 bp, Arabidopsis thaliana
gttcttaaaaagtcatcttcttttttttttttcttcatacatctctctctctctcaaccctaaaaccactcgtcacgcgccacgaactctacaccacattccccactactagtgaccatccacctctccgtctatggcgtcagacgccgttaagtatatgccaatccacggcggaggaacaacagcaacaaccgccgccgacatcaagagcttcttctccgctctaaaacccaaaaaaacctcaactttcgcttacgctttcgtcataacctttgtctcattcactctcttctttgcttttagtccttctccaaactcatcttctccttggttctctaacatcttcacttcctcctccacaaccacaacttcagacaacacttccggatctcagttctcttcaattttctcatatattcttcccaatgtcacttcaaccaaacccaccaatagatccagtgacgccacagattctctctctgttaacgccacttctccacctctcaattcgaattccaaaaacggaactttacaaacaccggcgccggaaactcacactccggttgctaaaaacacaacctttgagtctccgatcgtaaacggaaccaacccagatgcaaagaacaacacttcatctcatcctctgctttcagacaaatcttcaacgacgggatcgaataatcagtcacggaccaccgccgatactgaaaccgtgaatagaaaccaaacaacatctccggcgccgtcgaaagcacccgtgtcggtagatctgaagaccaattccagttccaattcatcaactgcttcgtctacaccgaaaaagcagactaaaaccgttgatttggtttcgtcggtgaagcaagagatcgagaaatggagtgaatctttgaagaattgtgagttcttcgacggtgaatggatcaaagatgattcgtatccgctttataaacctggttcgtgtaatcttatcgatgaacagttcaattgtattaccaacggaagaccagacaaagatttccagaaattgaagtggaaacctaagaaatgtagtttaccaaggttaaatggagctatattgttggagatgcttagaggaagaagacttgtctttgtgggtgattcactaaataggaacatgtgggaatctctggtttgtattctcaaaggatcagtgaaagatgagactaaagtctatgaggctagaggaagacatcatttccgtggggaggctgagtactcattcgtcttccaagattataactgcacggtggagttctttgtttcacccttcttggttcaagagtgggaaattgtagacaagaaaggaacaaagaaggagactttaaggttggatttggttgggaagtcctctgagcagtacaaaggagctgatgttattgtctttaataccggacattggtggactcatgagaaaacatccaaaggggaggattattatcaagaaggaagtaatgtttatcatgaactcgctgttcttgaagcttttcgtaaagctttgactacatggggtcgatgggttgagaagaatgtgaatccggcaaagtccctcgttttctttcggggctattccgcatcccatttcagtggtgggcaatggaactcaggaggagcatgcgatagcgaaacagaaccgatcaagaacgatacatacctaaccccgtacccgtctaaaatgaaagtgcttgagaaagtgttaagaggtatgaaaacacctgtcacttatctaaacatcacgagattaacggactacaggaaggacggtcacccgtcagtataccggaaacagagcttatcggaaaaagagaaaaagtcgccattgctgtaccaagactgcagccattggtgcctccccggggttccagactcttggaatgaaatcctctacgctgagctgatcgtcaaactcaatcagctcagccaaacacaacgaaaaacttaaggttcttccacccccaatacttgtttgatctcaacacttttactttctattttgatggtaattgttgattatagaatgtgtagagtaaaaaagaaagatggaatataatggatcactcgatatctttgttactattggtttgtaaatgcttttgtcacgacgaatacaatatttagctccaaagagaggttacatattcatatttcttataatggaattgattccactt

SEQ ID NO: 13 - DNA, 558 bp, Arabidopsis thaliana
gggggttgggtttcttctcccttcctacatcctctctcttctctttctctacactttcatctaatggccggcctgagatggagagagtggtggaacacgatggccttccccacccggcgtatctggaatcgtttcaccgttcgcgtcgggtttcgacacagcggacttttgaggttagaacatgacgtgagttcttgcgagtatgaagacatacacataatgtggaatttgttacacaagaatgaagatcttacacgcgtaccaatccaacaacaacaacaacagaggaagaaaccttgttggaatcttcttggttcgtatctttgccaaagattctgatccgttttatgatataaaccaaaccattgttgtatttgagagagccttgacgggtcccttgcagtgtggtgtggttttattgacaaatttcgcaaataatgaatccgaggttgcagagttttaaattagctgttatatattccattgcatacctctatgtacttatcatcacatgagtgttgtatatatattacaaaatgctttacatagtttgatact

SEQ ID NO: 14 - DNA, 901 bp, Arabidopsis thaliana
aattttcaacttctctctttcaagtttcaacaaacaatatcaatggcgaattcagagtcctcctcctcaccagtaaacgaagaagagaacagccagagaatctcaacactccatcaccaaaccatgccttccgatttaactcaagacgaattcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaaccggaacaacaacaacaacaactcttctcaggttaggtaatgatgaaatttgggggaaagaaaaatgtttctaaattgggggagttttaatttttattttgatttgtaaaacgttttttttcttctcttgaattgtaatttccttgtttgattttatggttatgttttattttttaaaaaaaatcagtctcctggataattggaatggtcgagataggttaaatttaataaca

SEQ ID NO: 15 - DNA, 1543 bp, Arabidopsis thaliana
aaataaatataactcccgtatttgattctttcttcaagatatcaatcaagatcaagagtaagacagagacacaaaggcgagagctatgtcgtcgtcggtggatttcgtgacggaacaggggagatgcggcgacgatggtaacggcgccggagagacagtaaagaatggcgaaattgatcatttgctttccgaaccgtcggctccgactatttctctccctacggaatctttcctcagagcagcgacgttactcaagaaccaggttgtggaggccacgtggaaaggtggtgtcgaagctcttgcctctggttcgggtccagtgctggatccgactgtgtacacaggactactcggcacagcgttcacctgcttgaagtcgtacgaggtaacgcggaaccatcaagatctgctaacttgcgcagagataatcgacacgtgtgccaacgttgcgcgtgccacaaccaggcacgtgacatttttatgtggaagaggaggagtttgtacgcttggtgcaattgtagccaattacagaggggaccaatcaaagcgtgacttcttcctcggtctttttcttgagcttgcagaagagagagagttaccagcaggaccagaggaaggaggatttgggatgtcatatgaccttctctatggaagagcgggtttcctttgggctgctctgttcctaaaccgatatctcggccaaggaactgttcctgaccatctcttatcacccattgttgcagccatcttagccggtgggcgagttggagctgcagatcatgaagcttgtcctctgttatacaggtttcacggaacgcgattttggggtgctgcgaatggattagctggaatcttgtatgtattgctgcattttccactatcggaagaggatgttaaagatgttcaagggacattgaggtatatgatgagtaataggtttccgaacagcggaaactacccgtgcagcgaagggaatccgagggataagctagtccaatgggctcatggagcaaccggcatggccattactttggctaaagcatctcaggtgtttcccaaggaaagggatttccgcgaagcagccattgaagcaggagaagtagtgtggaagagtggcttggtgaagaaggtaggtttagctgatggagttgctggtaatgcctacgctttcttatccctttatcgcttaaccggagatgttgtatatgaagagagagcaaaagcgtttgcgagttacttgtgccgtgatgcgatagagctcgtgaatatgacaagccaagaaacagaacatgattattcgctattccggggactagctggaccagtatgcctctggttcgatcttgtgtcgccggtagattctaagtttcctggttatgagatataatttaaaaccaggtaaccgtaggttcttttatgactatctctttgtgaaaggatcttaggttctccggtttattccactttctataatctattgaagtaacttgagatttgggagaaacattcatagaaaacaagaataaaagtaacatgaaaagat

SEQ ID NO: 16 - DNA, 745 bp, Brassica juncea
agttacaattttctgtgttctttctgaagatgacaacaatagcaggaggatcatttggagctaccagctctcgtatctctatagtcaccccaactctttcatcctcttctttgtttccaccactaacattgcatcagtcaggtaataaaaaggatagtcagttgcgctgtgccgtgcaagagtcttccacttctgctgttgctactgagaagaaagaaaaagaagactcaacagttgaagttccagcaaagaaaccaaaaccggcagctgcgaaggcagccgtggcaaaacctctgagagaaatgatggaagaagacgtgattcctcccctaaaagccattcttgaagctcaagatgatatatctgagattgatttatctttccaagacgataagctcgaggggtttttcttcaagaaaggtattcagtattccttctgggccttcttccccacaggaaacctcacaggagcaaagggcttttcaatctcctcgtacgggtcaggtccaagcacagtggagccatttctagtcgacgagaggaaaccaacagcaaaccacgttgtgttttgggtcgagaaacgccttgctgcacaagggattattcccgtttggaaccaataatgtaaccgagatgttgttttttttattcacttgtttataagaaaacaattacatttgtataccaaaactgaagaaaatcaaagtccttcgtatctctcaatatgtattaattaagaaacact

SEQ ID NO: 17 - DNA, 808 bp, Brassica juncea
aaatcaccctccctctctctctctcctcctctgcaatggcgtctcttcagcaaactatgctctctctgcaatccaaacttcctccatcatccttccacatcgggggatctcttcccatgcgaaagacagccttaccgctccgaaccagaggcggaaacgccgcgggagcgagaatgtcagccacggcggcgggaagctacgcgatggctctcgcggacgtggcgaagaggaacgacacactggaactgacgagcgcagacgtcgagaagctcgagaaggtcttctccgatccgcaggtgctcaacttcttcgcgaatccaaccgtcgagctcgagaagaagcgtctcgtgatcgacgagatcgtgaaatcgtccgctctccagagccacacctccaacttcctcaacatcttggtcgacgcgaatcgtatcaacatagtgagggacatcgtgaaggagttcgagatggtgtacaacaagataacggacacgcagctggcggaggttagatcggtggtgaagctggagccgccgcagcttgctcagatcgccaaacaggttcagaagctgaccggggcgaagaacgtgagggtgaagacggtgcttgatccgagccttgtcgctgggtttacgattaggtacggtgactctgggtcgaagcttattgatatgagtgtgaagaagcagcttgaggatatcgctgctcagctagaactcggcgagattcagttagctgcatgagaaaattgtattgacaaccgcttctttttttacttgtgcaagttaattctttctctcttcttttctcc

SEQ ID NO: 18 - DNA, 1312 bp, Brassica juncea
atgcacagaagaagaagtgaaagagacaaatgaataagacgatgtacagagagacttcaccggccggagatcacaattgagtttattagtctcggagtacctcaacgaagcaacaatggagcttccgttgctctcttacacgaactcagcctcgttttctcggacaggcttatgctcttcgtcttcgtcctcctcctcgactagtattaatgacttcctagagagaagaaggagcttgagaatgagtttcaacggtggtgaaacgtcaagaagcgttaaaacgttcgctggacgaagcagtgaagggatagagaaaacagacggcggcgtaggaggaggaggacagttcgccggtcctgccatggaggtcactacatttgatcgtggctttgctaactccaccactgttgatttcccgatttgggacaagatcggcgccgttgatagacttacttacggaatcgggatatatggagcgatggctgtagcaggaagattcatatgttcagtgactgggattgactcatctggtgggtttgatccttctcttgatgcacttttagccggacttggatatgctacaccacctatcatggctcttctcttcatactcgatgatgaagttgtgaaactttctccgcacgcaagggctattagagatgtggaagatgaggagctaagaagctttttcttcggaatgtctccatggcagtttatacttattgtcgcggccagttcagtaggagaagagctcttttatcgtgttgctgtacagggtgctctgtccgatatgttcttgagaggaacacaactgatgacagattctagaggcatggcatctctgaccggcgtatttcctccgtttgtaccatttgctcaagcatttgcagctgtgatcaccgcaacactcacaggctctctctactttcttgctgcttctccaaaagacccgatatacattgttgccccagtcctaagatcacgccgcgatgattttaagaagcttttgtcagcttggtacgagaagagacagatgaagaagatttactctcccctcctggagggactcttagctttctacctcggtattgaatgggttcagacggataacattttagcaccgatgatgacgcatggtatatactcgacggttatattagggcatgggctgtggaaaatacatgatcaccgtagaaggttacgtcggaggatcgaacggcttagatcggagaccgctgatgaatgaacggttttaaaatcatctatagattgtaactggttgtggggtggatttgtgtgtttttttttttca

SEQ ID NO: 19 - DNA, 1727 bp, Brassica juncea
acaggcgccgcgactcgggcccccacacgtgtggtctagagctagcctaggctcgagaagcttgtcgacgaattcagattcgactggagcacgaggacactgacatggactgaaggagtagaaaacatctttctcgttaagtcctaggggaagcaagaagcatcatccaaaacatggaagaagtaacgtccacactactctttatcgttctaattactctcatcttcttcatcggaagaaacagaaccaagctaaagctcaaacttcctcctagtccacctttcgcgcttcctatcatcggtcacctccgcttactcaagccacctctccatcgtgttttccttgccctgtctcaatccctaggcggtgctcccatcttctccctccgtctcggcaaccgcctcgtgttcgttgtctcttcacactcaatcgcagaggaatgtttcacgaagaacgacgtcgtactagcgaaccggccacacaccgtcgcttccaaacacgtctcatacgactacacaaccatggtcacagctccgtacggcgaacactggagaaacctccgccgcatcggcgccgtcgaaatattctcggctcaccggctcagtaaatttctgtctatccgacaggacgaggtccggcggcttatagctcgtcttgcacggaactcttcacacgagtttgtcaaggtggagataaactcaatgttttctgacttaacattcaacaatatcatgcgaatggtggccggaaaacgttactacggagatgcttcagaggaaaactcggaggccaaactcgtaaggaagcttatcgcggacctgatgagtacttttggtgcaggaaatgtggctgattatgtacctgtcctgcgttgggtcacgggtttcgagaaacgggttaaagaactcgctggtaggtttgatgagttcttgcaaggattggttgatgaaagacgagcagctaaggagaaagggaacacgatgatcgatcacttgctttctctgcaagaaacgcaacctgagtactacactgaccgcaccattaaaggaaccatactctcttcgattttggcggggactgatacatcagcggtaacattagaatgggcattgtcgagtctgctaaaccatccagaggaattgagcaaggcgagagaagaaatcgacagtaaagttggtttcaacaggcttgtagaggaatcagacatctccagccttccctgtcttcagaacattgtgtcagaaacatttcgtctataccctgcgggacctttgatggtgcctcacgtcgcatcggaagactgtaaagtaggagggtatgatatgccacaaggcacaacattattggtgaatctgtgggctatgcacagagatcctcagctatgggatgatcccgagactttcaagccagagaggttcgagaaagaaggggaggctcataagctaatgacgttcgggttaggaagaagggcgtgtcctggatcaggactagcgcaacggctggtgagcttgactctggcgtcattaattcaatgttttgaatgggagaggattggagaagaaggggtggatatgactgaagctggaggagtcacaatgcataaagctaagcctctggtagccatgtgtagagcacgtacctttgttggtaaaatccttcaccagaacgcttgataaatgtatgttttattttttgataattctcgttttgttggagatcggaagagc

SEQ ID NO: 20 - DNA, 2825 bp, Brassica rapa
aagcgaagtagaagcgaaaagaaaaaaatgttttgtaaagagtcgtcgtcgggtctccagaccctgagcatagcaaagagcctcagctctccgttccataaaccatcaccactcatcaaccccatttggacaggacgtcgagacaagctgtgtcgtccccgaaacctcggtggacgatgtaaggtcacggcatcacagtcaaatagtgaaccgaaaggtaacataatgaaagaaaaagttaaaaaaatcaaagtaaagggatatatacaggccgaagaagggacggtgctggagggcctacgttggtcgagaggtctcgatgacatttcagatattgccggcagatcactgctcgttgagcttatttccgccgagactgacaaccggacgctgatggagaaggatccggtagaagactatgcacaacgtgtatggttcgatggcgaatcccctgatgagaagtacgagtgcgagtttaacatgcctgaagactttggaaccgtgggagctataaggatacaaaaccagcaccatcgagacatattcatcaaggagagggagcttgagttacccagcgggtccgttacgttttcatgccactcatgggtggcccccaagtccgttgacccagccaagaggatattcttctccagcaagtcctacataccttccgcaaccccagagccccttaagaagctgcggaaggaggagctggagaccttgcaaggcaacaaccgcaagaaggttggtgaattcgagaaacacgaacgcgtttatgactatgacgtgtacaacgatgtgggtgaccctgacaaaaatgacgaactcgcccgtcctgtcattggaggcctctctcatccgtacccgagacggtgcaagactggtcgcaaatccagcaaaaaagacccctccacggagaaacgcgaaggggacttctatgtccctagagacgaggagttctccacaaccaagggaacggcattcacaggcaaggccatcttggcagctcttccatccgtgttcacacagctcgagtctattctgctggatcccaaatctcccttcccacacttcaagtcaatagaagatctctttgacgttggcatcaatcttcccaaggatgctggccttttacctatgctccccaaacttattaaagttctttctgaagctcaagatgatcttctccagtttgatccccctattcttcttaacaaggatagattttcatggatccgagacgacgaatttgctcgccagacacttgcaggccttaacccctattgcattcagctagttacggagtggccgttgcaaagcaaactagaccctgcggtttatggtgatcccaactcactcattacttgggaaattgtggaaaaggaaattagaggagtcatgtcagttgatgaggctctaaagaataagagattgttcatgttggattatcacgacttgctactaccgtatgtgaacaaagtgagggagttggatgacaccatgttatatgcttctcgaacactattcttcctcagcgatgatagcacactaagacctgttgccattgagttgactcgtcccccagatgtcaacaggccccaatggaagcaggtcttcacgccaggttatgatgctacctcctgctggctatggaaacttgctaagactcacgttgttgctcatgacgccggttatcatcagcttatttcccactggctgaggactcattgctgtatggagccatacataatagcggcaaacagacaattaagtgccatgcatcctatctataggcttttgcatccccacttccgctacaccatggagatcaaagcaagtgcacgccaaagtctcgtcaacgcaggtggaatcattgagacttgtttctggccaggcaagtattccttagagctaagttcagatgtctatggtaaactatggaggttcgacaaggaaggtttacctgcagacctcatcaacagggggctggctgtggaagatgagaaggcggaacatggggtgcgactgacgataccagactacccattcgcgaatgacggtctaatgctgtgggatgcactaaaggaatggatcacagactatgtgaatcactattatccagatgcaggactgatcacgtcggatgaggaactccaagcatggtggagtgaagtgaagaacatagggcatggagacaaaaaagacgaaccatggtggcctgagctcaaaacacaagatgacttgattggcgtggcgactacgattgcgtgggtggcttcaggtcaccatgcagctgtaaactttggacagtacgggtacggagggtacttccccaaccgaccaaccacaacaaggagaagaatgccagtggaagagcctacagaggaagagctaaaagagttctacgaggagccagagaaggtgttgctgaagacattcccgtcgcagaagcaggcgacgcaagtgatggtgactctggatctactatcgacccattcaccagacgaagagtacttgggagaagagccagaagcatcttggatcgatgaacctgtcatctttgctgcatatgaacgattcaagggcaggctccaatatctagaaggagtgatagatgagaggaacgtgaatgtttctctaaagaacagagctggcgcaggtgttgtcaagtacgagcttttgaagcccatctctgagcccggttgtaccggaatgggtgttccctacagtgtctctatctaatgcatctgaacatgtatttacttgctaaaatcattgatcaagtggtcagcaataaaaaataaaacaagtgaatttccttcggg

SEQ ID NO: 21 - DNA, 1647 bp, Brachypodium distachyon
gagaaacccatctccccttcctcatcctccgcgctccgccacgacgatgctcgccaccgcctccccgcacctccaagcggcggcgcgccgcctctcgctggcagcgctccccgcgcgcctgccccgctccgtgcgcctcccgcgcagcagcacgcggcaccccatccgccacgcgtcgctgcgcgcgtcgtcgtcggcggcggaggctaccccgtcggcgaaggacggggctgctggcgccgaggagctagggttcgaggagatgctgtccaggacgacgcggaggtactacatgctcggcgggaagggcggcgtcgggaagacgagctgcgcggcgtcgctcgccgtgcgcttcgccaacagcggccaccccaccctcgtcgtctccaccgaccccgcacactccctcagcgattcctttgcgcaggatttgactggcggggcgctcgcgcctgttgaaggcaccgattcgccactgtttgcgctcgagataaatcctgagaagtcccgtgaggagtttcggacactaaatcaaaagaatggaggaacgggggtaaaagatttcatggacggcatgggcctagggattcttgctgagcagcttggggaattaaaactgggggagttattggacacgccgccaccaggattggatgaagcaatagcaatttcaaaggttatacaatttctcgaagcaccggagtatagcatgtttagccgcattgtatttgacactgctcctacgggccatacgcttcggttattatccttaccagacttcttggatgcatccattgggaaaatcttgaagcttaggaacaagattgcttctgcaacatcagctattaaatcagtctttggacaagaagttcaacagcaggatgcagcaaacaaattggagcaactcagagaaaggatggtgaaggtgcgggagctctttcgtgacactgaatcgactgaatttataatcgttacaattccaacggtcatggcaatcagtgaatcctcaagattacattcttccttgcaaaaggaaagtgttcctgtaaggagactggttgttaaccaagttcttccaccttcgtcatcagactgtaaattttgtgctataaaaagaaaggatcaaacacgtgctttggatatgataaggagtgacccagagttgatggggttgaacataatgcaagcacctcttgtggacatggaaattagaggtgttcctgctctcaagtttctgggtgatatagtgtggaagtgaccttagtttagggaaaataggataactccaggcacctactggctagattatcactgttggcctgctatgctgttaaacctttaatccaatcgaagtgtcagcctgagcagatcttgagagctactgggtggaatgcaacttagcagattcccatactagtaaatagcaccaaataggacggttttgctgctctagcatatttgatttcatatacttaacagtaagcaaggactggttgggttgcaacagcatcatgccaatgcagtctgaattccatgatgtttcttgttaggagcagccagctgtggattttcggatcctcagcattgtaaaaacatgttttcccactcgcgacatgtaaattttgttgagatgtggtatgattttgc

SEQ ID NO: 22 - DNA, 812 bp, Brachypodium distachyon
ggacaaaaaccgcaaaatagcggtgtccctgtccaatttccccttattcttctcccagaaccccaagagtagcaagcaaaggaagccaagctagggtttgttcctcctcatcgatcccgcatccggaatccagacttgactcctcagctcactcaacaaggcaatggcggacaacggcggcgctcgcaggcaggcgaccttcaccaagatcgacgagctccggccctccacccacggccacaatctcatcgtcaaagtgctcaactccaagcccatcaccttccagaggccgcagcccaggcagatgagggtcgccgagtgcctcgtcggggacgaaaccggcgtcgtcgtcttcaccgcaaggaacgaacaagtggacgtaatgaagtcgggggcaattgttgaggtgaggaatgcaaaggtggacatgtacaaggggtcgatgcgcctggcggtggacaagtggggcatcgtgaaggctgcggaaagcccgtcggagctgacggtgaaggaggataacaacctgtctttgatcgagtttgagatgattaccctgatggtgtaatagtttttgtgtaggggaggagtcagcagcagaagcaattcgtgtcgagcaaagcaataagccaatcattttcatgtttggatgtttttcttttctgtttgtttctgtaccagaggttggatagttttgttatcttaaatggatagtgttttatgttaaatggataattgttattactataatccgtgtgaggatctgaaccagcgagtctaatgttagcttgtgttggatggacatgttattgttc

SEQ ID NO: 23 - DNA, 1387 bp, Brachypodium distachyon
tcctaagcttacccatggccctttctcgttgacatcatcgcttcaacaactactcctgctgctccggatcgatgccattgccatgccgccaacaactccggcccggccccaaccgtcaacgacttcggcagctcgggagcacaaagaaaagaaaaaagggctacgcgccttcgacacgacctctcgttaaaggctccaacttgtgttttttgtttgtcaaacacaagtacacaaactcttttcgcgtcccctgttcccttctgatcatatcatactctggctcagctccccaccgaccccgccgtccccgccacgccacctctcccccacccggcggcgaccagtccgccatcgcccccatgccgctcccgacgatgacccactcctcctccttcctcctcccgtccccgcccgccgaagccgccgccgccgccgacgcggtcgcctacgccgtcatcgtcctcaaccagcgcctcccccgcttcgcctccctgctctggacccgcgcgcagctgagggtgtgcgcggacgggggcgcgaaccggctgttcgacggcatgccggagctgcaccccggcgaggaccccgacgaggtccgcgcgaggtacaagcccgatgcaatcaaaggagatatggactctataagaccagaagtgaaggaattctattccaatttgggcgccaaaatagttgacgaatcacatgatcaggacaccactgacttgcacaaatgcatatcgttcatcaccagaaatccacctggccccgacaaggctaatctgtgcattcttgtccttggtgcacttggtggaaggttcgatcacgagatggggaacatcaatgtattatatcgcttctcaaacatcaagatcatcctcctgtcagacgagtccttgatctttctgctcccaaagacacacaatcatgagatccttgtcgatcaatcgatcgagggtcctcattgtggattgatccccatgggcatgccctcaagcagcagcaccaccactgggctacggtggaatttagataataccagcatgagttatggtgggctggtaagcacatcaaacatcgtggatgacaagaaagtaatggtgacttcagattctgatcttatctggacaatatcacttcgaaaccacacttaaattgtagtatatttgttccatcatggaccgtgctctaaattttggctcgtcaaatttgcgtcgatggattttacatttttaacccctctgtgatgatatcatcttcgactccactttccaattgataccagtaaacccgatccacgaatccattccacattgccaaaatgaggcatatatgttgtatggtttgagaaagttcattagttctttgcacatttatgtactacactttc

SEQ ID NO: 24 - DNA, 2043 bp, Brachypodium distachyon
gccaatcacaaaccacgcctccgcctctttcttcctcgtctccccactcttcgccccgcgactcgcagcctcccacgccgcttctcttctgcggccttgtagaaccttcctttgggttagggttccggctctgacggcggtgaagatgtctactcatgcgggggccgtggcgcgggagcagcgtaggtgaggcgtcgtcgcgcgtgctggattggaggaagagagcacggatggatccggacttctcgagggccagcggaggcccgagctacgaattcgccttcaactcggtcaacttctccgaccgggtcctgcggatcgagatcgtcgccggggacgacacagcgggggccaaaggtgccaccggcgagggatgctcgtccatcgccgactgggcacggcaccgcaagcgccgcagggaggagctacggcgagagaaagaatctggaaagcatatgttggacctaacaaacgtcaaagtcaaagcagaagaacctgatacctatgaggaaatcaacgaggagcctgtagctatgattgaagaatctccacctgatattggacaagatggtgaggatggaggaagcagtgactcatcctggaatatggagtgtaatagtgttttaagagtaaaatctatttatatcagctctgcaattctagctgcaaaaagtccttttttttacaagcttttttcaaatggcatgaaagaatctgatcagaggcacgcaacccttagaataactgcttcagaggaaaatgcccttatggagcttttaagctttatgtacagtggaaagttgacgacaaatcagccaacccttctgcttgacatcttgatgatttctgacaaatttgaagttgtttcttgcatgagacactgcagtcagttgctaagaagcttgcctatgaccacagaatctgcacttctctatcttgatctgccttccagcatttcaatggctgcagcagttcagccactcactgatgctgccaaggaattcctctccaacaagtacaaggatttaaccaagtttcaggatgaagccatgaacatcccccttgctgggatcgaagccattctgtggagtaatgaccttcaggtggcatcagaggatgcaatttatgactttgtgatcaaatgggctcgcgctcaatacccaaaattggaggaaaggcgtgaaatcttgggtacccgcttgctgccacttgttcggttctgtcatatgacctgcaggaagttgcggaaggtccttgcatgcaatgatctggatcatgagcaagcaactaaaagtgtgaccgatgcacttctgtacaaagctgatgcaccacatagacagcgcacgcttgctgcagatgtgttgacctgtaggaaatattgtgaacgagcttataaataccgtccacttaaggtggtggagtttgatcgaccatatccgcagtgcatagcgtacttggatctgaagcgtgaggagtgtacacggcttttcccgtctgggcggatatattcacaagcatttcatcttgctggacagggattcttcctctcagcacactgcaacatggatcagcaaagcgctttccactgctttggtctcttcttagggatgcaagagaaaggctcaacgagtgttaccgtggactatgagtttgctgcaaggacaaggccatcaggcgagttcgtcagcaagtacaaaggctactataccttcaccggtggaaaggcagttggttaccgaaatctatttgccatcccatggccatcatttatggctgatgacagcctctttttcatcaatggagtactgcacctgagagcagagttgaccataaagcaaccctaggtaatgcgtggtgtgctactaacttcgcatgtatgcttgctcatctccgaatttgtgcaatgatggggcttagggttgaatcttctgttgttcaaagcttgacgatgtctttacttgagcaccaaactgaacattttttaaacgagaaggaaaatcccttttgtttttacatcaaaagaggactgtctgttgtgcatta

SEQ ID NO: 25 - DNA, 2074 bp, Brachypodium distachyon
acctcgatgggccactgggccgagcccaccgcaattggccggatccctttacccccacgcagctccatggccagcggtgacccgttcgccgccgccggggacgtcaccggcgactcatcctcctccagtccaaccaccgcgcgtctgctggaagcactcgccgctctctcccaagtgttcgagtccggcgatcctgcctcctccggcgcagccaccgccgccgttgtagaaatattcggcggaagcgccgatgccgacgcgggaggcgatgccgcgcggcccgacacggctaacatggtctcagagcagctgctccgcgaggttcacgcgttcctctcgtgcccgtcctcgaaccagatggccatagacgccctctctctagagcttccgaaacctgtggcgaagttgggtgctaggatggggaattgccgggacattgccaagactatcattgagctcctcgtgtcaaattgcaacccaagagacatgctctccatcctctgtgaggcattagatacaccactagcatttaatgggtcagcatacttcgtccttatacttgatatgcttgcgagagtgcttattatgattcagaggagacatatcgagcaagtaaaggttgtacttcctgctgtccttcgagttatgcatgctattatatcagagtgtgatgaggaacatggaacaactgcggttgatctgttcaatgcagcactccaaatcggcaatgccattcaagaaatgtgcaaaacaatggttaaccacaagaaagaagagctatgtttgatacttggtctatactcccttcagaacatagcccttatatcagaaagcaaacatcagcatattctctctgcttgtggttcacttgttcttcagcatttcaaaattgttacattttgtggattcacctatttgggtcttttaactggtaatgaggtgacctcagccaccaacaaactctctaaagaagaagatgctgattttctgggctgcttctctttcaccgtggaaggcgcaagtcttctagctgtctggacctatatgcatgatgacatgtcaaaatatgctggggcagagttggaatctgcaattaaggaagttcaggacaactatatcaggaaatgggaagcaattaacatgtttagatatgtcttgtcctcagttaattacccatgggtaatcaaatcttatagtatagacttattgttgactctagttgatgaaaattgtattgaggaaaccaaggatcatgaagatttcctatattctactcaattttttgccacactcaaggccattgaaagcgtcatgatagctgccccagatccattgatgcggaagaaagcttttgctactttgaaaaaggttatttccgtggtgccatcctctcagagatttgatatcttacagtccctcataaagaatagtatgtttccctccttgactgcaattcacttggatctggtgaaaaacgaagttgtgagagagagtagtcgagctaaggacttgattgaatctgatcaatcacaagatgctggggattcaccacattgggcttctcaatcgcttgaattagtggagctgatcttgaggcctcctgaaggtggtcctccttgtcttcctgatcacagtgaacaggtattatctgctctgaaccttctcagattgatcctgataatagattcaagaggatccagatcactaaaactgttccgacaagagacgacacgaaaagtgtactcagagtggttgatcccactaagaccagttgttgcaggggttcagtcggaaatggagaaggacgacagcgagggtgcaaatcagatgatgtgcatgttaaatcctgttcaactggtgcttcaccgctgcattgagttggtggaggaaaagatgaaaggttcctaatgttttgaggtttcgctcatgttggtagtgttgagtcaatgagttgtgcaggaaatgatgtgttcaatcagcaggattcagaattgaacattactatcctgaattggatatggcatatagccgtccttctctgttattttatgctgaattgctgacccattgcttg

SEQ ID NO: 26 - DNA, 747 bp, Brassica napus
aaggttgagagagtgaagcgaaagtgtgctaatggcttcttcagacgtagctcttctctcttctaggattcaatttcgttcatcctcgtccatccgttatgctcttccaacaatcttcaatctctcttcaccagctgcgagttcgtgcgcaaccaaatcgacccagtttcttaaacggcgtttgagagccaaatcgacgaacttttctctttcttcgttgcctcggagacggttcgtatgcagagctgcggagtacaagttcccggatccaatacccgaattcgccgaagctgagactaagaagttcagggaccatatggcaaagaaactatcaaagagggatctttttgaagactctgttgatgagattgtcggagtctgcactgagatcttcgagacgttcttgcggagcgagtatggaggacctggaacactcttggtcgtacccttcatcgacatggctgatactctcaatgaacgggaactgcctggaggtccacaagccgctcgtgcagctatcaaatgggctcaggatcatgtagacaaagattggaaggaatggaccggcactgattagtagcacctgaacctcaaatcatcaaaatatagttcagtactcatgtattgtctttgtaaaactgaattttgcagatttcagaattttattagttctcttcttatataaaatccttggtctcatcatttgtttcccaaggtgatcagtgtgtggttgagtagattcttccg

SEQ ID NO: 27 - DNA, 1233 bp, Brassica napus
ctctctctctctggaactctcatcatcttatcatctcccgtaacaaaaccaaaatgttcctcttaaagacatggagatcaaccgctttcgggatttatggctatatgaatttcaccaagaatggtttcctagaccattcaaagaagttcaaacctgaagatatgcagatacaaatccaaggaaagaactgtgtggtcactggagctaactctggtattggttacgccgctgctgaaggtcttgcttcacgtggagcaactgtttacatggtgtgtcggaacaaggaaagaggagaagaggctctttctaagattcaaaactctacaggaaaccagaatgtctaccttgaagtttgtgatttgtcttctgttaatgatataaagtcatttgcttcgagttttgcttcaaaggatgttccggttcatgtgctggttaataacgccggtttgcttgagaacaaacgaacgactacacctgaaggattcgagttgaacttcgcggtgaatgtacttgggacatacacaatgacagagctgatgcttccactgttggagaaagcgtcgcctgactccaaagtcatcacggtctcctctggtggaatgtacacgtcgccacttacaacagatcttcagtttagtggtgaaaagttcgatggagtgttacaatatgcacggaataaaagaatccaggtggctctgacagaaaaatgggctgacaagcacaagaacaaaggcataggtttctactcaatgcaccctggctgggctgagacacctggtgtcgccaggagtttgcccagtttcaaagaatcgttctctggtaagcttagaacgagcgaagaaggagcagacacagttgtttggctagcacttcagcctaaagagaagctggtctctggtgcattctatttcgatagagcagaagcaccaaaacatctgacgcttgcaggtacaagcaagtctcatgaccttatagactctgtcattgacacactgcattccatggcagctcttgatccttaaaaactatatcttctacatgggttttttctcgagaataaatgtgatcgatctctggtaaatatcacaatggaataagattcaaatattaaactttcctattctttccttggaaagtattattgtgctggatgattacatagtatcagaacataagaaatacacatggtttttaacattggcagagtagccatgttatggatctcatcatgac

SEQ ID NO: 28 - DNA, 2192 bp, Brassica napus
aaaaaaagccaaacacatccatcaaacaaacaccaccacatggctgcgcgtacactccactcgctatccacctcccctttgtttctccttcttcttctctccgccttgtctccaccgaccaaagctcagcaaccgtacgtcaacaaccaccagctagcctgtgagaaccgtgacttcgacaacataaccaacggcttcacctgtaacggcccacgctcatgccgctcctacctcactttctggtctctcccaccgtacaacactcccaactccatcgccacactcctcaacgcctccgccgccgagatccagtccatcaacaacctcacctccctaaccaccgtaatccccacccgtcgactcgtcgtcatcccgaccacctgctcctgctccggcggcggtggcttttaccagcacaacgctacttacaggctctccggcgaaagacaggagacttacttctccatagccaacgacacctaccaagctctgtccacgtgtcaagccatgatgtcgcagaacccttacggcgagaggaacctaaccgccgggctaaacctcctcgtccctctccgctgcgcttgccccaccgcgaaccaaaccgccgcggggttcagataccttcttacctacttggtcgcgcagggagacagcgtctccgccatggccgagatgttcagaagctcaacaccagccgggagctccggcaacgagctcacgtccgacaacatctacttcttcactccgcttctcgttcctctcaggacggaacctacaagaatcgtgattactccgccgtcgccgacgccgccggttgctactccgccgcagtcgccgccggtggatcctccgggggggtcttcttcttcacacaaatggatttacatcggagttggaatcggagccggtttgctcctcttgatctcaatcttatctctctacttctgttactacaaacgaagatccaaaacgtcgtcgttgatagaacagaacaagcttacggactcgtcgaccaaacagtctcttccgacaacgtcaacaaaccaatggtcgatcgccttatcaaactcctcagacacaacatcaggtctcaaatcagctatagagtcgttaactctctacagattcagcgatcttcagtcagcgacttcgaacttcagcgaggaaaacaagatcaaaggctcggtgtataaggcaacgatcaacggagatgacgcggcggtgaaggtgatcaaaggagacgtgtcttcctcagagatcagcctcttgaagaagctgaaccattccaacatcatccgtctctctggcttctgcatccgcgaaggagcctcgtaccttgtctacgagtactcggagaacggttcggttagcgattggcttcactcgtctaacaagaagaagagtctgacatggagacagcgagttgagatctgtcgggacatagctgaggcgttggactacttgcacaactacgtgacaccgcctcatatccacaagaacttggaatccaacaacgtgcttcttgactccaacttcaaagccaagatttcgaatttcggcgtagcgaggattcttgatgaaggtgatctcgatcttcagttgacaagacatgttgaaggaacacaaggctacttagctccggagtacgtcgagaacggagtcataactccgaagctggacgtgtttgcctttggagttgtggttcttgagcttctttcggggaaagaagcggtgacgacggtggataaggaggagaaggaagagatgttgttgtgtagagagataaacaatgtgcttggaggagagaatgtgagagagaagctgaaggagtttatggattcatctctaggggatgagtatcctttggagctggctttcaccatggctcagcttgctaagagctgtgtggcacctgatattaactcgcgaccgtctattgctcaggttctaaccacgctcttgatgatcgtctcgtcatctattgattgggagccttctcatgacctccttcatgattcgggatctcttggcaactagttattctatttttttttgttttgtttgtcaataattgagtatttagattttagattttgtgtaatatataagataaggaccatatggctataaaatctacgagcaaaataattaccacagtgttcaacaaaagcaatgagaagatttgaatgttt

SEQ ID NO: 29 - DNA, 2747 bp, Brassica napus
cgctcaatctatctcatcacgcttcgtttatcgcaatccacttcgtctttcgaagctcacctccacattaatcaaataacaccatggcttaccgtttccctctacattcatcatctccacactctcgattcctctctccctcaaaccacccaaaaaccccgagatcccccagaaaacaccacacctcaatctcatgccaaaacacaaacgatcctcaagacgaagaaaaatccaaaatcaatctcctcgcaataccaatcacactcactctaatctccgcctcactaccccaaccctccctcgccgccgcaacgaagaagagaagccagaagaagaagcctcaagaagccttaacacccgaacagctcaaatcctggtccaaagacctccccgtagtctccaaacgcatcccctacacagaccttttaaccctaaagtcccaaggcaagctcaaacacgtcatcaagcctccatccttaaccctgcgcctaaaagcagagcccgtgctagtcgtcttagaagactcccacgtgctgaggaccgtgctgccgtcaatagacggtaacaaacggttttgggaacaatgggacgagttaaagctcgattcagtttgtgtaaacgcttactctcctcccgttaagaagccacctgtcccatctccttacttagggttcctatggagagtcccgtcttacatgctgacgctggccaagcccaagaaggagtctaaacgggccgcggagctgaaacggatgagagaggatttcaagaggcagaggaaggaggagatggagaggatgaacgaggagagcgaggcgatggagaaggcgatcaaggcgcagaagaagatgcaagagaggaagaagaggaaggcggttaggaagaagaagtacgaagagtctttactcgaggcgaggaggaactaccgcgacatgggccttatgtgggccagactggccgaggattcgaacgtcgcgactgctctcggactggtcttcttctacatcttctaccgcgtggttgtgctcaactacaggaagcagaagaaggattacgacgataggttgaagatcgagaaggcggaggcggaggagaggaagaagatgagggagttggagagggagatggaagggattgagttggatgatgaggaggaggagagtggcgagaagaatccttacctgcagatggcgaagcagttcatgaagtcaggggcgcgcgtgaggagagcgtcgtcgaataggaggatgcctgagtatcttgagaggggtgtggatgtgaagtttacggatgttgcggggcttgggaagattcgtcttgagttggaggagattgttaagtttttcactcatggagagatgtataggaggagaggtgtcaagatcccaggtggtattctattatgtgggccacctggggtggggaagacgttactggcgaaagctgtggctggtgaagctggagtgaacttcttctctatatctgcttctcagtttgttgagatatacgttggtgttggtgcgtctcgtgtacgagcgttgtatcaggaagctagagacaatgctccatctgtggttttcattgatgagttggatgctgttggaagagagcgtgggttgataaagggatctggaggacaagaaagggatgccactcttaatcagctccttgtttctttagatggttttgaaggaagaggagaggtgataaccatcgcgtccacaaatagaccagacattctagatcctgcgcttgtgaggcctggaaggttcgaccgcaaaatcttcattcctaagcctggtcttatcggacgtatggagattctgcaggttcatgctcgtaagaagccgatggctgaagatttggactatatggcagttgctagcatgacagacggcatggttggagcagagcttgctaatatcgttgaaatcgcggctatcaatatgatgcgtgatggaagaactgagttaacaacagatgatttgcttcaagctgcacaaatagaagagagaggaatgttagacagaaaagataggagctctgagacgtggagacaagttgctataaacgaagctgctatggctgttgtggcagtgaactttcctgatctcaagaatatcgaatttctgacaatcaaccctagagctggtagagaattgggttatgtccgtgtgaagatggaccacatcaaattcaaagaaggcatgcttagccgacaatccctgttggatcacataactgttcagctagcacctcgtgctgcagatgaactatggtacggtgaggatcagttaagtaccatatgggctgaaacatcggataacgcaaggtcagctgctagatcactggttcttggtggtctctctgagaaacatcatggcttgaataacttctggatggctgatcgaatcaacgatattgatgtggaggcattgcggatattgaacatgtgttacgaccgtgctaaagagattctccaaaagaaccggacgctcatggacgaggtggtagataaactggttcagaagaaaagtctttcgaaacaagagttcttcactcttgttgagctctatggctctattaaaccaatgccaccaagcattcttgaactcaggaaaatcaaacggctccagctccaagaggccgtgatgaaacaggacatgactagtgcaaggaacagttgataagatgatttgtggcaaacgtagaccttgttgtaatcttagtggcatgtgaacgagctt

SEQ ID NO: 30 - DNA, 913 bp, Brassica napus
actcttcacagtttaactgaacaaactagtaatggctatcgcacgtctaactctagctcctctcctcctcatcgccgccgtgattctctcaacggagacatcagctcagccggcagcacccgctccaggccctgctggtcctataaacctcacggcaatcctcgaaaaaggcggtcaattcactaccttcatccatcttttgaaaatcactcaagttggggaacaagtgaacattcaagtcaacagttcatccgaaggcatgaccgtgttcgcgccaacggacaatgctttccaaaacctcaaggccggaactctaaacaagttgagcgcagacgaacaagtcaaactcattctctaccacgttagccctaaattctacactttggacgatctcctctccgtaagtaacccggttaggactcaagcttccggccgtgacaacggtgtttacggtcttaacttcaccggtgaagctaaccaagtcaatgtctcaacgggttacgtggagacacgtgtcagcaacgcgttgagatcacaacgtcctctcgcggtatatgttgtggacatggttttgttgcctggtgagatgttcggagagcacaagctttccccgattgctcctgccccgaaatctccgaccactggggtttccgatgatgacaccaagtctaactcaagtaaaaaggctgcagcgccggcagataagtcagcatctggtgagaggagagttggacttgggtttggttttggacttgttgtcttatgtttgaagtttctcttttgaatattgtgatcgttgccttgtatttgtttctgattattccacccggttgggattatgaaatttgttcattttatttccgttgtaaattgtaaatgagagattattaatttacagttcgttggggagacg

SEQ ID NO: 31 - DNA, 1136 bp, Brassica napus
cgactcctatagggaaagctcggtaccacgcatgctgcagacgcgttacgtatcggatccagaattcgtgattggacactgacatggactgaaggagtagaaaaagacagaaagaaagaaagaaagaaagagagaaagagagaaagagagagagagagcatcatttgaagttggtagtccaatggcggcagcaaaggcaggtctagtcccgtggattatcccatcatcctcggcggcgacttcttctccgctgttttcagctgctgttaagttgcccctgagagggaggaaagcagagaaggatgtatctgtctctgtcgccttcaatccttctggcaatttcgacatctcagccttcgactctcacgacgatacagataaagtggaacctccgatgcctccaacgagcggcagatacgaagtagtcatagacaacgactcaattcagcggcttgacttatcgccctttcagaccgccaccggcattacctcgccttcctcagctgatccaagagagtatctggatcggagcatcggattcacgatcaattacaggagagaagacgcaggggatccgcgtgagctttcggagtatccggacataaggctgtggttcgtgaggctggatgccacgtacccttggcttcctctccttctagactggagagccggagagcttgctcgttacgccgccatgctggtccctcaccagatgagcttgagaatgggtgttgttttcaatcccgaggccttggagctgttcgtcatgagcaaagtgtttgtcgtttatccatggctcaaacgtcacgctgtccccaagccccggctcaagacctccgacatggccaggatgctcggcttcggtatcggcgaccagctcttcgacttgatcgatcaatacgatcattatcaaacaaccaccgattctctttaggcccttgtttcctccctcccctttaactgtgtgcttcatctctcagaaaaaaataataattatgtaagaaccattctctagcagagatttaaatttaaaatctgtaaaagaagagagtaaaattctactacctagacgttaacttgagctacaagaaacgtcttggcggcagcgagtctctcaacaaacacatccttttgga

SEQ ID NO: 32 - DNA, 1442 bp, Brassica napus
aacgagagacttgttttagctaaattccaaaaaagaaacagaaaacaaataagatcttaattctccttccgagtttgctttcttcaatatggctcctctacccatttcttcgattagagctgggaaaatagatgatgttcaagaattaataaaatcaaaaccaaacaaagttccagagaggttcataagagaagccaatgagagaggtgtcttagtgtctcataagactcaccttcatcatcatattcctgttgttgatctctctaaactgtcgaaacctcacactgatgatgattttctctttgagattcttaagctctcacaagcttgtgaagactggggatttttccaggttataaatcatgggattgaagtgggtgtggtggaagatatagagaaggtggcgaaggagttcttcgagatgccactggaggagaagaagaagtatccaatggagccagggaccgtacaaggttacggtcaagctttcatcttctctgaagatcagaagcttgattggtgcaacatgtttgctcttggtgttcatcctccttctattcgtaaccccaaactatggccttctaaaccggcccggttcagtgaaaatcttgaaggttactcaaaagagataaggaaattatgcaagaggttgttgaagtacatagcaataagcttggatctaaaggaagagagatttgaagaaatgtttggggaagcagtgcaagcagtaaggatgaactattacccaccatgttcacgtcctgatcttgtcatgggactcagcccacattctgatggaagtgctctcactgttcttcaacagagcaagaacagctgtgttgggcttcagatcctcaaggacaacacttgggtccctgtactacctcttccaaatgcccttgtcatcaacattggtgatacagttgaggtgctaactaatgggaagtacaagagtgtagagcatagagcagtgacaaatagagaaagggagaggcttacaatagtgacattctatgcacccaactacgaggttaaaatagaaccaatgggtgagttggttgatgatgaaaccaacccatgcaagtatagaagctacaatcatggtgactatagttatcactatgtctccaacaagctccaaggcaagaagtcacttgattttgccaagattctcaattaactatattactttcacacccctttcaccttccattaactaccacttaatttgttttatttttaagaatttagttgtgggactcttgtgtgtatgatgtacaggaatgtttcccacttaggggttttagtgtcatgattaaattccccagtgtaactacaacttgtaatatattatgtgtgtgtgtgggtggagttgggtgtgtttatgtatccatatgtatgccgagaaggaacataaagaataagaaagaacaatatcagat

SEQ ID NO: 33 - DNA, 1328 bp, Gossypium hirsutum
ataggttgctaaatgtttgtggagtctccatgttatcttccacaatccagtaagtggccctccttctccaattcaagataacccatccctcccttctttttcactaatccaaaacactttttctttctccagtttcctcattcatttccagttctcaacacaaattttcatcacccatcaagcttttcatcaatggcttcccttcaacaagcttcaatctctcttcaacccaagcttctttcatcttctcaacaccccagatcccttccctctctcaacctctctttttcagccactttcccttccctcaaactctgcaccactcgccctcttcatggcggtgccaaaatgtcagcctccgccgcttccagctacgccaccgctttagccgatgtagccaagtccaacaacacccttgatgccaccagctccgacgttgaaaaagtcgagaaaatcttctccgacccacaagtcctcgaattcttcaccaaccccaccattgatgtcctcaaaaaacgtcaggttttggatgagattgttagctcctccgagcttcagccgcacacggcgaattttttgaacatcctggttgatgccaagaggattgatcttatcaaagaaatcgtgaaagagttcgagttggtttacaatcagctgacggatacagagctggcggtggtgagttcagtggtgaaattggagtctcaacatttggcacagattgctaaacaggtacagaagctgactggtgctaagaatgttaggattaaaactatgattgacccaagtttggtagctgggtttactatcaggtatgggagttcagggtctaaattgattgatatgagtgttaagaagcaattggaagagattgctgctcagcttgatttgggtgatattcaacttgctgtatgagttttgaattcttttttccttttttaagaattgggtttgaagcttttttggttattattgtaattgaaatgaatacttttaatgttaattgtatgaaatttgtgtatgatgagattgtttgatatgggagaaactgatagtagtttgggatatttcattaggaagggctagggggaaagttgatattttgggctaaattcttgcatcagattcaaggattctaagcctaaatctcatgaatttaaagcattcaagaagtatgaagcattcatgaatgagtcctgaaacatgggtatcaattcatttagtagagtgtgatggaactttgagatatcagtgaatttgatttatatatttagaaacatttagtagctgagacacgcaacaggtaggcaaggcacacaggggatagg

SEQ ID NO: 34 - DNA, 2959 bp, Gossypium hirsutum
ccattcattcaaaggaaacgaataacaaaaaggaaaaaaaactgtatatggttttacaaattatatataaagtaataacagaaaccaacgtgcttgttatttattgtgtttttttctccattttctagtagaagctgcctctctctcacctcttagagaacaattaaggtccttgcttgtaataatctggctattgagaggcaggcaggtctctcttatgcttgttagggattcagttttcttagttgtgaaagactctttttcactctggccgctgcaacgaagctaaaattttctcgcacctcaaagtgggtgtggggggacaacaaagagctgattctgctttgtgttttaaggagatcaagatcatcccatatctggagactgcgacgtgtttcagagggtctttcgcttgattatggctaatgtctgtgttcgctaaagcacccagaagttcgattgtaccttgtctttcttttttaacggtagtagaattaggtgctttcctcaggtttttgaaccttaatgattacagtagtttgaagctagctttctatgtaagacaaaaggtaggtctcttgtggatgtattgctaatctgtatcaccacaatggttaggttttcctgcttcaatgctcatatcggaagtcagaaaccaaagaaaactgttcagccatctgttgaagcaatgcatacaactatagaagatttttctcaagttcaagcccctaaggagttgactaaagctgcaaacatggactcattctttccagagacacaaacaactgctgagattcatgaaagtgttgaacctgttacggtttcttcttctcctaaccctagctggaaatcagaggacataaaagacggagtcattcttgatagcagttccagggtccttcagaatccgcattatcttaagaagtgtagatctctcggaagtggcctttgcctggaaggacgagttcctggacaaaatgatacagatgatcagactgatcaaggattttcatctgattcccatgaccatgggttggttgaagatggcagcaagcatatagcagtgagccaaaatgcttcattctcagaatctgttcaagtaagctctaaccatgtctataacgaaccggttttctctataggagactctctacttccagaaaaggatggccatgatatctctaatttgcctttgccttgtgagcgtgccaatgcctctggtgatcattctcccaataatgcacctgtgattgtaaaatcatgttctatgccaaatattgttgcatcagcactcctttttggaggacattctcctccaaaatgtttggcacgccgtacaagatcctctgaggatgtgcatgttctcagcatgagacaaaaggagaccttaattcatgatgttgatactgaggtgatgcgagaacaagaaagagacgatggcatgcataaaaatcataaaactaactttgaaagttcttatgagggatttgaatcttatagttgttccgcatcagcgaaagactggatagtgccagtttcagatgaggtaagttcaatgaaaatgctgcaagaagaattgcgggttctgaatcggaatgaattgactggcaaggattttaagattaagcgaattgaggattgggtaaatggtcttcaacatgtccgcccatcagaagactcagttgaattatcccatcccaatgatcaggtaaaagcagaacctgctgtctataatgatttgactgctgcaaaggtggatgttaaggtaactcctggcatggaagctgcaaaaagatatatatcttctttgagtgcctcagcaaccacagctcaactggcaaatcatggtttggttgttataccgtttcttagtgcatttgtcagcttgaaggtacttaatctatcaggaaatgcaatagcaaggattactgctggtgctcttcctcgaggacttcacatgttgaatctgtcaaggaataatatatccaccattgagggtttacgtgagcttactcgacttcgtgtgctgaatctgagctacaatcggatatttagaattggtcatggtttggcttcttgttcctctcttaaagagttatacttggctggaaacaagataagtgaggtagagggtctccatcgtctcttaaaattgactgttttggatctgcgtttcaacaaaatctctactgccaaatgtcttggccaacttgcagcaaactataattccttgcaagccattggcttggaaggtaaccctgcacagaagaatgttggagatgaaaatctgaagaagcatttgcaagggcttcttccaaatttggtttactttaaccggcaggctattaaagtcagcacagtgaaggatggtgcagaacgatcagttaggctaggcatcagtgcccatcaatttgatcgtggccttagatcagaacacagagctactaggaagaacagccatggtacttctattcaccggccatcctcttcatccactcgtggtcacaaaagccaagtggcttccccaatgcagtcaagaggcaggcatgggcgctatcctcctagtggagcgaaggcaacaaataatcgtcaaaatcatcatgtagatcttggtagcaaagttctcaactttaaatcagagctttctatgcgaaggacccaaagcgagggaactctggggcttctatgaagtagagttactttgatgagtggaatctggtttttgactatttcacattcgagttgagttggttgtcgtaactgcaataaatgtcactcaaggtatttggtgtgactagacatttttagagtagattttgccaaaatggggaaggaagtcctcatacttgtttctgttagtaagttttcttatttgtatgccggggaaaatgtggtggaaacccaataatggtttgcattctccattctccttaatggtttttggaaaaaaaaaaaaaaa

SEQ ID NO: 35 - DNA, 1306 bp, Lotus japonicus
agatgtgaagtcactaccggcctttctacacatttgaacatggcttcttcttcttttgtcacccttcttctgatctctagctttctttcattttcccacatcagagtgtctgaagcagccacagctcctattgtgaagggactatcatggaccttctacgattcaagttgccccaagcttgaatccatcatcagaaaagagctcaagaaggtcttcgacaaggatattgctcaagctgctggtttgcttcgtcttcacttccatgactgctttgttcagggttgtgatgcatcagtactattggatggatcagcaagtgggccaagtgagaaagatgcacctcccaacttgactttgagagcccaggcctttaagatcattgaagaccttcgcagtcaaattgagaagaagtgtggaagagtcgtgtcctgtgccgacatcaccgccatcgccgcacgagatgctgttttcctctcagggggaccagactatgaactccccttaggaaggagagatggattaaacttcgccacaaggaatgtcaccttggataacctcccagcaccccaaagcaacaccaccaccatcctcaactcactcgccaccaaaaacctcgacccgaccgacgtggtatccctctctggcggccacaccatcggcatcagccactgctcttccttcaccgaccgcctctacccatccaaagaccccgtcatggaccaaaccttcgaaaaaaatctcaagctcacctgccccgccagtaacacggacaacaccaccgtgctggaccttcgcagccccaacacgttcgacaacaagtactacgtcgacctcatgaaccgccagggtctcttcttctccgaccaggacttgtacactgacaagaggaccaaggacattgttaccagctttgcagtgaaccagagtttgtttttcgagaagtttgtggtggcgatgctaaagatggggcagctgaacgtgttgacagggagtcaaggggagattcgtgctaattgctctgtgaggaatgcggataagaagaagagtttcttgactactgtggtggaagaagtggtggaagagttgatagaaatgtaattaaccagtgtgttagttactatatatgtgtaggtttatgttttatggcggttaataacacaaactaccctcttgtttccctgttgcgagggtgtacgttttgaaggatgatcgggtatatgatcatcataagaaatcttttgatgtttgtaattcctcctagttgtatcacacgacaatattggaaatgaaatattttcagttttgt

SEQ ID NO: 36 - DNA, 1120 bp, Medicago truncatula
aagcagtggtatcaacgcagagtggccattacgccggggattccgcagccacacacactcatttttctctttcgcaacatcgccaccatgtccgcgatcgcacggctgagagcgatttcaccgtcgctgaaaaccctcaaccgtccattcggatctgcagctgcgcttcaatacagctacgacgacgacgaagatgaagatttgaactataacgcgccacgtggcatgcttgacacggaaggttcagccccagaacgtggtattcagtgggttatgattggtgaacctggtgctaagagacatgttttcgctgaaagactctcgaagcttctagaagttcctcacatttctatggcttcgcttcttcatcaagaacttaaccctcgttcttctctttatcagcagatagcgggtgccttggatcatggaaaaattgtacctgaggaaatcatttttgctctattatcgaagaggctggaagatggatacgatagaggtgaaactggattcattcttgatggaattcctcgaacaagaatgcaagctgaaattctcaatcacgttgctcatgttgatctagtggtaaatttcaaatgtccgcaagaggaattaatgaaaaataaactaggacttcgaaaatttacttcgtgccaagaacatatttttaagaccagttcttggaccccaaccaagcaatcgcaggatgaatatgtccagaaacgtgcagaagagtccaagatgttggaagattactacaggaagcagaagaaacttctgaatttcgaagtagctggtggacagggagaaacctggcagggacttcttgctgcactgcatctccagcatattaatgctcttagttcttctcagaagttgactgcctgaagggcatcaatcttccatgtggcaccccatcgatcactcctcggcattataccatatgtgaatatgagagagccagtagaatttaatcgaaattttgtgatagtgttccaattattggtgattttgattttggaaattttgagtatgttaagtttgttctgtagtgaagctgtccaattaagaatcaaatacacaatgtatgagtatgaccacaaatttgtagtagtgaccgcgt

SEQ ID NO: 37 - DNA, 1263 bp, Medicago truncatula
acaccactgaactctcacacttcagttcattgtaataatttcacataaaaaatggcttcagcttccaccaccattacctcctccttcctctcaaccccttcttctctcacagagaaaccttcctcattcaaccaaaccctaagcctcggtttcaaaccaagacactccatctccgtttctgcatcagctgcaccttcaccaccaccctcctatgatctcaacgccttcaaatttgctccgatcaaggagtcaattgtggcacgtgagatgactcgtaggtacatgacggacatggtgactcatgccgataccgacgtcgtcatcgttggtgctggttctgctggtttgtcatgtgcttatgagcttagcaagaatcctaacgttaagatcgctatcattgagcaatctgtgagtcctggtggtggtgcttggctaggtggccaactcttctctgcaatggttgtgcgtaagccagcacatcatttcttggacgagcttgaaattgagtatgatgaacaggacgactatgtagtgatcaagcatgctgctctcttcacttccaccatcatgagcaagctactagcaaggccaaacgtgaagcttttcaatgctgtagctgctgaggatttgattgtgaagaatgaaagagttggtggtgttgtcactaactgggctttggtttcaatgaaccatgacactcaatcctgcatggacccaaatgttatggagtctaaagttgtggttagctcttgtggccatgatggtccttttggagccactggtgtgaagaggctcaagagtattggtttgattgataccgtgcctggaatgaaggccctcgacatgaacactgccgaggatgctattgttaggctcactagggaggttgttcctggaatgatagtaactggcatggaggttgctgagattgatggtgctccaagaatgggtccaacatttggagcaatgatgatttcaggacagaaggcagctcatttggccttgagagcactgggacttccaaatgctgtggatcatgcaggaaatattcaccctgagcttgtcctagctgctgctgattctgctgatattgcagaagcttaattattgttaccatattaactatttagttaatagtatcgaagtgctagtaaccagaaataaaactttgtctttgttgtttgttagtagtgattatgggcaggttgatgtgactctgtatgagcttttttgtcattaatatgaatgaatgtgtttgccaac

SEQ ID NO: 38 - DNA, 2115 bp, Medicago truncatula
caaggtgcagtaccaacgcagcgcacgttagcaaactctcttcaatacctatactataaaaaccgcttgtaaaatttcttcacttctctttctcctcactcctcactcctcactctacaaaaatggcggccgtaacttcctcatgctccaccgcgatctccgcctcttccaaaaccctaacaaagccaaccaccacaagcttcgccgccgctaatctctcattttcgaagctttatcctcagtcagttaaagctcgcagatgtatcgctgtcggcggtgcagtcggtgctcgtatggtgtcggctcctcctgccactcttccggcgaaacttgatttcgaaacttctattttcaagaaggagagagttaacctcgctggacacgaagagttcatcgtgaaaggtggaagggacttgtttcatttgttgcctgattctttcaaggggattaagcagattggtgtcattggatggggttcacagggacctgctcaagcacagaatctacgggactcacttgctgaagctaagtctgatattgttgttaagattggactaaggaaaggttctcgatcctttaatgaggctcgggaagctggatttactgaggagagtggaactctaggtgacatatgggaaacaatatcaggcagtgatcttgttttgttgttaatttctgactctgcacaggctgataattatgaaaaaatattttcccacatgaagccgaacagtatacttgggctgtcccatggttttcttcttgggcatttacagtctgttggacttgattttccaaaacacttcagtgtaattgccgtgtgtccaaaggggatgggtccatcagtgaggaggttgtatgtacaaggcaaagagataaatggtgctggaattaattccagttttgctgtccaccaggatgtggatggcagggctactgatgttgctttgggatggtctgttgcccttggttctcctttcacatttgccactacattagagcaggaatacaaaagtgacatctttggggagagaggcattttactcggtgctgttcatggaattgttgaatccttgtttaggaggttcactgaaaatggaatgagtgaagatctggcttataagaacactgtcgagtccattacaggagttatttctaaaaccatctcaactaagggtatgttggctgtatacaatgctttatctgaagatggaaagagggaatttgagaaagcatacagtgcttccttttatccctgcatggacattttgtatgagtgctatgaagatgtagccagtggtagtgagattcgtagtgttgttttggctggtcgtcgcttttacgagaaagagggtctgcctgcatttcccatgggcaaaattgatcagacccggatgtggaaggtcggtgaagttgttcgctctacaaggccagcaggtgatctaggtcctctatatccatttactgctggtgtctttgtggcgttgatgatggcccagattgagatcttgaggaagaaaggacattcttactctgaaatcattaatgagagtgtgatcgaatcagttgattctttgaatccattcatgcatgctcggggtgtttctttcatggttgacaactgctcaaccacagcaaggttaggttcaaggaaatgggcccccagatttgattatatcctaactcagcaggctttggtggcagtggacaatggagctcctatcaaccaggacttaatcagcaacttcatgtcagacccagtgcacggagccattgaagtttgtgctgaactgagacccacattagacatttcagtgccagcagatgcagactttgtccgtcccgagttgcgccagtctaactagaacatgaaccaattattgcctttcttgagttgatttcctttcagtaatcgctcaaagtagcagctatcgtgagtgagttttaaaatggttgagtgcttgtattgaagttttgtatgaccactttgtagtactaagatttattttacgaatgaggaatgttgtttgatgacatattagaaatgaggtaataaattatgttcacagatttttgagttgtcattttttactaactcgcattttctgtttgggc

SEQ ID NO: 39 - DNA, 1280 bp, Medicago truncatula
cctcctcttcaactcaattcgccaatcgccaccttacccttatcttcttccgatggccaccgtcctccgaactcccacattccggccatccccaacccttctcaccaccgccgccacatcttccaatcactccagaacctcacgcgtttccgtcgcatcctccagaagaagaccttcaccacttaaatcccaccggttcagttcaattcccaccctccggttcgcgaagttagtaccatttgcttttgacggagataccgaggcaccgcaagttcaagattcacctgaggttcaggttctggactctacagatggtgctgctgatgtggaggagagtacaggcgatgatgaggtcagcgacgctggtgaaatacctgcttcacctctgatagtattacttcagtcatacaaagaagcattagctaataatgattcagtcaaagttgctgagttggaatcatcattaaaatccattgatgatgagatagtaggtcttgaagggaaaatagcttccttatccgaagagttatcaatagaaaaagatcgaaaactaaggatcggtgcagattttgacaattatcggaagagaaccgatagagaccgcctttcactggtcacaaatgctcaaggggaagttgtggagagtttgttgcctgtattggataattttgagagagctaaagctcagatcaaggtggagacagagggagaggagaaaataaacaacagctatcaaagcatatataagcagttcattgaaattctaaactcacttggagttgagccagtggatacggttggaaatccctttgatccaatgctacatgaagcaattatgcgtgaggattctgatgaatttgaagatggtatcatacttcaagaattcagaaagggttttaaacttggtgaccgcctcttacgtccatcaatggtgaaggtatcagctggtccaggacctgcaaagccggaacaagaagtaccacaggaagaagaagtcaccaatgaaacttcccaggacagtaaagataatgatggcaacacagaaacagagtctgcttgaaaggacaactttgcctggattcagttttgtacaagtatatctatcggtttaatctccaggaacgtaattatgggtgttacagttgctcaagaaatattgcttccaagtttccttttaagggggaattagtattatgagattttgaattatgatttcagattttttatgcccttgcattgctttggtagagatgactaaattttctcaggtaccatgtttc

SEQ ID NO: 40 - DNA, 3253 bp, Medicago truncatula
caattcttaagccaactatttacattaaaaccgacacaaccactaactatttctcactgttccacttcttctttcatttcaccaaacgtaggaaacaaaaccttcttcataaaaattaacaaaaaaaccttagaagaaggaaaaaacctcaaagaaaccattgattcatggccctaacaaaagaattcatgggttcttcattggtagagagaccaatatttccttcttcttcaccatgttttcaacagaagaatggtagtttcttgatcagtcctgtttttgttccttatggaaacaaaagagttgtcaggttgagaaaatctgcaaagttccctgttgcagctatcagtgaagatttgatgaaaagctcttcttcatcttcttctatatcatcatcttcttcttctgttcctgctgagaaaccagtgaaatttaaggttagagctgttgtgacagtgaggaacaagatcaaagaggatttcaaagagacttttgtgaaacatcttgatgcttttactgataggattggacgaaatgttgttcttgaactttttagcactgagattgatccaaaaacaaacgctgcaaagaagaccaatgaagcagtgttgaaggattggtcaaagaagactaatattaaagctgagagagttaattacacagctgaatttacggttgattcaaattttggagaaccaggagcaattactgtgataaataatcatcaacaagagttttacttagaaaatataacaattgaaggatttgcaactggagcatttcattttccttgcaattcttgggttcaagccagaaaagatcttcctggaaagagaattttcttttctaataagccttatctacccgatgatacacctgctgggattaaacttttgagggagaaagacctgaaaaatctgagaggtgatggaaaaggagttagaaaattatctgacagaatttatgattatgacacatacaatgatcttggaaacccagatagaggaattgatcttgctagaccaactcttggcggatctgaaatgtatccataccctagacggtgtcgtactggccgtgaaccatctgatacagatattacttgtgagagtcgtgtggagaagccacttcctatgtatataccaagagatgaaagatttgaggaatcaaaaatgaacacattttcagtgaagaggctaaaaggagtgcttcataacttgcttcctggccttaaatcaagtctttctgctcaaaacaaagatttcaacgaattctcagatgttgatggcctttatagtgttggactactcattaagttaggtttgcaagatgatattttgaagaaacttccattgcctcacattgttagcaagatccaagaatccaccagccagggtatccttaagtatgacattcccaagattatatcaaaggataaatttgcttggttgagagatgatgaatttgctcgtcaagcaatagctggagttaatcctgttaccattgagagacttacagttttcccacctgttagtaaattagatcctgaaatctatggtccacaagagtctgctcttaaaaaagagcacattttaaatcaacttaatggcatgaccgtccaagaggctatagatcaaaataagttgtttataattgattatcatgatatctaccttccatttttggaaaggatcaatgccttagatggtagaaaatcatatgccacacgtaccatatactacttgacaccacttggtactctaaagcctgttgctattgaacttagcctgcctccatctggaccaaatactcgatcaaaacgtgtagttacacctgctttagatgctactactaattggatgtggatgcttgcaaaagctcatgtttgctccaatgatgctggtgtgcaccaacttgcccaccattggctacgtacacatgcttgcatggaaccatttatattgtctgctcataggcaattaagtgcaatgcatccaattttcaagttattggatccacacatgaggtacactttggagatcaatgctttagctcgacagagcttgatcaatgcagatggtgtcattgagtcttgcttcactcctggtcgatatgcaatggagattagttctgctgcttacaaaaccaactggcgttttgaccaggatagcctccctcaagatctcatccgcaggggaatggcagtacctgaccccacacaaccacatgggctaaagctaataatgaaagattacccttatgcagaagatggtcttctaatttggtcagcaatagaaaattgggttcgcacctatgtgaactattactacccaaatccaagcctaataatcaatgacagagagttacaagcttggtactccgaatcaatcaatgtaggccacgccgatatgaaagacgaatcatggtggccgagattgaacgacagtgacaatcttgtccaagtcctaacaatcttaatttggaatgcatccgcgcaacatgctgcacttaattttggacagtacccttatggaggttacgtgccaaatcgtcccccgttgatgagaagattaattccagaagagaatgaccctgaatatacaagtttcatatctgatccacaaaagtattttctcaatgcattgcctagtttgttgcaagctacaaaatatatggctgttgtggacacgctttcgactcattcgtctgacgaagagtatttaggtgagaggcaacagccttcgatttggacgggtgatgctgagattgtcgaagcattttatcaattctctgctgaaattggaaagattgagaaggtgattgatagtaggaattgtgataggaatttgaggaaccgttgcggtgccggtgttttgccttatgaattacttgctcccagttctggacctggtgttacatgcagaggggttccaaatagtgtgtccacatagaaaaaatgtcttaaataaataaatgagtcacaatatcatatcacattttgctaagcattatggttggttggtttatttatcagtagtattagtactataatcagtgactctggaacattttgtccttagatttgataaacattattactagtagacattggtggcttatatatgtagtgttgtatagactgtagatttgattaatgagttcatctgtgatttgaaccatttttcagttattgattgcaaatatctggaactaaaatttcatatgtgacgtaatcaaacctttattgcatcga

SEQ ID NO: 41 - DNA, 763 bp, Medicago truncatula
agaaaacaattttcatgttagcctgccaatctagggttagcttcattcttgtagtctaaacatctacttccaatttccgtggttcttcaaaattccaaagcaaaatcacagaaatggcgtggcgttctggatctctctcgcggtctattttctccgccgcaagatcaataccaactcgttcctctcttcaacattcttctacttcttccattcgttctcatcttcttcaacctcgccgcccccttgttactgtccctagggctttgggaattctcggttgcacgcagtcgttgatgccgttgcataacgccgatgccgctgcgcgcctcacttctcacgtttcagttgaattgcgcgcttgctgcgagctgtctcagggtacttgaattgattttacatttatcagcactggttgtgcctacatctatggttggatctaaaatggatggctaatgctgtgaagcacgaagcttgttgagaagtgttttttgtattttattattttagtcaaaattaaataagtatatctatccattcttctataaagatttaggtaacttttcaagctaattgaaggatatcgactttgttttgctttgtatcatcacataataataatgatgatgatgtccgagactaatgttgcatttaaattaagatgtatagatattgataattggcagtgtctcattatcaaatgagctgttacaaattgcaatggctttgctcttgatacaaatgcaaatgttttataattttggag

SEQ ID NO: 42 - DNA, 872 bp, Medicago truncatula
taacaacgcatagaccgaagcaaattctctcttcaccattcgattccccacccaaatcctcaaaccaaaaccctaaccctaattcttcaaatccgcaacaatggtgtgcatacgcaaagcaaccgtaaacgacctactcgcgatgcaagcgtgcaatctcttctgcttaccagagaattaccagatgaagtattatctctaccatatcctttcatggccgcagcttctttacgttgcggaagattacaacggacgtattgttgggtatgttcttgcgaagatggaagaggagacgaatgagtgtcatggtcatatcacttctcttgctgtgctcaggactcataggaagttggggattgctactaagcttatgactgctgcgcagaatgctatggaacaggtgtttggtgctgagtacgtgtcgctgcatgtcaggaagagtaaccgtgcagcttttaatttgtacacagagaccttggggtacaagattcatgatgtagaggctaagtattatgctgatggtgaggatgcttacgacatgaggaagcaactcaaggggaagacgatacatccaccacagcatcatcatcaccaccaccaccatggtggcggttgttgttctggggagacaaaggggaatgctaaagcctgattatgagagcaatatcccctcatatttttgctggtttattgaatgcctttgttgaatagtttgatattgacgagatggtaatatgttgccgaataatgctctgttacttgttgtacgcttatttagttatgttcgctattttgtcattttacaattgtggatttactatttttttttattgaatgcacccgtttgtggttcatcatgtcatgatgcttaa

SEQ ID NO: 43 - DNA, 2513 bp, Medicago truncatula
ctgaatgtatgtatgtatttttcacagcactgaagaggcttctctctctctctctctctctctctgagttgaatttgactctgcagaaaagtggaaaccctaacctaagaattacttcaaatctttcttcacagttgaagtttgtgaaattgttgaaacggaaatgcttctgatttcttagtctgttactatcggagattgagaataatgggtagacgccatggatgggaactcccttttcacacttttcaggtcgtggctattacggtttttttcttgctatgcattgcatattatgccttctttgctccttttcttggaaaggacatctttgaattcgtcgcttttggtgtttactctctactggcactttctgtattctttctatatgttcgatgcactgccattgaccccgctgatctaggagtaatgattgattgcgataaaacatccaagaatagatcaaaacttgatgaagagttggcagaacccagcaagacaaggctaaaggatgatggaatatctgatcagcatgattcaaatgggtgctcgaaacttggatgttgcctgtgtagtttccttgctagagaagattgccgtagcgatgaagattttattcttcagcaacaatctggagaggaggatgctttgttctgtactttatgcaatgctgaggttcggaagttcagtaagcattgtagaagttgtgacaaatgtgttgatggatttgatcaccattgccggtggttgaacaattgcgtcggaaggaagaactacatctcatttgtgtgcctaatggctgtgagcctggtttggcttttagttgaatgcggagtcgggattgctgtgcttgtcagatgctttgttgataagaaggatacagaaaatctgatagctgtaaagcttggagctggattctctcgagccccatttgctacaatagtggccatatgcacagcagtttctttccttgcgattatacctctgggagaattattcttttttcatatgatcctgatccgaaagggtattacaacgtacgaatatgtcgttgctatgagaactttgactgaaccacctggtccttcagttgatgcgggtgagcagcagagtctaccttcatctcctactggttcatctgtcactgcaataagcggaagaagctctgttggaatgagtttgcaaatcaaaggtgcctggtgtacacctccaagaatctttatggatcaacaggatgaaattatacatcatttggagcctggccgcttaccatctactgtggatccagatgcaatacaaccacctgacaaggggaaaaaattgaaccagcgccctgtgcgaataagcgcatggaaacttgcaaaattagattccaatgaagcagctaaggcattagctaaagctcgagcatcgtcgtctgtgcttcgtccaattagttctcgatctcatgcatatgatgtcgatcatttatcaagtagcaatttgagtggaagaagcagccctattagtaaccgaggatttcataacaaatatgatcaagcagggacatcaaggttatctccttccaagagttcataccctcccagtcaagcaagcagggaagatttagatgcgtgccaccacagtatgagtaacttgagcagtccacaagtgtccaacatatctccttcgccaatgcagaggccaggtttgaacagagaccatttcaaccccatgtatcagcaaccatctataaatcagtctccttcatcagttagaggaagtgaagggagtgtaaatccagttcatgaaaatggtgcacgtgtggcaatgaggaataacagcttagctgttttagaggatagaaggtcgtcagtgttttgggatcaagcagctggtcgctttgtcccgaacccatctagagctcaaggcagttctcagattcctggaacagagttaacatacagcggccgttctatattttttggcagtcctgctgtgagtgaacagtcaaatgcaggaacaagaaatagtagctcagtagctggtgtttcggacagagataatactataagggattttcagcaaggtagatcacatagaggtgcccagcttcctgtgttcgttcccagttattcccagcaaaacaagttctcttagggtatgtttcaattgatggtatcttggaatggaatgtgataacatctaaatagtagaatgttagcccattccattctactccttttcaccattaattgcaattttttcttctctaggaacatgttatctagcgctttttaatgtatgtcttcttgccatcgcgtggtttagtatgttcatcattccatctgtacagtctaatggatcacaacctttctctgtactaattcattgaccactatcattggattcgagtaattgaagtttgaatttgatcaaaggatgttttgattctcgtttggaatcccgaaactacataattgtgaaattggattctctccagctgtaagtgtattaagaaattaggatggggg

SEQ ID NO: 44 - DNA, 1265 bp, Medicago truncatula
ccacagttcttgtcttcctatattgcgtgtgtctgggtgtggataaaaatggcagccactcatgggaaaataatcttgttcatgtttcttgcagcctttatgttgtttaatacccaaaatgcattcgtgagttgtgctttaacatcagagttacaaaacaaaattgctaaaatcaacgaagagggtccttatttgggtttaatcataccaaattcttttgaacttaaccctcttcttcaaaatccaggctatactcctagtgatagcatcatagattttgcaggaaggagatttcgttttggatccattggcgagaaaccagttatactggtaatgacgggattgagcgtgataaacgcagctataacaacacagcttctattaagctttttcaaagtagatggagttgttcattacggaattgctggaaatgcaaacccttcattgcatattggagatgttgctattccacattattgggctcatttagcactttggagctggcagaggtatgggcaagatgctgatgatacgttaccactagaaatcaatggtgactacacaagggacgtaggtttcttgaaattttcagattttacctcaaacataagtgctgctaacagttttacagttaacaatcatctcaacaatctttggtaccaaccagaagagatttttccagttgatggcattcctgaacaaaggcaacatgctctttgggtccctgttgattccaagtactaccgtattgccaaaaaactagagcaaatgaagctggaggcgtgtatagactcagacacatgcttgacaacgacaccaaaggttgtgcttgtggagagaggaacaagtgcagggttctatctagacaatgcagcatacagaaccttcatcttcaataagtttaacgtgagtccagtggacatggaaagtgcatcagtggctcttatatgcttgcaacaaaggattcctttcattgctattagggctctctctgacttggctggtggcggcaccgcggagtcgaacgaggctgataccttctcaccactggctgcaaccaactctgttgctgtggtcattgagtttgtgaagctcttgtcaaaccacaccaagtagtgatccattttgtgatgtttttaataatccgtaattagttcaatggcatgcacatgtaaacaacaactttgttcttggtttggttgtctggaaaataataaagcataacatttctttcacgtaaatttgaaagaataaggtttttaaag

SEQ ID NO: 45 - DNA, 703 bp, Medicago truncatula
aagcagtggtatcaacgcagagtgcccattacggccggggacatcaattctagtgaagaagataacagctacattaaaaaccaatataaatttgttctttgcttttgtttctgaaaatatgtctagctgtggttgtggaagcagttgcaactgtggtgatagctgcaaatgcaacaagaggtctagtggattgaactatgccgaaggcgaaaccacagaaaccgtgattttgggcgttggtccggccaagatccaattcgaaggtgctgaaatgggtgtagcagctgaggatggtggctgcaagtgtggggatagctgcacatgtgacccttgcaactgcaaatgaagtgcatcatatgcctcttgaagcagagatatattggaaccaatatgtgtaattgtgtgtatattagtacacatttaatatataagaagcatgtgtttccttttttagaataatatgaggtggtcatggatctaaccttcatcaaattcaaatgttcttagattttgttgaaggtgttatgagagctatgatcgctttgtgtttggttgtcttgtataatgtataactaaaggctaatatgatcataaatctctgcgtattataaatgaaatgtattattgtgtgttgtttgaatagaattttttttattcatcaacatcgagttggcatatatcgacataagttggtccatttggt

SEQ ID NO: 46 - DNA, 967 bp, Medicago truncatula
aaccaaaaaagaaaagtttacattaaaaaataaaacagcacttgataatatcctttgattagattaattttaattagagtaatcaccgtatcatatgaaagtttgagtagagagataatcagaaagaaagaaaaaaagcaaagttcataatccaagaagttgtgaagattgtaaattaatggagacagtgatggaagatgtagaagaatacaactacagagaagtgaagcttccatctctgataccaatagtgcctgagccagagcttgagagggaaacaggggaaagaagaagaggaagggatatagtattagccatagatcatggtccaaacagtaaacatgcttttgattgggctcttattcatctatgcagacttgctgataccatccaccttgttcatgctgtttctgatgtgaagaaccaaactgtgtatgacttgactcaggggctgatggagaaattagcggttgaggcttttcaagtttcaatggtgaaaacagtagctcggatagtgcaaggtgatgcaggaaaagtaatttgtaaggaagcagagaggattaaacctgcagctgtggttctggggaccagaggcagaagcttgtttcaaagtgtgatacaaggaagcgtcggtgagtattgctttcaccactgtaaagcagcacctgttgttatcgttcctggaaaagatgctggtgatgcatcaatcgtctaatggatttaggttgtgttctgtataaattggcattgttttcgacccactttcttgtttggaaattcatgggcattttactttgttttgcaagtaattctaaactactcatttcttgaatgtaacattgtttggctcatagtttacttttatgagcacacagaatgcttttaggtaaccttctggcatagtagtttgttttgtaacaatgcaacacagctgatcgattgttagttgtttgtagttagtaatgac

SEQ ID NO: 47 - DNA, 1046 bp, Medicago truncatula
accattttgctttgtttcaactcattcattcactctttgattgtgatatttgttaacaatcataacatcactctgctaaatacactcttgtagtaataggattgtgtttaagttattgcattttgctgacaagttctgatggcattggtaactggaagaagttcagctctgaatccaaatgcacctctcttcatacctgctgcatttcggcaagtggaggatttttcacctcaatggtgggagcttgtgaaatcttcgacatggtttcataactattggttgagccagcataaggaggaagattttgtcgaaagtggcggaaatgatgctacaaatgatgatgatatagaacatatgctgtcagaaacttttgatcttggcattgaagaagatttcaactttctagataatgagtttgagaaattggtgatgtccgacgaagctcaagagtgtccagttatggatgaacctgttgaggaaaaaaagcctgttcatggtgttaacaaggatgctgcagctcttatcaagatcttgtcaccaaaggaaaggggttcaaagtcccctatcgggtctccaaagcaatttgagaagccagcacaatatgttaacctcaagtgtgcacctcagagaattcaccaacctcgttaggaaaaacttgaagctcacagtgtagtagcttgtttgaactgcaagtttctgacttgagtatacaaatcaatgttgagataacttgtgtacatagaagaaggtgtagtgtctttgtatttttcttgttggttttcatgtagtgtatttaatggtaggtgagactttcaagtttgaacggctcaaatcttggaatgtttatggtttgatgaatggttaatgtcagttacatggcaaagtagagtctatgaatttgatgttttaggtgtgtcctgttcagtttggtaattggattgaacttttcagtttggtaattttacatttggaaagaaaatggttaagcagctgcttttttctatgcaattgcatcagtttatcaactttatttaaacttggaacaa

SEQ ID NO: 48 - DNA, 1544 bp, Medicago truncatula
ctccgcatcattccagcttcattgcaatttgcacgcacgccactctcccgatactctctctatggcatcatctgattccaacgctaccaacatgcttcaagcaattcgctacaaccgtgggtctcttcagcttctcgatcagacaaagcttcctttagaaagcgtttacttggaaattcgtgattctaatgatggctggaatgctatacgagatatggtggtccggggagcacctgctattgctattgcagcggcactttcgctggctgtggaggtgtccaatttagatgattttaatggttctactgatgatgctgtttacttcctgcagaagaagttggactatcttgtctcgagtcggccaaccgcggtgaacttatcagacgctgcgaccaaactcaaagaaatcatatctaaggctgctgctaccacttcagaggccaagggcgtgtttcaggcatatctagaggctgctgaaataatgcttgaggatgatgttgcatcaaacagagcaattggaacttatggagctagttttattcaaaaccaaacagaaaaactgaagctttctgttttgacccattgcaatactggaagtttagctacagctggatatggtactgctcttggtgtaattcgtgcactttacagcgggggagttttagaaagggcttactgcacagaaacacgccccttcaatcaaggatccagacttactgcctatgagttggtacatgacaaaataccagcaactcttattgcagattctgctgcagctgcattaatgcaagcagggcgtgtggatgctgttgttgttggcgcagatcgtgtcgcatcaaatggtgacacagcaaacaaaattggaacctatagtgttgccttatgcgccaagtttcataatgtacctttttttgtggctgcccccttgacttccatcgatctatcactttcttctggacaacaaattgtcattgaagagagatctcccaaggagttgttgaacatgcgtggaggacttggagagcaggttgctgcctcaggaatatctgtgtggaatccggcttttgatgttacacctgctaatctaatatctgggatcatcactgagaagggtgtcattacaaagacgcctgctggcgatgcttttgacataaaagctttcgtacagaaaacaggttaagggtggaatgtattcagtactaatgctctatggtgtgatatgaaatgctatgtttcacccattgtagatttgagttgaatgttttcaaggggtgttgtagatctactcattcaatataactatccccggagaataaatggtgacctggttaataaacaagtaaatgagaaattggcggctaccatgacttgcgtcgataaaatggaatggtagttctcagaaaaacaggacatagttttgttttgttttttacagcaagacataattgtataagataacaaggttctaaaaatatgtaatgcttcttatgatgtcaaataaatattatattctagggtgcttatacagtggccttcctcgagag

SEQ ID NO: 49 - DNA, 899 bp, Medicago truncatula
ggctgccacatactcaaagtgacaagtccatgtcccatgaaaccaaaagcaaacaactagttctcatttttcagtcactgagctaagcaaaaatggaaggcattgtaaaatctctctaccttccaaaaattccaaagtctcaaacatgttctggttctcttctgaattcaccacttttattacactccaatgccacttcagtaactttcaattcagcaacacatcatttgcacaagtgctttctttttcagcaaccaggtggtgttatacatcccaaagcacaggaaaaggtgaacctaggagctatacatgcatcaaaagctacaactccaacaacaactactacacaaagatggattcttgaaccagttggagatggtgattcaaggcatataggcttcaaggttgagaggccaggtgcatatgaaattacttctaatgaagtcactgtaggacgtgttccagagaaagctgatttagtgatcccggttgcaacagtgtcaggtgtgcatgcacgcattcggataaaacaagacaatcttcttgttatagatttggatagcaccaatggaacattcattggtgacaaaaggctgaaacctggagtagttaccactgtatcttctgggagttatattacttttggggacactaatttggctatgttccgtgtgtcgaaaatagaagagaaggctgcagatacagttggagaaccagaaggtgaattagagaatgatggcaaatctgatagtactgaaacaagttcaacttctagttgaaaaacatactactttgttttgtatagtgaaactattcagctttgttttgcaatgccattttgatacaaagcatattctactgttgatagctgatattctgctcacataaatgaaagttag

SEQ ID NO: 50 - DNA, 1466 bp, Medicago truncatula
agtgaagtcagaaagagacagctgatgaattaagaagcattttgtattaatattattctcatgtatcgcggtctagatattttaatacgactccaaaacgctctctttattccgttcaaacgctgttcactttttcgcgtcggttttttcttttctatataagaaagaaacccctcgttccttctccttctccttctccttctccttctccttctattcattctccactctctcttcgttttactgtgctccgcatttttctctcccgcttttgcttctcgcagttaacagcataaagtaaagttgtcaagtcaagatggaaaacgggcataaattccaggaagtttccaacccaaaatatgattgtctcttgtttgatattgatgacacactttatcctttgagttctggaatttcagcgcaaacagcaaaaaatattgaagagtatatgcttcaaaagcttggaatggaggctgctacggttcctgaattgtgctattcattatacaagacttatgggacaacaatggctggtcttagggcaattggctacgactttgactacaacgactttcatagttttgttcatgggagattgccatataatctacttaaaccagaccctgttctcaagggcattttgcaaagcttgccttttaggaaagtgctttttaccaatgcagacatgggacatgcgagtagagtgcttaaaagacttggactcgaggactgttttgaaagaattattagctttgataccctgaattcctctgacagcatcatcccttctaatgaaaaagttggcagtgaaatttttgatttctgtgagtacacacgccgtcctgattctgatacggtgcttccaaagacaccagttgtctgcaaaccttttgaagatgcatttgaaaaggcattcaagttggctgacattgaccctcaaagaacattgttcttcgatgacagtatccgcaatttacagacagctaatcgtttgggcctccatacagttgcggttggtacatccgtgcgcagtacaggagtggatcatgcattagagagtattcataatatcagagaggcatttccagagctatgggaagtcgacgagaagcatgaaatcgtcaactacaaggttgcaattgaaacaacagtaaaagcatagatcagaagtttatccactatgatttgtttgtggcggtgtcttttagtatgttggtaaaagaatagctcacaagcttatccactatgatttgtttgtggtgtctttagtattttggtacctatgtaatttattatattgatatgtgaatcttaatcttaattcttagttattgcatttatatgtgaatcttaattcttagcttcaaatttgaaaacaatgtgatttatcaccccaaccgtatctcttatactatgtaattccttaaggcattctgcttcaaaaaaggcgttgttttggtgctctt

SEQ ID NO: 51 - DNA, 1634 bp, Medicago truncatula
aaaacatgtgttcctttcacatgacatgttcatttcttcttatgtttctttcttaacacaaaattttgttccttttttcttccaccacacaaaattccctttggaaaagtcactgctttttcttgtttacctctttttctgttgtgtacttataacagttgaagtggttcagaagagagttgttgttaagaattgtgtcagagactgatgggtaattgtcttgattcttctgctaaggttgatgctgctcaaagctctagatccacttctggaacctcaaaaactactccttctagtttaacaattccatcatacagtgacaaaagcaattcctcaagtcttcttccaacaccaagatctgagggtgaaatcttatcttctcccaatcttaaagcattctcattcaatgagctgaaaaatgccacgaggaattttcgtcccgatagtcttcttggtgaaggcggatttggtcatgtttataagggatggattgatgaacacacatttacagctgcaaaacccggatcaggaatggttgttgctgtaaaaagacttaagcctgaaggttatcaaggacataaggagtggttgactgaggttaactaccttggacaacttcaccatcctaatctagtaaaattaatcggttactgcttggaaggagagaacaggcttttggtatatgaatttatgcctaaagggagcttagagaatcatctttttagacgaggaccacaaccactgtcttggtcaataaggatgaaagtagctatcggtgctgctagaggactttcttttcttcacaatgcaaaatctcaagtcatataccgtgatttcaaagcttcaaacatccttttagacgcggagtttaattctaaactctctgattttggcttggctaaagcgggtcctaccggcgatagaactcatgtgtctactcaagtcgtgggtactcaaggatatgcagcacctgaatatgttgcaactggtcggctgacggccaagagtgatgtatacagctttggagttgttatgcttgaacttttatccggaagacgtgccgttgataaaacaatagctggcgtggaccagaatttagtagactgggcaaaaccatatttaggcgataaaagaagactatttcggatcatggattcaaaattagaaggccaatatccacaaaaaggagcattcatggctgctacacttgcactacaatgccttaacagagaagctaaggcaaggccttcaatgacagaggttttagcaactctagaacagatagaagctcctaaacatgcatcccggaattccttatcggaacatcatagagttcatgctccggtcagaaggtctcctgcacgaaaccgaacgccttcatatgttactcctactgcatcgccattgccatctgtccggcaatctcctcgtgcgcactaggcgctggacgaggaacgatctgtatgtaaatgtgtgttatttttatgaggttgtgtttttgacaaacatgtcttgtagcatctaattaaatgcaatttttggttatcttgaatatattatttataccatttttttagatactggtataaactttactctgatgtgtggatgataattaagtattaaccatgcac

SEQ ID NO: 52 - DNA, 2340 bp, Medicago truncatula
ttgaagtttctgtctttcttttgtggggttggaagaaatcacgtttgtggagctaaagaagcaaccaatacacttttctaccgcacttttttcactcaacttaaagaacagagtaatcaaaatttgaaaccaatgaaagtagctgagaaaagcttagatccacaactatggcacgcatgtgcaggaggaatggttcaaatgccatcagtgaacacaaaagtgttttactttccacaagggcatgcagaacatgctcaatccaacgttgattttggagattctttcagaattccaccactcatcctctgtagagtggcttctgtgaaattcttagctgactctgaaacagatgaagtcttttcaaagataactttgattcccttaagaaattcagagcttgaaaatgatgattctgatggcgatggttctgagaattcagaaaagcctgcatcttttgcaaagactttgacacagtctgatgcaaacaatggtggagggttctctgttcctagatactgtgctgaaacgatttttcctcggcttgattactcggctgagccaccagttcagacggtgattgcaaaggatgttcacggcgaggtttggaagtttaggcatatctatagaggaacaccaaggaggcatttgttaacaactggttggagtagttttgtgaaccagaaaaagcttgttgcaggtgattctattgtgtttctgagagctgaaagtggagaactttttgttggtattcgtcgcgcgaagagagggattgttaatggattggaaacaccttccggatggagttctggtaatggaaattgtggtcttggaccttatggtggtgcttttactgcttttttgagagaggagaataagttggggggtgttggtggtaatttgggaggtggaagagtgaaagtgagtggtgaatcagtgaaggaagctatgagacttgctgctagtaatcaaacatttgaggtagtttattatcctagagcaagtactcctgagttttgtattaagacttcagctgttaaagctgctatgagaattcaatggtgttctgggatgaggtttaagatgccattcgaaaccgaagattcttctaggattagttggttcatgggaactatttcttctgttcaagttgttgatcctattcgttggcctaattccccttggagacttcttcaggtcacttgggatgaaccagatttacttcacaatgtgaagcgagtaagtccatggttggttgaattggtatcaaacatgtcgatgattcatctcgcacctttctcaccaccaaggaagaaactccgttttccacaacatccggatttccctctcgatgttgtccagtttcaaataccaacgttttcaggcaacccttttaaccctttgtgttgtttatcttcttcggataattataacgctcctgccgcaggcattcagggagccaggcatgctcaaattggaatatctttatcggatcttcaccttaacaacaacaaatttcagttaggtgtgtttccaaataatcgcgagacgatttctaatgttagcaacataactaccaaccatgataataagagcaaagaaagtatatcatgtctgttgactataggaaattctcacaagagaagtttggagatcaaatctgataataatgataatagacaccaatttttgctttttggtcaaccaattctcactgagcaacaaatctctagaaaagattctagtgatgatgtgttgttgtccaagaaaaaggacaaagagaagtggtttttcagtgatactactcaatcttctatttctgaacagttttcaccagcaaaatcttctactactagtgctagtgctgacttctgttggcaacttggattagatactggtcattgtaaggttttcttggagtcagaggatgttggaagaaccttagacttgtcctgtgttggttcatatgaagaactgtatagaaaactggctaagatgtttggaatagaaagatctgagatgttgagtcgtgtactctatcgcgatgcaacaggtgctgttaaacaaactggtgaagaacccttcagtgacttcatgaagacagcaaaaagattgacaattctgatggattcaggcagcaaagatactagaagggtttgtatcacaggaactaggaatgctgaacgtggattagatgcatcaaataagacagggcctatgagcatctttgtttaagatgtgttgcattgcatttcagttattataattgttatgtgatttcagaagttgaaggatatataatcttgttaaagagaccttcaaattgaatcaaatatttgatta

SEQ ID NO: 53 - DNA, 1405 bp, Medicago truncatula
cgttcctcttttttcttctcccagccaaagcaaaaccaccgaacaacatccaccaccacaccactgccggcgagccgcgaccactcttctccttctccatccatcaccgccgcatcctcctcaatcttctgtattgattctttagtttagagagctatctccatccatctctctagtttagaaattggttaattcttagagttcaaaagctgactttgtttttaactgagacacaactataaactcttttctaacaacacatgattatatcacacccttttacaccttttccttcttgcattaccattacatgctccaaacctttttcccataataatcattttatcaaatcctatatacctccttttctgctcttgagaaatgctagatcatcgacattgttatgtagtgctagaagtggacgaaatgaaaattcaaacagtttggactttgatatagacatcaatgaggaagatcaagtgcttgagaatgatgattatggtgggttttcagctcaagggatggaaacaaatgatattattgatgtagatgaaggacaagatgatggtgatggcagaagatattcaggtggaggaccgtataaaggcagggatgagaaggattttgatagaaatccagaatttgctgaaatacttggtgattatctagatgatcctgagaaggcacagtccagaatggaagagagactaagaaaaaacaggaacaaaatactccacacaaagaccggatcaggagtaccaatgaaagtgtcattcaataaatttgatttttcaaactcatatatatggtttgaattttacaatgctccattggcaaaagacatcaacttaatttgtgatgctattcgagcatggcacattgtaggacgacttggaggatgcaatgccatgaacatgcaactgtcacagtctgagatagaaaaacgaccaagttacgattatattcagggagcgaatgtaacaccaacgacattttacaacattggggatcttgaggttcaagacaacttggctcgaatatggatagatattgggactaatgaaccattgattctagatgttttgataaatgcattgacacagataagttctgactttgttgggatcaagcaagtagtgtttggtggagaagaatttgagaattggaaagaggatttaacatcagaggattcaggttatggtgttcataagatctagccaattttctaggcatatggtcaaatgaaagagtaaatcatggttacaattgttatcaaactttatacaagttttattaggagacaagtcaacaatgttgctcatttgtttgcaagaacgtcaccgtatttcattagccatcaagagtttgatcataccccattatgtatttgtattcaaacaatttt

SEQ ID NO: 54 - DNA, 3432 bp, Medicago truncatula
ttgagaagctgccttcaacaactgaggtcatagaacgagaacgaaccagcagcgccgcgtctcctcgaactcaggtcatcacttccacttcgaagctcaatttcaacaactaagatatctcgtttgaattcaccgtcaaaatgcttcacaacaagtccttcgttaagaaaaccaaaggtggcaaagtcataaggcaagtaagggaacactacttgcgtgatgatatatattgcggagctccgtcttgcactatctgtaacacttctggtgctagactcagtgcttctccttccactattcttgttctcgacactaatgttgttcttaatcagattgatttgctggagaatcccgctattgatgatgttgttgtactgtctattgtgttggacgaggtcaagaacaagaatttgtcggtttataatcggttaagagctatttgtagtaatccaatgaggaaattctttgttttttccaatgagtaccacagggatacatatgttaaggaaatgagtggggaaactaaaaatgacaggaatgatagagctattcgagtggcttcacagtggtatcagaaacatctaggtgatgcaataaaggttttgcttgtaactaatgataaagagaacaaacggaaggcgagtgaagagggcatttgtgcagaaacagttgagtcatatgtcaagtctttggaccgacctgatttacttgacctgcttgtgcggccttcatctgaagacgtggagatggaagatgttgaagatcatagaccatccaagaggaaaataatttacgcagagcataaaccaatgtcagaaatcacatctggtttgcatcgtggaatatatcatcaagggaaacttcgtgtaaaccgttacaatccattcgaagcatatgtcgggagtgagagcattggcgatgagataattatttatgggcgatctaacatgaaccgagcttttgatggtgatattgtggcagttgaacttctgcctcaggaccaatggcaaggggagaagtctatgtctatagctagtgaagaagatgaggatgatgatgatgttcatctagccccgaacagcgctgatgttgcaccccgaactattcctcagcaaagttctactggagaaataaatgctggatccggtcgcccttctggttgtatcgttggtattataaagagaaactggcaatcgtattgtggatctttggagccaatgcctatacctggagggagtcgtggtgtggcctatgccttatttgtctccaaagatcgtagatttcccaagattcgtatccaaacccgccaacttgagaaccttttggacaaaaggattattgtatcagttgattcttgggatcgtcaatctcgatatccatctggccattatgtgcggactgtaggaaagataggtgataaagatactgaaactgaggtggtcttgatagaaaatgatataaattcaaggccattctctgcacaagtgctagcatgcctgccaccattgccatggtcagtctcttctgaagatttgtccattccatttaggcaagatttgcgtcacttgcgtgtcttcagtgtggaccctccaggctgcaaggatattgatgatgcactccactgcattgctcttccaaatggaaactttgatgttggagttcatattgccgatgttacaaattttgtgtttcctggcactcctctcgatgatgaggcttctcaaaggggtacatcagtttaccttgttgagaagcgaatagacatgcttccaaaacctttaacagaggacgtatgttctcttcggtctgatgtggagaggctagcattttctgtcatatgggaaatgacacctgaagcagatatcatttccaccagatacacaaaaagtgtcataaaatctgctgcggcattgtcttatgttgaagcacaagcgaggatggatgatagtcgattgatggacccagtaactactgacttgagaaacatgaatagtttagccaagaaaatgagattaaggcgtattgagaacggagctttgactcttgcatctgcagaagtcaaatttcaaattgacacagagactcacaatccccttgatattggtatataccagataaaggaagccaatcaaatggtggaggagtttatgcttgctgctaatgtttctgttgcgcaacaaattcttaaaagttttcctttgtgctcattattgaggcgacatccaactccaactaaagagatgcttgaacccttgctacgtgtttctgctgcgattggtctaaacttggatgtctcatcatcaaaagcattggctgactctcttgaccatgctgtgggtgatgatccatatttcaacaagttgatccgcattctgacaactaggtgcatgagtcaggcagtttatttctgtagtggggatcttagccctccagaatatcatcattacgggcttgcaacacctttatatacccatttcacatcacctataagaagatatgctgatgtcattgtacacaggctacttgctgcttctataggaatatccaagttaccgtctgtatttcaagacagactgcagctcaccagtattgcagacaatttaaattataggcacaggaatgctcagatggcagggcgggcctctgtagagctgaatactctcatttatttccgaactaggccaactgataccgaggctagggtagtcaagataagatctaatggtttttttgtgtttgttcccaaattcggcatagaaggacctgtatatttgacaacaagagctgaaaagggtagcggagaatggtatgtagatgaacaagagcagaagattaaaaagatggatggtagcttttcatacagcattttgcagactgtacaaattcacttggaggttgtggagcctcaacctaaccggccaaagcttcagcttactctcatctagaggtatacgagacatcatgagcattgaacaagaagcaagctaggaaatgtacctcttatttatattgctctccacgcctccgcacttgaagtttctggtattagaattgactggcatggatattttgttggaagaattgattggcatggatattttgttggaagaattgactggcatggatattttgttggaaggattgaaaaccatagcttgagtagtgttggcataaatgattgatgacaagtctttttacatttatttatttactgttagtttcgtaagtgtgaatgaggaattatccattttgatatatagagttagtgtgaacaactttatcaaaatgatacacgttggcttaaatatggtagccatcttgcacttgagagatttgcataactgttttaattaataggaaatttacaattatttaagaaacatgagagttttgttatagataatcatccagtttttgttattattgttggtg

SEQ ID NO: 55 - DNA, 2280 bp, Medicago truncatula
tttaacaaaaacaaaaatgaggtaaagcaccaaacataagattgaagcggtgagtttacgtcacttcactcactaatcttcaccttccttcttttttccctctttattatcaacacacttcacattcttcatcttcctatatacaccccctctttttctattcaacccactctcttcactttcacatcaacaacttcaattcaattttgaagttattaccaatcttcaatggcgaagatgaatccattattcatcctcgccttcttcttcttcttctccaccgtcagatctgattcatcagataaacgttacaaagaaggagatcttgttcctctattcgctaacaaagttggtccttttcataatccaagtgagacgtatcggtattttgatctgccattttgtataccagatcatttgaaagagaagaaagaagcactgggtgaagtattgaatggggataggttggttagtgctccttatcagctcgagttccaaaaggacaaggactctctgtcggtttgcaagaagacacttacaaaagaagaagtggcgaattttcggtccgctgttcgtaaagactactactttcagatgtattatgatgatttgcctatttggggtttcatagggaaggttgataaggaagggaaagaccctagtgattatagatactacctttacaagcacatccattttgatatattttacaacaaggatcgtgttattgagatcaatgtgcgaacggatccaaatgcccttgtggatgttacagaggacaatgaagttgatgtagagtttttctatactgtgaaatggaaggagactaacactcccttcgagaagcggatggacaagtactctcagccgtcctcgctaccccatcatttggaaatccactggttttcgattatcaattcgtgcgtcacagtcctcctcttgactggttttcttgcaactattttgatgcgtgtccttaagaatgattttgtcaagtatgcacatgatgaagagactgcagaggatcaggaagagactggctggaaatacatccacggtgatgtttttaggtttcccaagttcaaatctgtatttgcagccgctcttggatctggtacccaactgtttacccttacggtgttcatattcatattggcacttgttggtgtattttatccgtacaaccgaggggctctattcactgcacttgttgttatatatgcactcacttcaggaattgctggctatactgctacctcattctattgtcaactggaaggaacaaactgggttcggaatctactattgaccggatgccttttctgtgggcctctatttcttacattttgctttctgaacactgttgcaattgtctacaatgctactgccgctctcccattcggcacaattgtcgttatagttctcatatggacacttgttacgtctcctctacttgtattgggagggattgctgggaagaacagcaaggctgaattccaagctccagtccgcacaactaaatatccaagggagattcctcctttgccatggtatcggggagcaattcctcagatggcaatggcaggatttttgcctttcagtgctatttacatcgaactttattatatatttgccagtgtctggggccacagaatttacacaatctacagcattctgtttattgtcttcatcattctcttgattgttactgctttcattactgtggcattgacatacttccagcttgctgctgaagatcatgaatggtggtggagatcattcctatgcggtggttcaactggattatttatctatgcctattgtctgtattactactatgcccgctccgatatgtctggtttcatgcaaacctcatttttctttggatacatggcctgcatatgctttggtttcttcttgatgcttggaactgttggattccgtgcagcattgttctttgtccgccacatataccgatccatcaagtgcgagtaggcattttgtcatctcttattgtcttcatttcataggcattctgtagaaaagttatagtaattttgcagttctgtgtactatataagagaagctgggttgggtgggtttgtagcttccagagcaacttgttagatcacaaaagaaacttttttggagataacgtctgtactaccatatttttaactaaactcttgaatactttattttttggtaatcatttgaacacaattctggtaactttttcaagctatgtcaaaacaattctgtttccttagaaatgatggc

SEQ ID NO: 56 - DNA, 1200 bp, Medicago truncatula
aacaatatcacttcaattcaacccaaactcactctcattcaaatcaaaccaaaatggcattctcatcatccatgtggtcttctctctttgttccaaacccaaacaaaactaaccgtttcgctacattctctccctccagccacagcaaactcttaacaaccacattcgccatccctccactttcaaccgcaacagccgccgacgttaccggcgccatagacggcacaacagtcgccgtcatcagcggcggcttcgtcgctggcctcaccgcacttctctccctttcagacccggaaagacgacgacgggaacaggcggaggaagtaggcggtgatgacaaagaagttgtgagggagtatttcaacaacaacgggtttcaacgatggaagaagatttacggtgatactgatgatgttaatagagttcaacgggatattaggttgggacattccaagactgttgagaatgctttgcagatgttgaaagatgaagggtcacttcagggtgttactatctgtgatgctggttgtggtaccggttctctttcaattccgttggcgaaggaaggtgccattgtttgtgctagtgatatatcagctgccatggttgctgaagctgagaaactggcaaaagaacaacttgtgtccagtgaaaatggagtgtcacctgcgatgccaaagtttgtggtgagtgatttagagagtttggatggattgtacgatacagtggtgtgcctcgatgttatgattcattaccctcagagtaaagcagatgggatgattgctcaccttgcttctttggcagaaaagcgattgattctaagctttgcacctaagacattttattatgatgcactgaagagggttggagagttgttccctgggccttccaaggcaaccagggcatatcttcattctgaagcagatgttgaaagggcgttgcgcaaggttgggtggacgataaagaagaaaggcttaatcgctactcaattttactttgccaagcttattgaggctgttcctatgtagtgagtccagaggattcagaggtaagttttgcatcattagaggaaattcctaatgtatattgtaagccatttttttgtgcttttgcatgctatgttatcctatgatcccctggatatgtatattatattccttcttagcgtaaacgatgctgatgtattgttttttattttgt

SEQ ID NO: 57 - DNA, 1686 bp, Medicago truncatula
acaaagaatagaattgtttatgtaaatatattattctattttttctggtgcaaatctgtggttggttgggccagagagcaagaataggcaaagattacgtggcggctaagatcctttgctgacttttttgttgcaaaagtagatagaaacagaaaagagagacacaaacatggctactttgaatgttttctctcaaccattgcaccctacaactatttcatcttctttatgttcttcttcttcttctaattctactttttcatgtcacttttctcttctttcttctcactcatcccccacactgtctaagctctctaatcatgttcacacccacttctctaagtcaggcaatggaagttcatggctgcaaagtagttccaccgctgacagcattgcgcacaagaagggtcctgtatattcagtatttccttcatcacctgcccaagtttcatctgtccaagatctgtatgaatttatttgctcaggacctttgctttacaaaattggtttgacgccagagaaggtggccgagtctatagataagtggttgtcttatgggcggcaactatgtcgactgtttcagcttaatgaattgttcttgacagagcctcaaaaagttaggctttatcattactatataccagtcttcctctggtgtgaaagtgagattgctcagcatcaggccaaattcaaagataaagaagatattcctcctttagtgattggatttagtgcccctcaaggctgtggaaagacgaccctcgtctttgctcttgattaccttttccaaatgattggcaggaagtctgcaacaatatctatagatgatttttatttgacagctgaaggccagaataaactaagagaggctaatccaggaaatgcacttcttgagtatcgtggaaatgctggaagccatgatcttcctttttctgttgaaactttgacagctttaaccaaaatgtctagagaaggtaccaagatgaagttaccaagatatgataaatctgcttttggtggaagaggtgatcgtgctgatccttcgacatggcctgaaattgaaggcccccttactgttgtgttgtttgaaggctggatgcttggtttcaagccccttccagttgaagctgtaaaagctgttgatccgcagctagaaattgtaaataaaaacctcaaagcgtattatgatgcgtgggacaaatatatacagtcatggatagtcattaagattaaggacccaagctgtgtctatcagtggcgcttgcaggctgaaattgctatgagggaggcaggcaatcctggaatgtccgatgatgaggtgagagattttgtttctcgctacctgccagcatacaatgcataccttcctactctttactcggagggtccgagtggatcagaccctcaacatctactaaacatcgaaatagatgaaaagaggaaccctatcctaggtgtctagtctcacaagatgatatgacatttctggcttttcaattcttttgagagaattggaatggccctttccaatcagttgcaccatcggtggagataagtaaatgtatcagcgctattttcgttgaaatgtatagaggttatttttatcagcacataacaatgccaaatgctttatggtttttcatatgaaataactggatgtaggaaccacagaaaatgttcattgcg

SEQ ID NO: 58 - DNA, 1236 bp, Medicago truncatula
atcttttattatttattgtcccctccttccatctctgaaaacaagaaccccttgaaaatttcttcaccatatctctatccaatggattcaagctctaacgaagtagtccttgatctctcacccatgattaaaatctacaaagacggtcacatagaaagactcataggatccgacatcgtacctccatcttttgatccaacaacaaacgtagaatccaaagacattctcatctcaaaagaccaaaacatatcagccagaatcttcattcccaaactcaacaacgatcaatttccaaaccaaaaactccctctccttgtttacttccatggtggtggtttctgcgtagaaacacctttctcaccaccataccacaatttcctcaacaccatcgtttcaaaagctaatgttattgctgtttcagttgattacagaagagccccagaacaccctcttcctatagcatacgaagattcatggacttccctcaaatgggtcgtttctcatttgcatggaaatggttctgatgaatggatcaaccgttatgcagattttggaaaaatgttctttgcaggagacagtgctggtgcaaacattgcaaatcacatggctattcgtgttggaactcaagggcttcaagggattaaccttgaagggattgttttggttcatacattcttttggggtgttgaaagggttggatctgaggctactgagaaatctgaacacttatctttggctgataatttatggaggtttgtttgtccaacaagttcgggatccgatgacccgtttttgaatccgggtaaggataagaatttggggaggttgggttgtaagagagttttggtttgtgttgctgagaatgattcgttgaaggatagaggttggtattataaggagttgcttgagaaaattggttatggtggtgttgtggaagtgattgagacaaaaggtgaaggacatgtttttcatctctttaatccaaattgcgataacgctatttctttgctcaatcaaattgcttcctttattaatcatagtggttaaccttaagcatgctgttatgcattgctaaatgctaattactattatgaatttatgattatgaataatgtaatgtaactctcgtgcatttgtggaatacctgttttcttggtctacactctactagtagtattctacttgcagttacaagattattaataatttgactttagcatctgcttattaataaat

SEQ ID NO: 59 - DNA, 956 bp, Medicago truncatula
tactgtcacttgttcactgacactgtcattttcatcactatcacactccaaaacaactctgacacagaacaaacacctctccttattccattgtttccaaggttgtctcctgtgtttggtccccacaaacaactctcctttttcatttctcttttcactttgctatggaaatggaaggttatgatatatttggagatgctactgagagaattggtaaaaatggttttgaagtaaacaatgaggtaattggaagtgggtatggttcaagtttctctctggttttggatagggagagaggggagcttgtagaggaacctgttaaaatggaaggaaagggtgtgtccactacagagagaagtgttgaagctttgaagaatcatagtgaggcagaaaggaggagaagagctaggattaatgcacatcttgatactcttcgttgtgtcattccaggtgctttgaagatggacaaagcatcattacttggtgaagtagttagacacttgaaagagctaaaaaggaatgaaacacaagcatgtgaaggtttaatgataccaaaggacaatgatgaaataagtgttgaagaacaagagggaggttggaacggttttcctttttcaattaaagcatcactatgttgtgaatatcaaccaggtttattgtctaatataagacaagccctagatgctcttcatctcatcatcatgaaagcagatattgcaacttttggagacagaatgaagaatgtctttgttgtaataagctgtgaagaacaaaactttgatgctgctgaatacagacagtttcttgctggttctgttcaccaagctcttaagtctgtacttagtagattttctgtttcacaggatatgctaagagcaagaaaaagaaggagggtttctatattcagttcttcatctttagaaaatttcttataagttcctttgtcaagtaatttg

SEQ ID NO: 60 - DNA, 2402 bp, Medicago truncatula
atggttgtaaaccctaaaccctagcaaattacctgaacaaaacacaaatcctgcaatctctcttctccaatctgcaatggcgccagcaactaagaaaaaaccttcaaagccagtcaaacctcagaaagcccccaaaaaagttcaaattgttccaatcaaagacgattccacttctgaatccgaagaagaagaagcaccacctctacaacatctcgaactcgatggttctgattccgacttatcttctgatggtgatgatcaactagctgatgattttctccaaggaagcgatgatgaagacgacgacaacgacgatgaaggttcggatttggaatctgggtcgggttcggatgaggatgaggattcggaatcgggtgaggaagatattgctaggaagtctaaacttattgatagaaaaagggagagagatagccaggcagctgcagatgaattgcagacaaatattcaaactaatattcaagatgagtctgatgagtttacattaccaactaaacaggaacttgaggaagaggctctgcgtcccccagatctttccaatctgcagaggaggattaaagagattgtccgtgttctttccaattttaaggcgttgagacaagatggggcgacgaggaaggattatgttgatcagcttaagactgatatacgttcatactatggctacaatgagtttctaatcggtgctttagtggagatgtttccagttgttgaactgatggaactgattgaagcctttgaaaagcctcgccctatatgtctgaggacgaacactttaaagacacgaagacgggatttggcagatgtcttgataaacagaggagtaaatctggatcctctcagcaaatggtcaaaagttggacttgttgtgtatgattctcaagtacctattggtgccactccagagtacatggctggtttttacatgcttcaaagtgctagttcttttctgcctgtgatggccttggctcctcaagaaaaggagcggattgttgatatggcggctgcacctggtggtaaaacaacttacatagctgctctaatgaagaactcaggaataatttttgcaaatgaaatgaaggtgccacgactaaaatctctgactgcaaatctgcataggatgggtgtatcgaacactgtagtctccaactatgatgggaaagagcttccaaaggttttgggtttcaattcggttgatagggtattattggatgccccttgcagtggaaccggggttatatccaaagatgagtcagtcaaaacttcaaagaacttggaagatataaagaaatgtgctcatctacagaaggagctccttcttgctgcaattgacatggttgattcttattcaaaatctgggggatacgttgtatattctacatgctcaatcatggttgctgagaatgaagcagttattgattatgtgctcaaaaggagggatgtaaagctggttccttgtggacttgactttggacgtccagggtttacaaagtttagggaacagcgttttcacccttcattagataagacaagacgtttctatccacacgtacacaatatggatgggttttttgttgcaaagttgaaaaaaatgagccacccaaaacctgctagaacatcagaaacatttgagaaggatgaaaaagaaaccgagcttgttatcgacgacgataaacctagtaatggcgttgaagaaaatggcaaacattcttttgaacttgaatccaagaagaggaagaaagataaattcccatcaaaaccaagtaatgatgtaaaagccaatgtcaaagaagcttctgaacctgaatccaagaagaggaagaaagataaattcccctcaaaaccaagtaatgatgtaaaagctaatgtcacagaaacttctgaacctaaacccaagagggtgaaaaggaaacctccatctagagaggagatttcaaaagccagagaggagaagagacttgctttaatagaaaagaagagaaaaagtggtaagcaacagagaggaaaaaatgatgaatgaccagtggcagtacaagtagtattgatgaccaactgtgcaattatagcgcagaattgacgcaaaactccatcaatatgggagtactgaggtgttgcatgtcgaaagaatgtaccctggagtcagtggcatgacctgatcgaaggtcccaattttgttttgttctgtttaagttatttagccatggcatttttaaacatagatctgtttattaagctgtaaaatcagaatggagaaaagctacttttaggcatgattaatttgaatttattttctaattcttgtcttcatgtctattgcccctctttatttgttatcctttgtaagaattattacacttgcgtttaatgatattataaaatttatg

SEQ ID NO: 61 - DNA, 1019 bp, Medicago truncatula
attcttagcgagagtgtgagagaaaagagaaaatggttccaaaaatgttgaagttctctcgcatgcttcattcatcttccaggaatcatctattggaagttctttacgctagggatttctctactgccacaaataacaactattctgctaaagggtatacttcagatcgtatctttgctccttattctgtttacaagggcaaagctgcgttctcactcagtccttgtcttcctacttttactaagttggattctggggctcttgtggttgatcgtcacggttccataatgatgagtttcatgcctgctattggcgagcgcaaatatgactgggagaagagacaaatatttgccctatcagctactgaagtcggttctttgatagccattggtccccaagattcatgtgaattctttcatgacccctcaatgaaatcaagtaatgctggtcaagtaaggaaaagtttgtcaattaagcctcatagcaatggctactttgtctctctgtctgttgttaactccgtgttaaataccaaagacaattttagtgttcctgttacaactgctgagtttgctgtgatgaagacagcttgcagttttgcattgccacacattatgggttgggatcgtctaactaatcagcagtccagtgggacagtcagctttcaaccaaagatgaactcacaaattttagacttggagtgggaaaagtgagttactgttgggaaatatgaaatggatccttctttgtgctgtcaattccattttgtgtattatcaatccaaagactaggattgtttgtggaagataacctgtaaattgtaatacttaagaaagaagcatgggaaggatgaattatgaaatgtctgacgttgtttcagaattagtcgtgttattattttgatgtttccttgtttattcttcttctgcttttgttattatgcactgtctattgagatttgagacataagaagcaatcatgatattcatagggttggattagatccaattgaaattcca

SEQ ID NO: 62 - DNA, 928 bp, Medicago truncatula
cacaaaccaaaaatcaaaaccaaagggtggtagtagtagtattgtagtggtgccggccagccgacaattacgggagccaatgtgggtcccttcacttttataaactcaaatcacttctcacttcacttcgcaaaccctttcttttctctcttcttgtgttgtttttctttgttttcatggcttcttcttcaacttcttcagcgaatcgtgaaggacactacagaggtgttaggaagcgaccatggggacgctacgccgctgagattcgcgatccgtggaagaaaacgcgtgtttggctgggtacatttgacactcctgaagaagctgctcttgcttacgacggcgccgctcgttctcttcgtggagctaaagcaaaaaccaacttcccaccggcgccggtcgccggaggactttgtttggatctcaacgctccttcttctgatctccgatggccatctgtcccttcacgtggccgtgtgcttactgagtttcttcaaactggtgttctcaaggatttcaaccctcctccacctccacccatcggcggggtggttggacagaggcataatgaagttactcttgctgtcgccggcagaactatggtggctgagaactctccgacggcggcttacttgggacttgttcgacgtgggattccgattgacttgaatgaacctccaccgttgtggctttgaaaaaccctagacaaataagtagcgtaaaatgagatgatttattgtagttttttaacggcgtcgttttaggatcttatctaattaatcttgtctttttctcccttattagcggcatagttatcatgagggagtatctacctatcttatctttgtaatgtatctatggcaatctaacatttaaaaaaaaaaaaatgaagtactttatgatattttatttatttatttccatatta

SEQ ID NO: 63 - DNA, 2445 bp, Medicago truncatula
attctcgctactacttgttcatattaacaataatatctcttacgttctctgcattcattccattccattatctcttcttcttctgccaaattccaatggcgggaattcctatcacctcctctaactacaactatgcttcttccatccattcacttcctctcttctttgctcgcaccaacttcaccaccaccatcaacatttctccaacctcttcttttcgcgtcttttgccatactcaatccaagacaaagaaaacggagataagaaggttttcccctttattagaaagttccggtaatggtggtgtggctttagatgagtggaaagctgttcctgatatttggagaacttctgcagagaagtatggtgataaagtagctttggtagatcaatatcatgatcctccttcaactatgacatacaaacagttgaaggatgcaatattaaactttgctgaggggttgagagttattggagtaaaacctgatgagaaaattgctctttttgctgataactcgtgtcgctggcttgtagcagatcaaggcatgatggcaattggagcaatcaatgtggttaggggttcaaggtcatcaattgaagaactactgcaaatatacaaccactctgaaagtgttgcactagctgtggacaatcctgaaatgtataatcagattgcaaaaccattttatttgaagacctcaatcagatttattattctgctttggggagaaaaatcaagccttgtcaatgaagcagacaaaggggtgccaatctatacattcatggaagtcataaattttgggcgtcaaagtcgcagggcattgcacacctccgatgatgctagagaacactatatctttgaaacaataaaattggatgacattgctactcttgtgtacacaagtggtactactggaaatcctaaaggtgttatgctaacccatcagaatcttttgcatcagatcaaacacttatcggacgttgtacctactactgaagctggagataaatttctaagtatgttgcctccttggcatgcatatgaaagagcttgcgagtatttagttttctcacgtggtcttgaacatatatacactactgtaagaaacttgaaggatgatttgggacgttataaaccacatttaatggtttctgttcctttagtttttgaaactttatacagtgggatcatgaagcagatatctacaagctcacttgttagaaagcttgtcgctctcacattcataagggtcagcttaggatacatggagtgcaagcgaatttatgagggtaaatgtttaaccaagaatcagaaagcaccttcctatctctatgcaatgttggattggctatgggcaagaattatggctacaatattatatccagttcatatgctggcaaataaactggtctacagtaaaatccgttcaactattggaatatcaacggctgcaataagtggtggtggtagcttaccttctcatgttgataagttttttgaggctattggtttgaatttgcagaatggatatggtttaacagaaacttcaccggttattgctgctcgacgacttggttgtgacgtaattggatctgtggggtatccacttaagcatacagaattcaaagttgtcgattctgaaactggtgaagttcttccacctggttcaaagggaattttgaaagtcaggggcccacaattgatgaaggggtactacaagaatcctttagctacaaatcgggtcattgatagtgatggctggctaaatactggtgacataggttggattgctgcccaccattcaactggacggagtcgtaattctggtggtgtgattgttgttgaaggccgtgctaaagacaccattgtgctttcatcaggtgaaaatgttgaaccgggagagcttgaagaagctgccacgaggagtaacctcatacaacaaattgttgtcattggtcaggataaacgacgtctaggagctataattgttcctaacaaagaagaagtcttaaaggcagcaaaggaattgtcaattatagattccaatagttcagatgtcagtcaggaaaaagtgaccagtctaatatataatgaattaaggacctggacgtcagggtttccatttcaaattgggccaatccttctcgtaaatgatcccttcacgattgataatgggctaatgacacccacaatgaaagttcgaagggatagagttgtggctcaatacagggaccagatagagaatctatacaagtaaacttacctaatgtcaatggtatgttacaaatacttatagctcaacacaggatcaaatggagaacctatacaagtaaaattacctaatgccagtggcacaatagactcgtactaagtgataacagttataccatgaccacaatagttagattagtaataacattttatgatttctatagtgactcttg

SEQ ID NO: 64 - DNA, 1692 bp, Medicago truncatula
agtttcaagataatatgagatcaacttggagttctatatagtctttatcttcaaccttattacgtacaacccaaccattcatttgtagacatgtcttttgcagtaacaacaataatatttgcttttcttctcttcactttcatgtactttctattcaaactcttcttacattcaaaacaaaaaaccattatccatgaaaaaccaccaggtccaccaacactaccaataatagggaaccttcacatattaggcacccttccacatagaacacttcagtcactctccaaaaaatatggtccaatcatgtccttacaacttggtcaagtcccagctattgtcatttcatcttcaaaagcagcagaatcattcctcaaaacccacgacatcgttttcgcaagccgaccaaagattcaaggatctgagctcatgtcttatggttccaaagggatggctttttgtgagtatggtccttattggcgtagtgtgaggaaattttgcactttgaaacttcttagtgcttcaaaagttgagatgtctggtcctattagaaaagaggagttgagtattttggttaacactttgaagaaagctgctttggttggtgaggttgtgaatgttagtgaggttgtagagaatctaatagaagatattgtgtataagttgatgtttggtcggagtaagtatgagcaatttgacttgaagagtttggttcaagaaggattggctttgattggagcttttaatctggctgattatgttccttggctaggaatttttgatcttcagggattaacaaaatcttgcaagaaagtcagtaaagcacttgatgaggtgctagaggtgatattaacagaacatgaacaagctgctaatgtaaacaaaactcaaaaagattttgtagacatacttctttcaattatgcaccaaaccattgatattgagggtgaacaaaatctcgtcattgatcgaactaacatcaaggctattttgctcgacatgatagtggcagcaattgatacatctgctacctcgattgaatgggctttatctgaacttttaagacatccaagagtgatgaaaaagcttcaagatgagatacaaaatgaagtaggaaataaaagaatggttaacgagaaggatctaaagaagttgaattatttagatatggtggttgatgagaccttaagactttaccccgtagcaccgttactagtccctcgtgaatctagagagagcacaacaattgatggttattttataaaggaaaagacacgacttatagtaaatgcatgggcaatagggagagatcctaatgtttggtcagaaaatgctaaagaattttacccagagagatttgtagagaaaaaaatgaattatcttggacaagagtttgaatctataccatttggttctggtcgtaggcgttgtcctggaattcaattgggtttaattactgttaaattggttatagctcaatttatccattgttttaactgggaacttccacataatattagtccctccaatttgaatatggaggagaaatttggactcactataccaagagctcagcatttgcacgcaataccgagttatcgtttgaatgatgctaagcttgaatagtttcaagaacaatattatgttgtgtaacaagtttattgctagtaaaaatgccaagtattgtacgtctag

SEQ ID NO: 65 - DNA, 1133 bp, Medicago truncatula
gaccaaattttcatattcattacttgagaatcacttccgactcttgctgtgttgtcgtcgtcagcggcggtagtgggaaaaatgtcgcggcggacgatggagtgggcggcgaagtcggaccaccttcacggcataccacgcaaagtcgtaatagcagcagtcggttccttcgcgaaaacagtttcatctctcatcaacacaaccttcgttcataacgccgacactctcctccgcctcgttcgttccagacccaaaggcatccccctcatcaccgtcagcaatcacatgtcaactttggatgatccggcgatgtggggatttaagggttttcctatctttgatactaagttagcgagatgggttcttgctgctgaagatatctgttttagaaatccactttattcatatgtttttcgcaccggaaaatgcatacctattacaagaggtggggggatttatcaaaagcacatgaatgaagcgcttgggcgcttaaatgatggagaatggctgcatacttttccagaaggaaaagttcatcaagacgatgcacctataaggcgattgaaatggggaactgctagtctaattgtccgtgcacctataactccgattgtattgccaattgttcatcatggttttcatgaggtgatgccagagaaatatatgtttggtagacggcctcctttaccattatgcaataagaagattaacataattattggcgatccaattgaatttgaccttccagcaatgagtgaaatggctattgcccagtctcggaatgattcattccctactattgggtggcccagaacttccgatggtttggatgaggcagctcaacgacatctgtacactacactttcagagaaaattcgtgttgccatggagaaattaagatgttatggtaaaagttttctgaagtcttaagttaaaccccacctaagccttttaagatgccacaaatttgttcattgtattgtatcattctttgtttagttgacggttgagtgagaactgtcaacctgggattcttaaagtcgagttagcaatataatatttaagttttgtagggccatggcccatagactaccctccatgtaatgcctaaaattagatagggtaatatttga

SEQ ID NO: 66 - DNA, 2000 bp, Medicago truncatula
aaatgccaaatgaacaaaaaaaatgaataaaccatccaaccaaactcaagtcaagatacaagtcaacacctagtcattgaattgttcctccatcctatgctatgctatgcaatgattctctcttcaagttttcttgatcaccttcaaactgtgtaataatttatggatccatcacaaagagtttcacgttttgaagcagctcagaaagcaataaactcaattggattgggttttgacataacactggatatcaactttgacaattgtaagagtattggttcacctttgatcttcatcaataatcaacaacactgccgtcatttggagcttcctggtggtgttacaattccaaatgtttcaaactctgtcaaatgtgtcagaggagaatctattagaatccattcagatgttctcaccttgcaccagatgttgcagcacttcaaccatgaaatgcgtcttgtaggagacactgcatctggtcatttttgtgcttcatttgggttatctggtcgatgtatcaaagacttggcttctattaagtctctcgcttatgatggttggttcatcaaacgctatgctgtagaattagaaaactatcatggtgaactccatgatcatgtcaaagaagctgtgccatcatcatgggaccctgaggccttggcaaggttcatagaacgttttggaactcatgtgatagtcggggtgagcatgggagggaaggatgtgttttatgttagacaagaagatacatcagatatcagtgatccaactagtatccaaaaacttttgaaggaaacagctagcatgaagttcatggattctgccgataatcagcgctcagcttctgaagacttaagtaacaaaaaagagaatctttttatggtacataaaagaaagggtggaagcagtaaaacaatgtatcatagtgaatggttggatactattgaccaacaacccgatgtcatatcgatgcatcttcttcctctgacatcacttttgttgaatatccgtggaaatggatttatgagccatgctataaatctctaccttcgctacaaacctccaattgaggacctccatcaatttttcgagtttcagctaccaagacaatgggcccctatacttagtgagatacgtcttggttcttactggaagcatcaaatgaatacctggctaaggtttagtatcttgggtcctaagctttacataaatacaattccagtagatgttggtaatagaccagtaattggcctgagattacaattggaagggagaagaagcaaccggttggccattcaccttcagcatctgacttctttaccaaagtccttaccactcgcagacaacgcaaatgcctatttgtcttgtgactcctatagctgcaatttccataagaaagtgaaatggagctgcttttcatatgtttgtaccgcaccggttgaatcggatgacagtctttccattgtcacaggagcccagttgcaagttgaaaagaagtgtctccttttacggctgcgcttctccaaagttatcggtgccacccttcagaaaccacctgagtgggatcaatcctccaatcttggcggtttcagcagcaagtccacgggcgtcttagcttttattccaaaagagggaaagaggggtcatccaaaaccgggtgatgtgaccattggttctactacatattctgctgcactacctgcaccagtgcgtacacctaagcttcaaaagtatgtggacataacggaaatgatgagagggcccgaagacactccaggatactgggttgtgtctggtgcaaggctttctgcacagaatgggaaaatatatctccttgttaagtattcactattgaactttgttatgcagtgtgaaacgaaagcttcatagcagtggtttaatgctcagttgaactcactttcaactttgttggatgtctcattttatgcagaggatacctcggttgaactttgttgtgatgctatgtgccaaaagttgca

SEQ ID NO: 67 - DNA, 1682 bp, Medicago truncatula
aaaaatcttatgccaccaattatctcccaaaaatgacttcttcctcttcttccaaatctcctcctttaatcccttcacgccattctccacaattcacaccaattcaagaggaacatgaatttgatgaatacagaagccaaagtagaagaacaacaccaacaagtgcttcaactccaaagcatcatcatcatccaccaacaccaatcaatatcaacaaaaacacaaaaccaaatcacaagaaaaaacgttctgaaactgaactagaagatggttctgtttcatgcaacaaatgcagaccacattctcgtgacaaaatctttatccttccctttgatcattccaacaacagcaacagtaacagcaagtattcatctttgttgcaaagtccaaatgggattttcaaatccattgtttcaaagctaacaagaaaaagtccaatgtcaacatcaacaacaaacaacaatgaagaacaatggaaaatggcagtggcagaactttctcacaaacttgttcatgccacaagaaaaagagatgaagctcttcaagaagcttcaaggctcatgaattcaatgtcagagttagagaaaaagttgaacaagcttgaaatttattgtcacactttgaaatctggtcttgaagaatgtaacattggttcttctaatgtcgttgctcagaagaattttcatcatcatgttcaagacaatgacaacgttgtacaacatttcttggtggctgtttctgaagcaagatcttcagtgagacttctaagtcgttcattaacaatgcaacttagacacacaggaagcaaagtgtatgaaaaagtttctttacttttacaaccttatgatataaaaatatctttttcaaagaatccaagaagtttgcttttttacttggaagcacttttgaacaagacattttttgaggattttgagtcaatagggtttcaaaagaatgcttgtaataggatattgaaccctatggaaaggtgtgaatcaagttttgcttcattcaacatgatacatgggttgacttgggatgaagttttgagcaaagggacaagacattttagtgaagattttagtagattttgtgatagaaaaatgagtgaaattgttgctatgttgggttggaatagggcttggtctgaaccactattgcaagctttctttgttgcttcaaagagtgtttggatggttcatttgttggctaattcagttcatccaagtttacaaatatttagagttgataaaggagtcaactttgattctgtttacatggaagatatgggtggggacaagtcttcaaggttggtaccaaacatggttaggattatggttgcacctggtttttatgtctatggtagtgctgttaaatgtaaggttctttgcaggtacttgaccaataacctcagcaacaacaaacaagacaaaggtttaaacccatcaccttaaataaacccattttattttttatttttaatgtggaattggaaagtgtactctatttggtttggaatttagaatttggatcaggttctattgttgttatgattcatggcttggttttttgttgttgatattttatagtatgtatttttcatgcttgagttgggatatgatatgtcggtatatggagtcaacgtgaacaatttggcattttatggttaccctttgttttat

SEQ ID NO: 68 - DNA, 2047 bp, Medicago truncatula
actcactcactcacacacatcaccaggatcctctcattcatattcacacacattctttctttctttctttctttatctctctctctctctctctctctctctctctctctccatttttgtttctttttagaaactaacaactcactccatccatcaatggcggttcctccctccgccactccagcttctctttacgtcggcgatctccatcccgacctctccgactctcagcttcacgatgctttctccgatttcaaaactctcgcttctgttcgcatttgccgagactcttcctctggtaaatcactctgttatggttacgtcaacttcctctcccctcacgacgcaattcgtgccattgaggtgaagaatcattctacattgaatggaaaagctattagggtgatgtggtcacgtcgtgatcctgatgcaaggaaaagttgtatagggaacgtgtttgttaagaatttagctgaatcaatagataattctggattagaggatatgtttaagaagtttgggaatattttgtcaagtaaagttgtaatgtctgaggatgggaagagtaaaggatatggctttgttcaatttgaaacagaggaatctgcaaatgctgctattgagaggttgaatggatatcttgttggtgataagcaaatatatgttggaaagtttgtcaagaaaagtgaccgcatatcgtctggcccggatactagatatacaaacttgtacatgaagaatttggacttagatatttcagaaacacttctgcgtgaaaagttttcctcttttgggaaaatcattagcttggctgttgcaaaggacagcaatggtatgtcaaagggttttggcttcgtgaacttcgataacccagaagatgctaaaagggcaatggaaacaatgaatggattgcaactaggttcaaagattctgtatgtagccagggcacagaagaaggctgagcgtgagcagatcttgcaccagcaatttgaagagaaacgaaaggaacaagtcttgaaatataaggggtcaaacatttatgtgaagaatattgatgacaatgttagtgatgaaggactgagagatcactttagtgtatgtggcactataacttctgcaaagattatgcgagatgacaaagggataagcaaaggatttggttttgtgtgcttctccactcctgaggaggctaataaagctgtgaactcttttcatggattcatgttccatggtaaaccgctatatgtttctcttgctcagcggaaagaggacagacaggcacagttgcagctccaatatgcccagcaaattgcaggactcgctgggccttcaactgccattgtccctggtggatatcctcctttctactacacagctactggtgttgtttcacacgcgcctcctcgtgctgggctcgtgtatcagcctatggcattgaggcctggatggagggctaatggctctgcacctcctgccagatcattccaacagtcacctacgcctgttgtttctaacaataatactaggcagcataggcaaaataggggtaggatgaatggccatgcagtatcacagggaaatactcactctggtacatatatgccacaagcccagcaggcttctcagtcagcgatctcttcaagagagtcaagtactcagcagagaactgggcaagctaagtatgtacctagtgggcgccaccgtgagatggaaaaaggatctggattatcatctagtggaggatccttgggaccagaagtgctgcatagcatgcttgctaatgctactccagagcagcagaaggagatacttggcgaacatctatacatgcttgtccagaaaatcaagcctaacctagcagcaaagattactgggatgcttttggagatggacaatgctgaattgctggttctcattgaatcaccagagtctctttctgccaaggtggaagaagctttccaagtgctgaagaactctaaagctaaagtttctggtcaggatgtacttcattcaaatttcctttcagctgaggttgctgtgaactaag

SEQ ID NO: 69 - DNA, 1296 bp, Medicago truncatula
cctgaataagtgtcgaaaacataacaatataaacaaaaacaccaattcgtttcccttttaaaactcctcaacattaatcacacttggccactcaactagcttctatagaatccagtgattatcataatcaccacccaccatggctgtggactttagctccatccccataattgatattagtcctcttttagccaagtcagatgatccaaaaatggctgaggatcctggtgtacttgatgttgttgcacaattggataaggcttgtacagaagcagggttcttttatgtgaaaggccatggcattcctgatagtcttcttaaaggggttcgagatataacgcgtagattcttcgaacttccatatgaagaaaaggcgaagatcaaaatgactccggctaatggtttcagaggatatgagaagattggagaaaatataactgaaggtgcacctgatatgcacgaagctattgattgctatagggaagtgactaagggcatgtatggagatcttggcaaagttatggaaggattcaaccagtggccacaaaatcctccaaagttcaaatttcttatggaggaatatattagcctctgcaaagatcttgccaagaaaatcatgcgcggaattgctttagcattaggtggatcaccatacgaatttgaaggtgatcgagctggtgatccattttgggtgatgcgtataattggttaccctggtgtatccagtgatgacattggatgtggagctcacacagattatggtttattgactttgttgaaccaggatgatgatataaatgctcttcaggtaagaaacctatctggcgagtggatatccgcacctccagttcctgggacatttgtgtgcaacattggcgacatgcttaagatatactccaacggtttgtacgagtcaactttgcatcgggtgataaacaactcctcaaaatatagagtcagtgtagtatatttttacgagacaaactttgatgctgcggtagagccgttgaatacatacaaaacaccgataaatggtgacaagaagtttgaaagagccatctacggagagcatctagtcaagaaggtcctcacaaattttgttgatgggtgactgtttttctctttctagtgaataataagttaagcatcttgtatgttgataagctcctgcttgcatgtccaaatctactaagaataattttaagtcaaaatcaagtgtttattatctatcaaattattaacgtcaaatacaacacagagacaaacacaaatttgtccgctaagcaaaagaatctg

SEQ ID NO: 70 - DNA, 662 bp, Medicago truncatula
attttcattttcattttgtgataaaaaataaaaagaagctaagagaagaggcatatccagaatcaatcaatcaatcaatcgaacatgaacatgaacatgactagcatcacttcttcaattgcaacattggtgactccgttaccgttgttcatgaatacgaagaacaagattcagagcagaagcagcaaaatgactcggataagatgtgatgttggagaagaagattcatcatcatcaacagcgaagattggatcgcgtgttagggttaaggttcctctcaaagtctatcacgttcccaaagttcctgaagttgatctaactggtagagaaggacaaatcaaacagaacgtgactttctggaaagataataagcgaatctctgctaatcttccttataaggttgagtttgttgctgatgatattcaaggtcctcgtggtcctctcaagttcgttgctcatctcaaagatgatgaattcgaatttctagaatagagtatttcataaataattacgcatatcaattactacattagagagaggtattcatgttatctcatctcttctttaatcaaattctgtcaactatctatctattactacattttcactatcatttttatttttagtgtaaacactccaattcagtctccgactgaacacaa

SEQ ID NO: 71 - DNA, 1809 bp, Oryza sativa
agtacacacactccacctaatcttcttctcctcacacattcacacacacacaccccgcagaccccggcaccttaccgagcggcggctcagcacgctgctgctacgcacatggacaagagccagggagtcctactgtccagcaacgtcggggccggctcccggccgtggccggagctgctcggctccgcccactgggacggcctcctcgacccgctcgacctcacgctgcgccgcctcatcctgctctgcggcgacctctgccaggtcacctacgactccttcaactccgactcccactccaagtactgcggcacctgccgcttctccaggtccacgctcctcgaccgcacgcagttcccggccgccggcgacctctccgtcgccgcctacctctacgccacctccgacgccacggcgttcccggggagcatggtgtactcgatgtcgcgcgaggcgtggagcaaggagtccaactggatcggctacgtcgccgtgtccaacgacgccgcagcggccgcctcgggccagcgcgtcatctacgtcgcgtggcgcggcaccatccggtcgctggagtgggtcgacgtgctcaagccggacctggtcgaccacgacgacatcctccccgaggggcacccggggcgcggccggtcgcgcgtcatgaaggggtggtacctcatctacagctccaccgacgagcgctcccctttctccaagtacagcgcccgcgaccagatgctcgccgccgtgcgcgagctggtggcgaggtacaggaacgagagcctcggcgtcgtctgcacggggcacagcctcggcgcgtcgctcgccacgctctgcgcgttcgatatcgtcgtcaacggcgtgtccaaggtcggcgacggcgcgcacatcccggtgaccgccgtggtgttcgggagcccgcagatcgggaacccggagttcaagaagcagttcgaggagcagcccaacctgcgggcgctgcacgtcaggaacatgcccgacctcatcccgctctacccgagcggcctcctcggctacgccaacgtcggcaaaaccctccaggtcgactccaagaagtcgccctacgtgaagcgagacaccagcccaggcgactaccacaacctgcaggggatcctacacacggtggccggctggaacgggaaggacggcgagttcaagctccaggtgaagcgcagcgtcgcgctggtgaacaagtcgagcggcttcctcaaggacagcaaccttgtgccggagtcatggtgggtggagaggaacaaaggcatggtgctcggccagaacggggaatggcagctcgaggggcccgcagaggagaacctgcccgtgccaccggtggtgaccgggaagatcatcgacgacgacgtcgctgccgtggccacctccagcagtgccaaggaggataagaagacgggcaaagggtctaagcttctgtctggattgattgatcaactgctttgtgtgcctgatacatgtaaagccggagctgcgtgagttgttgaagaccacatcagaaaaagactcgagagcggtggcgtcgaactgatatgcttgtgaagtagctggagcttgggagttgggagcgagctagattacaacaatgtcatttatcggtttttctttggaataaaatgagttgttttgttaggagaaagtagtatttttcctttctgcttttagtgtctcttgagaaagaataaaatgagtcctggcatcataagtaggtgggttagtcgactaggttcgagcctcaccacatctcaataaatatcgatatgtgacccctcctttcatatc

SEQ ID NO: 72 - DNA, 1433 bp, Oryza sativa
ctctgatcaactggtgagtttggagtagggcatagattcttggagaactgggcaaattttggcatggattctggtgctgctgccgtctgcgcggagaaggcgagtgagatcatcaagatcggtcaggttgatgacgtgcaggagctgcagcgacgactgtgctccgccaccaccgtgccggagcggtacatcagggacggcgacgaccggccggatcacgccgtcgtcgacgacgagcgcgcgcaggagcggattccggtgatcgacgtcggcgagctgcagcgcggcagcgaggacgagctcgacaacctcaggctcgcctgcgagcagtggggcttcttccaggttgtgaaccatggagtggaggaggagacgatggaggagatggagaaggcggcgagggagttcttcatgctgccgctggaggagaaggagaagtaccccatggagcccggcggcatccagggctacggccacgccttcgtcttctccgacgaccagaagctcgactggtgcaacatgctcgccctcggcgtcgagcccgccttcatccgccgccccaacctctggccgacaactccggccaactttagtaagacgctggagaagtactcggtggagatcagggagctgtgcgtgcggctgctggagcacatcgcggcggcgctggggctggcgccggcgaggctgaacgggatgttcggggaggcggtgcaggcggtgaggatgaacttctacccgccgtgcccgcggccggagctggtgctggggctgagcccgcactccgacggcagcgcggtcaccgtgctccagcaggacgcggcgttcgccgggctgcaggtgctccggggcggcggcggctgggtggccgtccatcccgtccccggcgccctcgtcgtcaacgtcggcgacacgctcgaggtgctcaccaatggcaggtacaagagcgtggagcaccgggcggtggccagcggcgagcacgaccgcatgtccgtcgtcaccttctacgcgccggcgtacgacgtcgagctcggcccgctgccggagctcgtcgccgacggggagccgcgcaggtaccggacgtacaaccacggcgagtacagccggcactacgtcaccagccggctccagggcaagaagacgcttgaatttgcaaagatttaagttgatcgattgatcaccgagtaattcagtataattaatcaacctaaaaagatcaattatgttgacacaatacttgcgtttgagttattgtttatgataatctgaagtatactaatgttactatactctgaagtctgaagaagtattgtactatgtctggtgtatgtactagtattccacaaaaatggacaagcataatttgaacgattttcataatcatttggtattcaatatttcatctacagtgctggataagatgatcagcacta

SEQ ID NO: 73 - DNA, 1610 bp, Oryza sativa
cccgattcccttcgcttcctactccttcctcttccttgttccttccttccttcctcaccccacgaacgcgcacaccaacctttcccatccctagctgctgcccttccatcggatccacggatcgagacctggcacggcggcggaggacgggccggcggagatggaggtggaccacgcggaccgcgacggcgcgcggcgccggtgccgcgagtacctgctcgcgctcgaggaggagcgccgcaagatccaggtgttccagcgggagctccctctctgcttcgacctcgtcacccagactatcgaggggatgaggagccagatggacgccgccggcagcgaggagacggtcagcgaccagggcccgccgccggtgctcgaggagttcatcccgctcaagcccagcctctcgctgtcctcctccgaggaggagagcacccacgccgacgccgccaagtcaggcaagaaggaggaggccgagacgtcggagaggcattcgtcgccgccgccgccgccgccggaggccaagaaggtgacgccggattggctccagtccgtgcagctctggagccaagaagaaccccagcagccatcgtctcctagcccaactcctaccaaggatttaccgtgcaagccggtggcgctgaacgccaggaaggccggcggagcgttccagccgttcgagaaggagaagcgcgccgagctgccggcgtcgtcgaccacggccgcggcgagctcgaccgtggtcggagacagcggcgacaagcccaccgatgatgacacggagaaacacatggagacggacaaggacaacgacaaggacgccaaggacaaggacaaggaaggccagtcgcagcctcaccggaagcctcgccggtgctgggcgccggagctccaccgccgcttcctgcaagcgctgcagcagctgggcgggtcccatgtagcgacgcccaagcagatccgggagctgatgaaggtggatggcctcaccaacgacgaggtcaagagccatttgcagaagtatcgtctacacacgaggaggccgagctcgacggggcagagcagcgccgcagccggcgtccccgccccgcctgcgccgcagttcgtcgtcgtcgggagcatctgggtacccccgccggaatacgctgccgcggccgccgcacagcagcacgtgcagcttgccgccgccggcaataatgcgtccgggagcgccaaccccgtgtacgctccggtggcgatgctgccggcaggcttgcagccgcattcgcatcggaagcagcaccagcagcagcagcaaggacagagacattccgggtcggaaggccggcggagcggggacgccggcgatggcagctcgtcctccccggccgtctcgtcgtcgtcgcagaccacctccgcttgattagtgtagattcgtcgattacatcattatatgtacgtagtacgagagtgcatcacatcaaagtgcagcttgattttggagctagctagcttaaattaagggttaattactgattgcttcgtgatcgcacacaccacatttgctgttttgtttgtaaaaaagataataaaatacataaatattaaggaaactccatagacattattctccc

SEQ ID NO: 74 - DNA, 1576 bp, Oryza sativa
cttccttccactcgtctcgccattaacaagaattctttttttccttcccccaaatccttctcgagcaacagctaggggggagtggttcgcttcgtaagaagccggctacctctgctcgatcccgcctttgcctgcggattcccaccctgattttcgccgtttgtttgtttagtttcttggggcaaattcgagacgaggggaggagagtttttttgggggggagttgttgcggccttgcgggcggggtatgcggctgcacggggaggtttccttcgatgaggacgaggaggaagtggtgatggttccggcggcggcgctgtcgtcgtcgccgctcaacggcggggccgttccggtgacgaggctcgtggtggggtacgccctcaccaagaagaaggtgaagagcttccttcagcccaatctgctgttgctggcgaggaagaagggaattaatcttgtagcaattgatgacactcgcccgcttgcagaacaaggcccatttgatgttatcttgcacaagattactagcaaggaatggcaacaggttctggaggattatcatgaggaacatccagaggttactgtccttgacccaccaaatgccatcaatcatctgaataatcggcaatctatgcttgcagaagtatctgatttgaacttatccagtttctatggagaagtttgcactccacgccaactggtcattatgagagatccatcctctataccaaccgcagttgccatggctggactaaccttgcccttggttgcgaagccattggttgttgatggaacatctaaatcccacgaactatctcttgcatatgatgaggcatccttatcaatgcttgatcctcctctggtcctccaggaatttgtgaaccatggtgggatcctctttaaggtgtacatcattggtgaaactatacaagttgtacggaggttttctcttcctgatgttaacacttatgacttattaaacaatgttggcgtctatcgatttccaagagtttcatgtgctgcagctagtgcagaccatgcagacctcgatcctcatatctcagaacttcctccaagaccactcctagagaaactgggaaaagagcttcgtggaagactgggtttaagattgttcaacatagatatgatcagagaacttggaaccaaagatcggtactatataattgacatcaactacttcccagggttcgggaaaatgccaggttatgagcacatattcaccgatttcttgctgaatcttgcgcaaagcaagtacaagaagtgcttaagcggcggctgaagtgcaaagagtcctgctgaacattaacaaaatggaatgtaacggtctagcagtcagtgtacatatctcggagaaataagtttaatcccaaggctttgaggaagagagatttagggtgtcttcccagaaaatggtggcacttaccggattagagaagagatgaaaaaatggatcgattttctaatgccgagtgcttgtataaatcactaacactgaatgttcccagcgtgccttcgtcaaggcttctgtctcaataatttcattatctttttcatgagc

SEQ ID NO: 75 - DNA, 2489 bp, Oryza sativa
acttgtcatccctaaaactctcctggtccccgcctcccgcaccacgccgtctccgatcaagattcttccctgatccccttgctgctgctgccatcaaatccttggacatttccagttgcaaatttagactcttcccccgcgattcccagcactcccaagtcccatccttcccgctgccccatcccatcccactatctccctaaccactgtgatttaaccaccgaggaggcggcaagaatcgtgtccagctccgcaccgttgttaggcgggagtggagtggactggttatcgtccacgcaagacgacgacgacgacgacgacggccggagctcgccggagcatcggtgtcagagatgagggtcatgaagctcggaaataggccggacaccttcttctcgtcaggccccgtcaggtcggtctccacggatttggccactgacatgcagattcttgtggatggttgcctgtttcgtctccacaagtttcctttgctttccaagtgcatgtggctgcaagcgctgtgcgtggagtccggcgacggcggcggcgccgtcgagctgccggctttcccgggcggcgcggaggcgttcgaggcgtgcgccaagttctgctacggcgtggccgtcacgatcgggccgcacaacgtcgtcgccgtccgctgcgccgccgcgcggctcggcatgtccgaggccgccgaccgcggcaacctcgccgcgaagctcgacgccttcctctcctcctgcctcctccgccgctggaaggacgcgctcgccgtgctccactccacgcgccgctacgccgcgctctgcgaggagctcggcgtcacgtcacgctgcgtcgacgccgtcgcggccctcgccgtcggcgatgcctccggcgccgttccggccggttcgtcttcgtcgtcgccgccgtggtgggcgcgtgacatctccgagctcggggttgacctctactggcgcgtcatggtggccgtcaaggcgaccggcaccgtgcacgcgaaggccattggcgacacgctcaaagcctacgcgcgtcggtggctgccgatcgccgccaagaaccaccacgcggcagagcgaaccgccggcggcggcggcggcggcgcggccaatgccgagcgggccaccaagaaccaccgcctcctcgtcgagaagatagtgagcttgctcccggcggagaggaacgccgtctcctgcggcttcttgctgaagcttctcaaggcggcgaacatcctaggcgcttctccggcgtcaaaggcagagctcacgaggagggtggcgtcgcagctggaagacgccaacgtgagcgacctcctgataccggcgccgccgccgtgcgcgggcggggtgctgtacgacgtggacgccgtggtgaccatactcgaggaattcgcgctgcggcaagcggcggcgtcggggagcccgaagggcagcccggcgcgcgcgggcaggcaccggcgatcgatgtcggccgagagcggtgagctcgagggggcgcgccgttcgacgtccatggcggcggtgtcgcacggcgcgatggtccgggtggggaggctggtggacgggttcttggcgatggtggccacaaaggacgcccgcacgccgctcgacaagatgatcgccgtcgccgaggccgtgccggacttcgcgcggccggagcacgacgatctataccgagccatcgacacatatctcagggcgcacccggagatggacaagagctcgaggaagaagctgtgcagggtgctcaactgcaggaagctctcggagaaggcttccatgcacgcggcgcagaacgagctgctccccctccgcgtcgtcgtgcaggtgctcttcttcgagaacgcgcgcgccgccggactctcgtccgggcacggcaaccgcgtcgccgcgcgctttcccggcgacggcggcgacgtcagtgcgctgcttggcactggcaggccaagaacgacggaggagaacggcaaggacgggcagagccccgccgccgccgggagcgtggcggcggacggcgactggagcgtggaggggctgaggcgcgcggcgtcgagggtggcgacgctgaagatgaggctggaggaggaggacggcgaggacgccggcgacgaggcgttcgtgcataggacgcgcgcggggttggcacggagcgcgtcgtcgcgtgtcacggcggcggcggggaggtccaagcggatgctgagcaggctatggccgacgagcagaaccttcacctaaggggcatcaagacacttgagcaaagctgatccgtacataccgtgtacaaatatgcttgaatttgtaagtaaaatttgttccctcgagatttgattttgttccaactagttcttgaagtttggggaagttgtgtgcacagatatgactgcgtgtacactccctccatttttttaaaaaaaacattttgtaaggacgaatatgaacaagggtttatccaaattaatccctaaaaattaatttgttttggacaga

SEQ ID NO: 76 - DNA, 1486 bp, Oryza sativa
gagaattgttagatttaggtctcccccatatccccattcccatctctctctctcgagtctcgacggcggctgctgctgcggcgtcgcctgcggtgcgatgtcgtcgtctccggcgcatgctcagcgcttctactgccaccagtgcgaccgcaccgtccccatcccgccgcccacctcccccgacgccgacgtcctctgcccgttctgcggtggaggcttcgtcgaggagcttggggaggacatcaaccccaaccccaaccccaaccctagccccttcctgccacaccaccccttcttccccttcgcctccccatccttcgacctccgcaaccctagcgacctcgcggccttcttcgggcccccctccccctccccctccccctccccagccgccaggcacttcgacccctccaacttcctccatgatcacttcaccggcctcctctctggcggcgccaccatccagatcgtcctcgagggctcctccgcctccctccccctcgggggcgccgccgccgggcccggggggatcagcctcggcgactacttcgtcggctctggcctcgagcagctcatccagcagctcgccgagaacgaccccaaccgctacggcacccctcctgccgccaagtccgccgtcgccgcgctccctgacgtcgccgtctccgccgacatgatggccgccgatggaggggcccagtgcgccgtctgcatggacgacttccacctcggagctgccgccaagcagctcccctgcaaacacgtcttccacaaggattgcatcctcccctggctcgaccttcacagctcctgccccgtttgccgcttcgagcttcccaccgatgaccctcaccacgcccacccaacccttggatctcaccgccccgccgcacccgcctctgcctctgcctctccctctccagctccaccacctaggctggctgagagaaggttcaggatatcgctgccatggcctctccgtgctgcgtttggcggccaggcggagagcagcaatcctaccaatcaggatcctgttggtggttctactgatgcttccggttctggcaacaacaatgcaactggaggtcatcgtggctacgatgatcttgactgaagagcatcggacaaagaggggatgaggaggggcgagggacattgtttggagaagaggtgcgccgcggcaatgaagctagcctattccgttctattcacctatcaatgacgagaagaaatgttggattttttcccccttccttaattgtggcatggatttactattgctggttttggggtcctctggtggtgtagagaattttctatgggggcccttttcttggtgacatggacatagactggtggtgaaaaaaaagaaaggatggtggtggggatgttatacattttaagtactatatgttacttgtcatatatacatatctgggagatctgaaagctttcctctgattgctggcgttggcgagctaaacaa

SEQ ID NO: 77 - DNA, 1485 bp, Oryza sativa
accttcactagctccccacataccaagaacagtgtcactctagcttcttcctctttctctctataaatcttttcccgagccaagaaaaccaccattaaacccaccaccaccgccacctcctccacctccatggcgatggcgatgcaccggttcagcctctgctgcgtcgtcctcctcgtgctcgcgccgctcgccgccgtcgcgtggcggccgtggccgccacggaatgggagcggcgaggttgaggggatcggggcgtccaagaagttcgaggggtcgtcggatttcgtcaagctgcagtaccacatgggccccgtcctcgccgccgacatcacggtccacccgatctggtacggccggtggcccgccgagcagaagcgcaccatccgcgcgttcctccggtcgctctcgccgccgggctcgggctccggcgatggcggcatcccgtcgccgtccgtggcggcgtggtggcgcaccgtgcggctgtacaccgaccagacctcggcgaacgtgtccggggtggtgaggctcgggcgggagaagtgcgacgcgcgcgcgtcgcggggcgggcggctgacgcggctcgacatccagtccgtggtgcgggacgccgtgacggcgcggacgcggccgctccccgtggactcgagcggcgtgtacctggtgctgacctcgccggaggtggtggtggagaacttctgcgggcaggtgtgcggcttccactacttcacgttcccgtcggtggtcgggtacacgctgccgtacgcgtgggtggggaactcggcggcgcggtgcccggaggtgtgcgcgtacccgttcgccatcccgtcgtacgtgggcggggggcggagggcggaggcgccgccgaacggcgacgtgggcgtggacgggatggtgagcgtcatcgcgcacgagctggccgagctggcgtcgaacccgctcgccaacgcgtggtacgccggcgaggacccgtcgttcccgacggagatcgccgacctgtgcgaggggatctacggcaccggcggcggcggcgcgtacaccggccagctgctcaccgacggccgctccggcgcgtcgtacaacgtcaacggcgtcggcggccgcaagttcttggtgcagtgggtgtggaaccccatcctcagctactgctccggccccaacgcgctcgaccagtagccgccgccgccgccacgcacgaacgcagtgttcgtccgcccatggattcggattccttttcttgggaatccatggtagctttaaattcttgtatagatcgagccggtgaagtgaacaagggtggcgatgtttggggttttgggtgactttgggtgaatggatggtatgtttgggggagactgtttggaactttgagattattttgcttaccaccatggctcaaatgctcaattcgtttgtttgagttcgttcttcttgaactaagtttgaattcgaactcagcaatttggcattgcaacaggtaaaatt

SEQ ID NO: 78 - DNA, 1850 bp, Oryza sativa
cacccccccaccccccacaattttttctccttttccactctcacaccccgcctcctcttcctcgtcacttcccaatccaaaatccaatcgcggggttgccaaaccctaaccctaggcaccgctcgagggaggcggcggcgatggccggcgaggggagcggcggcgagggcggtgcgggcgccttcgaggacgaggcggagccgacggtcaccatcggggagtacatcgaggggatcgaggccgaggagctggaggcggatttggtgctgggcggggacgacggcaaggagtgcacctacggcggcggctacctcaagcgccaggccgtcttctcctgcctcacctgcgtgccagcgggtgtcgctggagtctgcaccgcctgcagcctcgcctgccacgacggccatgaggtcgttgaactatggacaaagcgaaagtttcgttgtgattgtggcaactcaaagtttggaagtcatgtttgcaaactttgccctgagaaagatccagagaatccagtgaattcttataaccataacttcaaagggtcctattgcacatgtggcaggccttatcctgatccagaagctgaaaagcaagttgaaatgatacaatgctgtatttgtgaggattggttccacgaggatcatattggtcttaactccattgaagagataccacgagatgaggaaggggagccactctacgaggatttcatatgccccaaatgctcacctaagtgctatttcttgaaattatatccggatactatttgggcatctaataagcagagttctgcaccacaagctgagactaccaattcaactgttatgaatggaaattcaagccttggtgacatagagaaaagtgaaaatggtgctcttataaatcatttgaattgtgaaaagacctctgacaatgagaattgcccaaaagacagtgtagctccagaaaaggccagtctggatgacagttctgatggcaaatgtaagctaggaatgaacatttgttcaaatacaccatcagctgattcagagaaaaagatgccgttttttatgtcaaaaagctggagagaggttatctgtagatgtgaaacttgcaccgacttctatgcacaacaaggtgttgcgtaccttatagacaaggaagactctattgaggagtatgagaaggttgctaagcagaagagggaaaagaagttggagcagcaggaaggagttgaagcaaactttcttaattcactcgaccatgtacagaagattgagattttgagtggcatcaatgacatgaagaatgagcttcagtcttttctggaaacttttgattcatcaaaaccggtcacatctgaagatatacgagctgtttttgagaatcttgctaagaagaaaaaacagaggttgtcatgaaactcagctgcttggggttctgtttgagactaatatatcccactgccggtcgatcgagcagtttttctggccactcccccgtgaatttatcgttcgctatgtcatggctattgtgtcctgttacctagcttgtactcgacttctaatgtagttagcagaggtagtaatgctaaatgctccgaactgagcttctggtagatgctccagggcagcagaacaaaatgtttgctcctttgtatcaaatcaaaagaactttgtgacgtggtaatttacattacccaaaaccgtgtaaccctttgtgccgctcctttaatcatctgttgcctatgtgctatttgtgcttacagatggtaaggggaggaacttggaaacggttgcaacttggaactactgcttttgggtcttagcgtgaagggcatttgggcatttggctagtttagttggagc

SEQ ID NO: 79 - DNA, 1753 bp, Oryza sativa
cctcccgaaggttccactgaatcatcgaatccctctcctctcctcactcgtgtgtttccctccactccttcccgccacaacggataacacctcacttcctcaacactcaacacagcagagcagcgcaaaacagagcagaccaagagcaaggagacgacgacgacgacgacgatgcaatccctcctctcctcctcggtgctcgccaacccatgcaccaccggctccccgctcttcccgccgaccgctgctaagctcgccgccgctgcctcggtcccggtggccgcggcggcgaggagtggcgccattgctgccgtgtcgaggagatcggccagtggcggccggtgcgtggtggcggctgcgtcgtcgtcgtccccggcggtgaccacggcggaggccggcgaggtgcccgcgacgatgaaggcgtgggcgtacgacgattacggggacggcagcgtgctcaagctcaacgacgccgcggcggtgccggacatcgccgacgaccaggtgctggtgcgcgtcgccgccgccgcgctcaaccccgtcgacgccaagcgccgcgccggcaagttcaaggccaccgactcccctctcccgacggtgccggggtacgacgtggccggcgtggtggtgaaggccgggaggaaggtgaaggggctgaaggaaggggacgaggtgtacggcaacatcagcgagaaggcgctggaggggcccaagcagtcggggtcgctggcggagtacaccgccgtggaggagaagctgctggcgctcaagcccaagagcctcggcttcgcgcaggccgccgggctgccgctcgccatcgagaccgcccacgagggcctcgagcgcgccggcttctccgccggcaagtccatcctcatcctcggcggcgccggcggcgtcggctccctcgccatccagctggccaagcacgtgtacggcgcgtccaaggtggcggcgacggcgagcacgcccaagctggagctcctcaagagcctcggcgccgacgtcgccatcgactacaccaaggagaacttcgaggacctgccggacaagtacgacgtcgtcctcgacgccgtcggccagggcgagaaggccgtcaaggtggtgaaggaagggggcagcgtggtggtgctcaccggcgccgtcgtgccgccggggttccggttcgtggtcacctccgacgggtcggtgttggagaagctcaacccatacctggagtccgggaaggtgaagccgctggtggaccccaaggggccattcgccttctcacaggttgtggaggccttctcctacctcgagacagggagagccaccgggaaagttgtcatctcacccattccatgagagcttgacatcaatggcagagcttatgatggtctctcgcacctgagattctgattctgaagtgtgtcagcatagaccaaaatgaagtttatctcatattacagttcatagagttacactgttacacaagttgtatgcactgtgatgaactgctgagcaatgtccacaacccctctctagcaatgtccagttgatttgaacaggcaggtggtgccccgaatgtcccaatgttacatgagttttgctatgtaagggaaggaacatcgatataccgcgcctcagttcgtcttgaaagggctgaaattttcgctgcagttcatctcagtaggtattatgatgtgttcattgcttgggagacaatctgattgggcagattgcaaatgccatgcggcgtgcagcgaaggccagt

SEQ ID NO: 80 - DNA, 1300 bp, Sorghum bicolor
ggcgacgggcgaacaaggacgcagccgggattggaccccccccatcgacgggggcagcccgcagcccatcggtttcgccgaccggcgcctcgttcgtatcgactccactcctccctcctctcgagcacccgcaggccgccgcccgctataaactggactaggcccgtggatgcggcaccgcctgctccgccgcgcgatgccgatccctccgccgccgcaatctccccggacgccgggggtcgccggcgggcgtctcttcgcttcgctcccgctgccgccgccgctccagtctcgaagagaggtgcatgtttggtatcttttgcctgatgagttgaatgatgcctccctactgaagatgtacacggagctcctttccccttctgaaaggaagactgctttgtcaatgaacggggaaaagttgcagaaaggtgctgtgctgtcccgtgcactggtgcgcaccaccctctcgagatatacagattgtaaagttgatccaagatcatttgagtttaagaaaaacaagtttggcaaacctgagatactgtggcaatctgatgacagcaggatggaatggcctttgcatttcaatatttcacacacatcttctttgattgcctgtggcataaccatggatgctcctattggcattgatgttgaagacaagaaacgaaagacagccaagaatattctatctcttgctcgccgttatttcaccccatctgaaattgattatctagctaaaattccagatcctgatggtcagcaaaaggagttcataaaactatggactcttaaagaagcatatgtaaaagctctcggaagggggttttcaggcgctcctttcaacaaattctcgatcatcttggcagcaaataacagaatcaaaatttctgtggcaccaaaagcattcaatgattctgactctagctgtgactgtctgtccgagaattggcaatttgcagttgctgagctaaatagttctcattacatggcaatctgtacagaggatgactcaacaagttcagattctggaaacggcagactgccactaggattgaaagtatggaagaccattccattcgttgaagatatacttgtttcgggaacagaagctgtaaaacttgtcagttgagtatgtgagaggatctgctattggtctattaatgatttcaccagatgacacattgtggtgcaacgaatatatttggacaaagtatgcatggagactgaacattcttggagcatatattcatcaactgaccactgacactgtgctctaattaagccttgggaaatgcaa

SEQ ID NO: 81 - DNA, 2162 bp, Sorghum bicolor
cgggagaggagtcgagagctgagacggcgagctgcctccgatcctgctctatatcagctcagcttcgttctgctgtggctctgagctgagccgccaaggatacatacgatacgatacgtcttgcagctgcgggttgccttcttctccggtggacctcgtcggggttatgcggaggagctggtcgtgcttgtcctgcttgcccatggggacggcggcgctgcccattgaggaccgattcgttcctccggctgggctaccggcggtgcccgcgtcaggttcagaagatggaggatttggcaagggcagcatagaccttggaggcctggaggtgcgccaaatcaccacatttgccaaggtctggtccaccacgcagggcggccaagacggcctcggcgccaccttcttcaagccctcgccggtccccgccggcttctccgtgctcggccactacgcgcagcccaacaaccggcctctcttcggtcatgtcctcgtcggtcgggacacgtctggcaccggtgcagtcctcgccgcgccactggactacgccctcgtctggtccagcccggacggcgccggccacttctggctccccacggcgcccgaaggctacaaggccgtcggcgtggtggtcacagccgcggcggacaagccttcgcccgacgaggtcaggtgtgtccgttccgacttcaccgacgcgtccgagatcgaggacacggtgttgaccagcgacaaggatggcttcagcgcggccaccctgaggccggcggtccgcggcatcgacgcccgcggcgtgcacgctggcacgttcctcgcccagagcagcgcgacgccggcgggagcgtcgacgacgccggcgtgtctgaagaacaacagcgcgagctacacgtccgccatgcctgacctggcccaggtgaactcactcctggcggcctacgcgccgcacgtgtacctgcacccgaacgagtcctacctcccttcgtcggtgacgtggttcttcgagaacgacgcgctgctgtaccagaagggcagccagaccccgacgccagtggccgccgacgggtcgaacctcccgcaaggcggcggcaatgacggcgggtactggctggacctgccggtggacaacaaccagagggagaaggtcaagaagggagacctcgccggtgcgaaggtgtacgtgcaggcgaaaccgatgctcggcgggacggtgaccgacctcgcggtgtggatcttcttcccgttcaacgggccggcgcgcgccaaggtcggactcatccagtcgatcccgctcggcaagatcggcgagcacgtcggcgactgggagcacgtgacgctgcgcgtgagcaacttctccggcgagctgctccgggtgtacttctcgcagcacagcgcgggcacctgggtggacgcgtcgcggctggagtacctcgccgacggggacggcgggaacaggccggtggcgtacgcgtcgcagcacgggcacgcgttctacccgaacgccgggacggtgctgcagggcaacacgagcctgggcatcgggatccggaacgactgcgccaggggtagccggctggacaccggcgccgggcggtgcgaagtggtgtcggtggagtacctcggcgtcaaggagccggcgtgggtcgggttcgagcgcgagtgggggccgcgggaggagtacgacatcgggcgcgagatcaaccgcgccgcgaggatcctgccgcgttcggtgagggagcggctagccaagctggtggagaaggtgctcgtcggggaagggccgacggggcccaagatgcatggtaactggagaaacgacgagaaggaagcctgacagcagattaaggattgcctgcagatgcatggtaaccgtgcaattcgtgaggaatatatatacggatcagacggttcgcgattgaccgacagcagattaaggattgcatgcatgctgattattagaggaggtaaaaggattggttgtgttgtgttgtgtatttcgatctcagctgtatgtattcgatgatctcttgtttggtttgctgtttattgctttgtatacgaccatgtgagatcttcatttgtaagcacgagcttcacaatttgaacaaaagtgtaatgtaccgtggggttttttaaaatttttccgcattcttattttaaactttttc

SEQ ID NO: 82 - DNA, 654 bp, Sorghum bicolor
ataccataccatttctcctctgcttcgtcgtcccaacccaaccatcaccatcactaattaagctattactactactactaatcggctaatcgccgtgtgctggaggtcatcatctcccccaactcctctgcctctcgatcgaccgccagggagcaagaggccggcccggccacccacccatagcctgcctggtagccatggaccggtccaagtcgtacgcgggcgggcgcatgcagatcgagccgtactacggcggcggcggcgcgcggccggacttccggtcctactcgtacagcgccggcgggggcgggatggggacgtcgtcctactcctcctcctcctactcgtaccagtacgagtacggcggccctgcggcgggggcggcggcgggggaggaggtgaagcggagcaagtcgaagcggcggtggctggcgctggcggacccggacatggatcgcaagcgccgggtggcggcgtacaaggcgtacggcgtggagggcaaggtgaagggctccttccgcaagagcttcaagtggatcaaggaccgctacctcaacctcgtctacggatggtcctgatgatgatactccatgggtttttttttgggggggctctgcctcctctgtcctctctcttctttttcatgcttgcagt

SEQ ID NO: 83 - DNA, 1219 bp, Sorghum bicolor
cggcctcggcggctgattttctttgccctttcttctctccgacgatatcggcggcagcgaagtgtaggccgacaaaatcacggtagcagaagcagcagacaggaggggaagatgtcgtcgctgcggaatgcgatcccgcggcgcgctcacaaggagcgctcccagccggaggcgaggaagaagtttgggcttttggagaagcacaaggactatgtcgtccgggcgcgggcttaccacatcaaggaggcaaccatcgcgaaattgaaggagaaggcagcatttaggaacccggatgagttctactttaaaatgatcaacagtaggactgttggtggaattcatagacctaagcctgaagataataagtatacagaagaggaacttcttctgttgaaaaataaagatatgggatatatccttcagagcattcaaagtgaaaaaaagaaaatcgaaaagttaagctcaacacttcatgaactggataacaagcctcaaaacaagcatgtttattttgctgaagacagagaagaagcgaaagaaatacaatcaaggataggacaaagcaacaacatgcctggtcttgacaacatcccttctcgtataaagaaaaaaacagcctcttcatacagggagttagaagagaggaagcagcggcttcaaaagcttgagaaattgtatgcagacatggcattgcaaaaagaattgaagaaacctggacgcaagaggaaactgaaactcaatgaagatgaggagacggataatcaaacatcacagcctgtttataagtggcgagcacagaggaagcgatgatatgaatgggtgacagagtaaggaaaaggcaaggcattagtagtggaagcatggtcatagtggcgtacttgctggcgattgatcagctctttttcgatccaaaaagacttacctgcaaaagtagccctccgcaagaactactatggctttgtcaaactgttggagtgttgggaaaaaagaattaggataagatgtaagagtaactttaatttatacaagatcagattctgtatgattcaatcctatgtatcatgtctcaattcattgctctctatgctgttgaattcacctagtgatgtgctgttgaattcgacccaacatcaacatgtatcatgtcaaactattgaatttgatccaacaccaacatgtataataccgttgggcttgaccacagttttttatgcacaaa

SEQ ID NO: 84 - DNA, 2059 bp, Sorghum bicolor
gctctccatataatttccaaactccagtctcgatctaatctaaagagcatctcaaaaggaagatagcatcgtcatgagaccggaaggcgcagcgcggttggcgtggctgctcctgctcgccgccgcggccgcggggcatggcggcgtgcagccgctgtcgcgcatcgccatccaccgcgcacgcgtcgcgctggacgcgtccgccgcggtgcgggcctcgccggagctgctgggaaccaagggcgaagatactgcctgggtgaacgttgattttattactccccatccaagtgatgatgattggatcggcgtattttctccttcaaacttcaacgcgtccacatgccctggttctcacggatctggcccaggtcctgtgatatgctcagcaccaataaagtatcagtttgcaaattactcatcagattttggaaagtctgggaaaggggcactgaagttccagctgatcaaccagcggcaagacttttcatttgcactgttcaccggtggactctcgaatccgaaacttattgcagtgtcgaatgccattgcttttgcaaacccaaagtctccagtttatccacgcctagcacaaggaaaatcctggaatgagatgactgtatcatggacaagtggctatgatataaatgaggcatatccctttgtcgaatggggaataaaatggagccccgcggtacgcactgcagctggcaccgtcacttttgatcgtgatagcatctgcggagaacctgctcgatctgttggttggagagatcctggtttcatacacacagctttcctaacagacttatggccaaataaagagtactactacaaaattggtcatatgctgccagatggaaatgttgtttggggcaagttgtcgtccttcaaggcacctccttatcctggacagaagtcgctgcagcgtgttgttattttaggagatatgggaaaggctgagagggatggaagcaatgaatacgccaactaccagcctgggtcacttaacactactgatacactaatcaaggaccttgacaacatagacatagtgttccacattggcgacattagctacgccaatgggtacatttcacaatgggatcagttcacacaacaagtggaagagatcacttcacgagtcccttacatgattgcgagtgggaatcatgaacgagattggcccaacagtgggtcatacttcaatggaacagactctggaggggagtgtggtgtgttagctgagaccatgtactatacgccaacagaaaacagagcaaactactggtactctacagattatggcatgttccggttctgcgttgcggacagcgagcacgactggcgggaaggcacggagcagtacaaattcatcgagaactgcctcgcgacggtcgaccgaaagaaacagccgtggctgatattcatcgctcatcgcgtcctcggctactcctccggttacttctacggcagagacggatcgtttgctgagccaatgtcccggcaaagcctccagaagctctggcagaagtatagggtggacttggcgttctacggccatgtccacaactacgagaggacatgccctgtctatgaggaacaatgcatgagctcagagaagttccactactcgggcaccatgaacggcaccatccacgtagtcgttgggggcggcggcagccacctgagcaacttcacaatccaggtcccggcgtggagcgtatacagggagatggactacggcttcgtcaagctcacggcgttcaattactcgtcccttctgtacgagtacaaacggtccagcgatggcgaggtgtacgatagcttcactttgcacagagagtacagggacgtgttagcgtgcgtcaaggacagctgccctccgactttaaaatcgacatgacatgcagccattcagttttctgaacgtggcgctgcttctgcgtgtaactgtgagtgactaattaatttggtcgtcgaccgacccacctatatataaattctacattgaaataaagagcatattatattgacgctaattagatcactgcaccgg

SEQ ID NO: 85 - DNA, 2145 bp, Sorghum bicolor
gcgaggggtatatgcggaagctgaaaaaactcggggtgcgcccgtgcatcccagcaccggaagctggatccgcccctgcggtggcggcatgagcggcggggcgtcgctgggggtcaggtcgtcggggagctacggatcgctgccgcagcagcagcagctaggcggctgccagtcgtcgccgtcgccgtcgccgccgctcgccgcgcggaagcccgcgaagatgtccctcggcggggccggcgccggcgccggcggcccgcgcgtcttcgcccggatctgcaagctcgccggacgccgccagcggatgctcctcctcctcctcgtcgccgtcgccgtcgccttctgcttcctcttctcatcacttgtcagtaaagacgaagatgcatcacctggcgttgagaccatgcttgtgttttctgatcatgtccggagctttgtgaaccctggttggacatcgtcgggcagaccagtagctcagagaggttcgctgactgtgaatggtttgaatacagcatcgcacatggaaaaacaatcagatagcaaacaacaagttcaggaactcatgcagagttttccaccagctgttatggatcatcatccttgtgaaaatttctcattgtctcctccacctattgatagaaaacgcactggaccacgaccctgtccagtttgttatttgccagttgagcaagcgctggcactgagaccagctaaaccatcattgtcaccagtccttcaaagcttaaattatatgtttgaagagaatttgattcccaaagagtcaaagagtggttctttgtttggaggttttccatccctggaggaacgagaaaagtcttatgacataaaagactcaatgactgtacattgtggatttataagagggaagacacctggtcttagtactgggtttgacatagatgaagctgatcgttctgagatgcagctgtgccagagcactgttgttgcctccgctatttttggtaattatgatgtaatgcaacaaccagaaaatatcagcaaattttcaaaagatacagtttgcttctttatgtttctggatgaagaaacagaagccgcaataaagaactccactactattggtcatactaaaagaatcgggctgtggcgggtagttgttgtccgcaacctaccatttacagatgctaggcgcaatggaaaggttccaaagctcttacttcatcggctttttcctaatgtgcgatattcaatttggattgatgggaaacttaagctagtgagggatccttatcaggtattagaaaggttcttgtggaggaagaatgttagctttgctatttccaggcattacagacgcttcgatgtttttgaggaagctgaggccaacaaggctggtggaaaatatgataacacatcaattgactaccagatagagttctacaaaagagagggtctaacccattattcgtcagctaagcttcctataacgagcgatgtcccggagggctgtgtgataattagggaacatgtccccataacaaacttgtttacatgcctttggttcaatgaagttgaccgcttcacgtccagagatcagctaagcttcagcacagttagggataaaataaggtcacgagttaattggactgcagacatgttcctggattgtgaaaggcgtgattttgttgttcagtcataccaccgagaactgttggaacagaggcaggctaccttacgaagttggcctccccagcggccacccattgtgcgcgtccaccctagaaagatgcttccagacaatgcagcaaaggaaccatggagggcttctgcgaccaagaagttatcagggaagcgaacacgggataagagatcaagctcaagacgaactcatcgaactaacatgaaggaagcaattcaactgtaaatcctggcaattttgctcctatacaactgcaaatctaacggacaacattccaacattgttttactttaacttcctttgatgcccccccccccctccccaaaggagccaaaattttgtcagggattgttgatagagagctgaaattctttgttgtaaataaacatttttagatcagagatggattcaactagcagctgattcaattcaatcattttggaggtagtctttgccagggtttc

SEQ ID NO: 86 - DNA, 3789 bp, Sorghum bicolor
cggctgtaaacgacagacggggggagtgaaaccagcgagcaaagagcgcagcggagcagggtaggtcgccgttgccgttgccgttgctggcctcgctcgccccctcccacttaatgccgcaccgcccgtaatccggagtcttctcctccctcccgacctcccctaacgccagcaccccctccctctccccctcccttccccacccgcggcctgctgctgcggctgccaccttctccacccccacaaatctcgcctccgccgccgactccggccgcgaaatccaccccagatcggcgcgggggcgccgcttgatgtccgatctgtgagtggggctcgccaccatgagggtcttgctgctgctggcgctgctgctggccgcttgcgccgcggcggcggcgcaggcggcgggaggggccaactccaactccacctccacgccgttcgtgccgcgggacgacatcctgctggactgcggcgccaaggggcagggcaacgacacggacggccgggtgtggaccggggacgcgggctccaagtacgccccgccggacaacctcgcctcggtggcctccgcctccggccaggatccctcggtcccgcaggtgccgtacctcaccgcgcgggtctcggcctcgcccttcacctactccttcccgctcggcccgggccgcaagttcctcaggctccacttctacccggccaactactccaaccgcgacgccgccgacggtctcttctccgtctccgtcgccatcccgggcggaaagctcacgctgctttccaacttcagcgcctaccagacggctgccgcgatcacctactcgtacctcgtccgggagttctccgtcaacgtctcgtcccagacgctcgacctcaccttcaccccggagaagggccaccccaacgcctacgcgttcgtcaacggcatcgaggtcgtatcctcccccgacctcttcgacctctccattcccaacatggttgctggcgacggcagcctccagcagttcgaaatcgatcctggcacggcgatgcagaccatgtaccggctcaacgtcggaggccaggcgatttcgccctccaaggacacgggcggttaccggtcctgggacgacgactcgacctacatctttggcgccagcttcggggtcagctacccgaaggataacaatgtcaccatcacatatccaagcaatgtgccggagtatgtggcgccagaggatgtctacggcacagcgcgttccatgggaccaactaaggaagtgaacatgaacttcaatctcacatggatgttgcaggtggatgctggattcctgtaccttatcaggctgcatttctgtgagatccagtacccgatcacgatgatcaatcagcgggtcttcaacatttacattaacaaccagactgcagtcaagggtgctgatgtgattgcatgggcggccgttagtggtgctaccacccgtattggctctccggtgtatcaggactatgtggtgagcacaccgggtgtaggggccatggatttatggatagctctccatccggatcctgactcaaaaccacaaatatatgatgctatcctcaatgggatggaggtgttcaagttacagcttatcaatggtagccttgcagggctcaatcctatcccaagtgttgccccggccaatgatgggacaactaagaagaagtcaactgttgggcctatcgtcggtggagtggttggaggtttggtggttcttgcacttgggtattgctgcttgtctatgatctgcaagcgtaggaggaatgctgggaaggatgcaggcatgagtgatggacattctggttggctacccctgtctctttatggcaattcacacacttccagttcggccaagtcacacactactggtagctatgcttcatctttgccatccaacctgtgccgtcatttctctttcgctgagatcaaggccgcaacaaaaaactttgatgagtcccttattcttggtgtgggtggatttggtaaagtttaccgtggtgagattgatgggggaacaactaaggtggctatcaagcgtggcaatcccttgtctgagcagggtgtgcatgagttccagactgagattgaaatgctgtccaagctccgccaccgtcatctggtgtcactgattgggtactgcgaggagaagaatgaaatgatcctggtctatgattacatggctcatggtactctccgcgaacacctgtacaagacccagaattcacctcttacctggaggcagcgtttggatatctgcattggtgcagctcgtgggcttcactaccttcacactggtgcaaagcacaccatcatccaccgtgatgtgaagacaacaaacatcctcctggacgagaaatgggttgccaaggtttcagattttggtctgtccaagactggcccatctatggaccatactcatgtgagcacagttgtcaaaggcagttttggttaccttgatcctgaatacttccgcaggcagcagctcacagagaaatctgatgtctactcttttggtgttgtgctgtttgaggtcctctgtgcacggcctgccctgaaccctactcttccaaaagaagaagttagcttggcggagtgggcgttgcactgccagaagaagggcattcttgatcagattgttgacccctacctgaagggaaagatagctccacaatgcttcaagaagtttgctgagacagctgagaagtgtgtttctgatcagggtattgaccgcccttcgatgggtgatgtgctctggaacttggagtttgcccttcagatgcaggaaagcgcagaagagagcggaagccttggttgtgggatgtcggacgagggcactccccttgtgatggtcggaaagaaggatccaaatgacccatcgatcgagtcaagcaccaccaccacaaccaccacttctataagcatgggcgatcaaagcgtcgcgagtatggactcagatgggctgacgcctagtgctgtcttctcacagatcatgaaccccaaggggcggtgaggtaaagctcatcccattcgttaccttgcaggcataatttattcattcagcatgtttttcatgagttcgtgctgttgatgttctctcaagttatgaaccagaagtaagagaattgtttcatactactagatattctgccttgccttgtacttcttctccagtattgtaatgactatacatctgtccgcttgtattgtactgctgctattgacccaactagtattttactgtatgagaaagtgatgtgcacgaactattcttatgggtggttgtgtgacgtgctgttaggaatgagtctcaactctgaatacgacatctacacttgataatcatttttcaatctgaatggattacaagttgatagatcgttgtctggttattggcagaactgagattgtgttggtctttgtccttcagacaaatgccaattgtcaaacaatccatggaccgttttcgacaactgatcgagctggcagctgagatattcttccttcagataaagtgcaagctgtggacatttcacattttcacgagagcttttaaggtgttatggacgctaatatactagtaactttttgtgtagcggatgttgatggattgtgtgatggtgactagcagaatatggcgggttatgcttcgtacctcttgtttctcatactgttgttgggaaagatcatgtaaaccaatgctgatgatgcactagattgtgtccgtttagttccattgtctcggcattcactggcagttgccacttcgcttt

SEQ ID NO: 87 - DNA, 853 bp, Glycine max
ctctctgtctctctctctcgctttctctctccccgcgatggagaaagccgagagctccgcctccacatcggagccagactccgacgagaaccaccaccgccacccgacgaaccaccacatcaaccctccctccggcctcaccccgctcgagttcgcctccctcatcccctccgtcgccgagcaccactcctacctcgtcggctccgggcaatgctcctcactcctcgcccagcgcgtccaagcgccgcccgacgccgtctggtccgtcgtccgccgcttcgacaagccccaaacctacaagcacttcatcaagagctgcgccgtcaaagagccctttcacatggccgtcggcgtcactcgggacgtcaatgtcatctccggcctccccgccgccaccagcaccgaacgcctcgacctcctcgacgacatccgctgcgtcaccggctttagcatcatcggcggcgaacaccgcctccgcaactaccgctccgtcactaccgtccattccttcgaggacgacgccgacgacggcaagatctacaccgtcgtcctcgaatcctacgtcgtcgacgtccccgacggcaacaccgaagaggacacgcgtctcttcgccgacaccgtcgtcaagctcaacctccagaagctcgcctccgtcaccgaaggaaccaaccgcgacggtgacggtaagtcacactcgcggtgaagaagcaaatacgcctcaataaaacaaaatatatattaaagaaaaaaaagaaagaattggaatttgaaactaatcgctccctcgtcaattcataaaaggagaaaagcaaaacaagtttttctctcttttctctttattttctttttttcc

SEQ ID NO: 88 - DNA, 709 bp, Glycine max
gccactcacaaataaacataattacttgccttgaggaacgttccagaccacatacagaggtttctctagtgatcttcgttcttctgtggagatcttgttttttcatctcacttttcttctaattaaggaacaagctttccgcagttgaaaaccctagctagctagcttccaccaatttgaatcaccaatggctcgctctttctctaacgtcaaggttctctctgctcttgtggccgacggattctccaacactctcaccaggcgtgggtacgcagcagcgacacaaagcgcaacaagaggaggagctgcctccatcagcagcaagatagctcccaagtcaggggaagacaaggtaggaggaggtgctgaaaaggtttcgtgggtcccagaccctgtcactggttactacaaaccggagaacatcaaagagattgatgttgctgagctgagagccacggttttgggcaaaaaattcaaccactagctcgctagctagttaatttcaataacctttttggtcacttgaatatgttatatcatatatgactctctcgaagttcacagaaccttcggggattattcagcatgggccatctagcatatggccaaattaatgtctactagtgtgattggatctcatgttgaatactcaaactatgctttagttgaattctcttttgctgaataatacgagtagtttgaaactttc

SEQ ID NO: 89 - DNA, 1108 bp, Glycine max
atcccaaaattgagcttctattggagagaagcaaccaccaaattaaaagatctaccatggcaaacaagtaccataagcttcgctcaataagtttgccttctagatctcatcctagcaccgttagagtagaggaggagctgagaaagatcaaaacttgggaaggaacatccacaatatccacatcaaagtctattcacacaggcctttcattgcttgaagatttgtacatttgcttggatgatcttctcaacatggcatccacccaaaaggtgatttctcaccataggggtgacaaatgtgtggaagaagtgttggatggttcggtgagaattttggatatatgtggcatcacaagggacaccatgttgcaaattaaggaaaatgtccaagcccttcattcttctcttcgaagaagaaaaggagactcatgtgttgaagcaagtgtggccgagtacaagttgttcacaaaaacgatgaagaagaatgccattaagttgatctcatctttgaagcagatggatggcaaatttggggtgtccccacttttggatcttgatcaccactttgctgctgtgattagagttcttagggaagtcattctaatcaacttgtcagtcttccaatttattttgtcattcttgaccgtgtcttcatcgaactcaaagacatccaaatggtcgttggtggcaaaattgatgcataagggggcaaaaccatgtgatggcaccaatgatgagatgcagtgtgtggaagcagctttgagctccctcctaaatgaagggactaatgatgacaagatacatgtggcacatgaaaggttggaggctttggaggatgccattgaaagttttgagaatggtttggagagtttgtttaggcatttgattaagactagagcttcccttttgaacataatatctcagtagagtattttcaatagcatcttttctccaattcctgcaatgcatccaaattttagggacctgccgaggaaaataatattttttttactgataaaatatataatatttaataacaatttatagatttgtacaactcataagtaatacattgaagtgtaaagaaaatgctcattttctattttttt

SEQ ID NO: 90 - DNA, 1518 bp, Glycine max
acaaaactcagtttccaattcaccaaactcacaatggttgatctagattggcaaacaaagatggttcactccaacatcatgcctccaatgtcccccaaactctctctcccggatcataacattccaatcccaactttgcaactcccccttcgccaaaacgacatcaccgcagcgtcgtctcctatctgcgctgcatacgacaactaccttcgtctccctgagctcagagccctctgggcctccaaggacttccccaattgggccaacgagcccatcttaaagcccgccttacacgccctcgaaatcaccttccgcttactcgcaaccgttttctccgacccgagaccgtacatcaacaaacgcgagtggacccgacgcgtcgagtctctcgccacggcccaaatccagatcatagccatgttatgcgaagacgaagaagaaaaccccgagacacgtggcaaggcacccgtgactgacattaacggctttaccggtcaaagcagaagctacagcgaggaaagcctgctcccgcgcctcgccacgtggcagaaatccaaggacgtggcgcagaggattctcaattcggtggactacgagatggggaggtgcacctacaccttaggtttaggagaggcgaatatcgcgggaaagaagatatttctcttcgacgcggtttgcaggccgagggagattcactcgttggagacgacgccgtttgatgattacgtggggaaccacgagaacaagacgctgcacgccacgcagcagatcgccgagtgttggacgcgctcggtgaagaagctgctggagagagtaacggagtcggtggagaaaaaggcgttggagaaggccgcgagtgagtgccatgcggtggagcggatctggaagttgttaacggaggttggggacatgaacctcatgatggatccagaggatttcttgaggctgaagaaggagttagggatgatgagaactgcgggcgaaacggtggcgttttgcttcaggtcgagggagcttgtggaggtggcgagggtgtgtaggaatctgagggagaaggtgccggagatattggaggtggaggtggaccccaagggtgggcccgggatgatggaggcggcgatgaaggtttactcggagaaagagaaagggaaggttcatgttttgcaggggatgcaggggattgaggtggcgatgaagaggttcttctacgcgtataagcaggttgtgacggttatgatggggagctccgaggccgataatgggttcaccaagatattccttgaacccacttatttccctagcttggatgctgccaagacctttcttggttattacaaccaaaattaattcttttattcacttcaattccatcttactcacacaaagaaacaaaaaggattgaattttgtaaacaaatctttgtctgtaaaaatatatttatttgacttctttttggatcatattctttcgatcatatccccgcttttgaattttaaaagtggtggtgttttaaaatgc

SEQ ID NO: 91 - DNA, 2077 bp, Glycine max
acacaaggtacactactcactaatcatcatcactaacaccagtgaggagaaaaatggagatagagaagagcactaagggcagtgcggaaataggagagaaagaagagaagaagaagaagcagcatcgacgaggaggcatcagaacattacctttcattcttgcaaatgaagtgtgtgacagatttgcaagtgctggttttcatggtaacttgataagttacttgacccaagagctgaacatgccattggtagctgcctcaaacacactgacaaactttggaggaacatctagcttcacccctctcattggggctattatagcagattcctttgctggacgtttttggaccattaccgttgcttctctcatttatgaactgggattgattagcatcactgtatcagctatactgccacaatttcgtcccccaccatgcccaacacaagctaattgccaagaagccacatcctcacaactgtggatactctacatctccctcctcctcacatctgttggatcaggtggcattagaccatgtgttgtgcccttttcagcagaccaaattgacatgaccaaaagtggtgtggcatcaagaaagtggaacatcttcaattggtactttttcagcatgggcttcgcttctcttagtgctttgaccattgtggtttacatccaagacaacatgggctggggttggggccttggaattccatgcattgccatgttgatatccatcgttgcctttgtgttgggctcaccactttataagaccgtaaaaccagaagggagccctttggttcgtttggcccaagtaaccgtggcagctataaagaaaaggaaggaggctttgccagaagatcccaagcttttgtaccataattgggaacttgatgcttcaatttctttagaagggaggcttctacactctgatcaatataaatggttggacaaagctgcaattgtcacagaggaggaggccaaagatccaactacaacaccaaaattatggaaattagccactgtccacagagttgaggagctaaaatccatcatcagaatgcttccaatttgggcatcaggaatcctgctcataacttcttcatcacatctgcacagttttgtgattcaacaagctcgcacgatggaccgtcacctctctccctcgttccaaatttccccagccagcatgtccattttcagcgtgctaaccatgatgtcaggagttgttctatatgaacgcctctttgttccctttgcgcgcagattcacagggaacccttctggaatcacatgtttgcaaagaatgggaataggcttcataatcaatatcatagccactgtgattgctggcctaatggaaatgaaaaggaaatctgttgctgctaagtaccacttattggatgatccaaaagccactattcctataagtgtgttctggttggtacctcagtattgccttcatggggtggctgaaattttcatgtctgttgggcatttggaatttctctttgagcaatcacctgaaagcatgagaagcagtgctacagcactgtactgcataaccacagccattgggaactacatgggtacattgctggtgtcattggtgcataagtacactggcaaggagaataattggcttccggataggaacctcaataggggtggattggactactattattttcttgttagtgggattcaagttgtgaatctcgtttattattttatatgtgcttggttttacacttacaagtccgtggaagaaattagtgaaaagaacaaggaagaggatttggaacaagccaacgaacatgtctcatctgatgacaagttaaatgatggtaaggaggaagaaaagagaggattaacgaaagatgaatgaattgatggggttgatattagtttttagcattgttgattgttgaactttaaggaatgttcttttcctcatcaaatggcatatgtaagcacatggtagatcgtgtctactgttttatacagtttatgtttagttgtgcttctaatcttctacataatcatctaacttaaaggcattattttcttcaaatattt

SEQ ID NO: 92 - DNA, 2985 bp, Glycine max
gttgagaagggaagaggtacacatggcaagtggcaactgacctcattgttgatagttgatacttggcctcgaagatgcacttgctactatccaagtccccactattactgatacataattcttctatgctcctgcaccgcttctctcctcttctccttcctcgttttctctttcgccaaccccccttcccctcttcgaatttcaaacctctcacactcaaggtcctctccatggcatcgtctcattcctcccaccacatacacactaatcgactcgcttccgaacagagcccctatcttctccaacacgctcacaaccctgttgattggtatccctggggcgaagaagccttcgccgaagcgcgccggcgagacgcgcctatcttcttgtcaattggttacagcacttgtcactggtgtcatgttatggaggtcgagtctttcgaggatgaagcggttgccaagttgctgaacgattggttcgttagcattaaggtggatcgagaggagcgaccagatgttgataaggtgtacatgtcgtatgtgcaggctttgtatggtggaggaggttggcccctgagtgtgtttctttcacctgacttgaaacctttaatgggtggaacttacttcccccctgatgataagtatggacgaccaggatttaagactatacttagaaaggtaaaagaagcttgggatagtaagagggatatgctaattaagagtggatcatatgcaattgaacagctttctgaggcaatgtctgctagttcagattctgataaactgcctgatggggttccagctgatgcgttacgcctatgctcggagcagctctctgggagctacgattcaaagtttggtgggtttggatctgcaccaaagtttcccagaccagttgagataaacttgatgctatatcactccaaaaagttggaggatacggggaagttgggtgtagctaatggaagccagcaaatggttttctttagcttgcaatgcatggcaaaaggtgggattcatgatcatattggagggggatttcacagatacagtgtggatgagtgctggcatgttccgcattttgagaagatgctttatgatcaagggcagcttgccaatgtttatctggatgcgttttctatcacaaaagataccttttattcttatatatcacgagatatccttgattatttaaggagagatatgattggtccagaaggtgaaattttttcagcagaggatgctgacagtgcagagactgaaggagctgcaagaaaaaaggaaggagccttttacatatggacaagcaaagaggttgaagacttacttggagagcatgctgctctttttgaggagcactattacatcaagcaattgggtaactgtgacctatctggaatgagtgatcctcacgatgaattcaagggaaagaatgtcctgattgagagaaaggaaccttcagaactggcatcaaaatatggcatgtcagttgagacatatcaagaaattcttggagaatgcaggcataagttgtttgaagtaaggtcaaggcgtccaaagccacatttggatgataaggttattgtatcgtggaatggactggcaatctcatcttttgccagggcttctaagattctcaagggtgaagctgaagggaccaaattctactttcctgtcattggcactgaaccaaaggagtacatgggaattgcagaaaaagcagcatcctttattaggaagcaactttacaatgtagaaactcacaggctacaccatagtttcagacattcgccatctaaagctcctgctttcttggatgattatgcttttctgatttctggattgctggatctctatgagtttggtggtggaattagctggcttctatgggccattgaattgcaggaaacccaggatgctttgtttcttgataagacaggaggaggatatttcaataatacaggagaagatgcttccgttctcctccgtgtaaaggaagaccatgatggggcagaaccctcaggaaactcagtttctgctataaatcttataagattggcttccatggttgctggaagtaaggctgagcattataagcgaaatgcagaacatctattggcagtttttgagaaaaggttgaaagatatggctatggcagtgcctctaatgtgttgtgcagcagatatgttgcgtgtactttctcggaagcaagtggtcgtggttggtgaaaggacgtctgaggactttgaaaacatgcttgctgcagctcatgcagtatatgatcccaacagaacagttattcatatagatcccaacaacaaagacgagatggaattttgggaagtaaataacagtaatgttgctctcatggcaaaaaataactttgcagtcaacaaggttgtagctcttgtatgccaaaacttcacttgtagcccctctgtgactgaccattcgtcacttaaagctttgctctccaaaaaaccttcctcttcgttcacgtaagctattggttctgatgagtaggaaaatagttaacgtcggcgaaagctccctcttagagatccccctttcaatctacagaactagttggttctgacttctctgtcaaaataaagataggtaacattctctgttgacttgaggaattgatgcatgtccttttcgtatgcctgtgctcaacaagccatgatttttcttcaaatgtgatacagaatgatggaatcatggaagtatgtataattgtatatgcaatgtaagctatcgttgaaataattatcttttccagttggagtctgttctcatgtttatacttcatttttttctcgatgaacttgcacaagaaagtctcgatggcatggctaagaaatccttcatgtctgttcgtgcaatatgttgtagaaagctcaaaaggtttgccaatctgagacattcttctgttttcgagacattttattagtatattataaagtatatgttgcacaca

SEQ ID NO: 93 - DNA, 480 bp, Glycine max
gtgcccctccttcgttcgcattttaggcattgaaaactaattgaaggagttgcagtccagcgttgatcagaatcagagcatggacgggcatgattcagaagacccaaagcaaagcactgctgatatgacagcttttgtgcaaaatcttcttcagcagatgcaacttaggttccagacaatgtctgactccatcatttctaagattgatgagatgggagaccgtataaatgagttggagcaaagcatcaatgatttaagatcagagatgggagtggagagcactccatcacctgtggcccctgctaagccaaaggaagaagagtcaaacaaagaagagggttctgcttgagtaatgttacgtgttcaactgccttgtcttttatttttgggtctcgtgtgattcattcaggattttgttactgtatatctagtgaactctctttgctagctaaaacatactgttcaaactatgtaaaaatc

SEQ ID NO: 94 - DNA, 1511 bp, Glycine max
gcacgataggaggcactacgctgtcgtttgcggtgttagaagacctagtcgggcgtgatggcgaagaagcgatcagccccgagtggcggtcgtcgggaaaaccgagccgaatcatcttcccgacggctcaactcagcttccggtcgcagaaaactcgttgcgttcttcatcgtatcgtccatcatcgctatcgtcacttatcgttatcgcttcagacaatcttctccttcgcaaggccttgtcacaactcatgctaattgccaacatatactcgccgaaaattcaaaagtatcaggaaattcgtctcagcgccattatacttatcctgtgcttggctacattactccctggaattctcgaggttatgaattggcaaaaaggttcaactctaagttcacacatttatcacccatttggtatgatctaaagagccaacagactagcttagttctagaggggagacataatgctgacagaggatggatctcagagcttaaaaaggcaggagaagctttgattttgcctagagttgttctggaagcatcaccagcagtgctgttgggaaaggaaaaacaaaggaacaaagccattaaccttatagtaacagagtgcaaggaaatgggatatgatggtattgttttggaatcttggtcaaggtgggcagcttatggtatcttgcatgatccaagcatgcggaatttggcattgcagtttgtaaaacagcttggagatgcactgcattctataagctcagagaaaattagtgggcagcagctgcagttggtctatgttataggttcaccttctgagaagttgcaagagcatgattttggtcctaaagatcttgagactttaagtgaagctgtggatggattctcgttaatgacatatgatttctctaatcctcataatcctggtcctaatgcacctttgaaatggattcaaattgttctacagctgcttctcggtacctctggcaatagagcccaaagccttgcccccaagatacttcttggtatcaacttctatggaaatgatttctccctttcaagggatgcagatgcagggggtggagctattattgggagagattacctggcacttttggagaagcactggcctgaactgcagtgggataagaatagtggggagcattttttcttttacactgacgacaaggatatcaggcatgtggtattttatccatctttgaagtcaatttctttgcggttagaggaagctcgttcatggggatgtggcatctcgatctgggaaattggccaaggtctggattatttttttgaccttctgtgatagcttgttatgtgtacttcttttgtggcccatgttaatgtttattcctacgtcgtaatgttgtgtattcagtataatcgaaacgtacttcagttaaattgggattttgtttttcagaaatctagtttgaggaaatgtgcagttagttcacttacgtgacagcatagaggatatttgagaacgtaataaaaatgcca

SEQ ID NO: 95 - DNA, 2137 bp, Glycine max
attatcccatgagttctctattcttttaaaccttagtctcccacggaagacttcaacagaagaaaaaggaagaattaatatcactcttccatggttgccgacgaagcttcaccattcgagaccagcgatatgctggcaacgctcctggcgtcgacgccgctgttgtcagagtcatggcggctgtgcaccaccgtggccgccaccgcgccgaggagtttcatgactgagcagcacggtggcggcggtgtggtgtacgtcgctttccccggcgtagaaatggcggcgggatcggactctatctgcagaaacttggtggcgttggaaagcatcggcgacgtgccactgttctcggcgcggcgtcgcaacaaggaaggcgatgaacctgtgatggtgcatgctgggatgctgaatctcttgtccacctttttcgaaccatttcaaaaacagatgttggcactcatgggaaattccaagaccaaatcaattgtcctaactggccactccattggaggagccacagcctctctatgtgctctttggctactatcttacctccaccagacatattcctctatttctgtgtcagtcttgtgcatcacattcggttcccccatgctagggaatggctctttctcacgtgccattctcagagaaagatggggtggtaacttctgtcacgtggtctcaaagcatgacataatgccaaggcttctctttgctcccataacaccttacactgctcaaataaacttcctgcttcagttttggcaactgtccatgactgctccaggctttgggaagcttgcagttccaatttctgaccaacagaaagagctgttcaactttgtgatgagtcacttggatgcagccacacaagatgaagaagggtctgcacctgttttgtttcacccatttgggagctacctttttgtttcatcagatggagcagtgtgtgtggattgtgcaacttctgttataaagatgttgcatttgatgtttgcatcagtttccccagcttgtagtattgaggaccatctaaagtatggagactatgttaagaatttgtcattacaattcttgaaccagaacaattccgtgcaggggaatattcctgattcaagctatgaagcaggacttgaattgtcggttcaatcttcaggtttgggtaaccaggaatcggcaatcgaacctgccaaggagtgccttaagatgacaaggaggatgggtccttcaccaaccaagaatgctgctaacttatcaattacattatcaaagtttgtgccttataggaccgaaatagaatggtacaaagcttggtgtcaccagcaagttgatcaaatgggatactacgacttattcaagaggagaaggagcacttcaaaaatggctatgaaagtcaacatgaatcgtcacaaacttgccagattttggaacaatgtgattgaaatgtgggagagaaatgagctgcctcatgatgtggcggtgcgggctaaatgggtcaatgcttcacatttctacaaactattggttgagccactagatattgcggaatattatgggaaggggatgcacacaaccaaggggcattacatacagcatggcagagagaagaggtatgagatttttgataggtggtggaaggatgcaatgggcaacaccgaagaaaataatgagaggaggagcaagtttgcaagtttgacccaagattcatgcttttgggcaagggtggaggaagcaagggactggctgaatagtgttagaagtgagagtgacacaacaaagttggctgtgctgtgggataacattgagaaatttgagaagtatgctatggaacttattgataataaggaggtgtctgaagatgttcttgctaagaactcaagttacagtatatggatggaagatttaagaggactgagggaactcaaagcaaaggtgaagacgttttcacaccactttaacccgtttctggatggagaagtaattccttagtaattttaaatgaaatcaataaataagcttgactctgtaatctgtaatatgcctatgaactacttgtttgcaaaataactagtgtgcttatggcttgatctaatcagtattttacttaaatgcttacaagaagtgtgacaaaaac

SEQ ID NO: 96 - DNA, 2080 bp, Glycine max
acacaccccactatacaaaaacactctctctctctctgtttcctccaaaaacaaaactttccctacacactttcttccaatggccgccaaaacggtaacccccgacgccgtttcgacgctcctcgcaaacccttcccccgattccacatcggatctccccgacatcgtcgttcaagtcctcgatcttaaggcgacaggcaataaatacatgtttactgctaatgatggaaaaacgaaactgaaagctatgattccttcggatatgcgctctcaggtgctctccggggctattcaaaacctaggtcttattcgcgtccttgattacactgtcaacgatatccccaataaatcggacaaataccttcttgccattaaatgtgaagctgtatctcccgcgcttgaaatggagataaagagtgaggaatctggatctgggattcttttgaagcccaaagtagagggtggagtcaagactgaaggtgctgctgctgggattcttctcaagcccaagcaagaagtggtgacaaaatctgctaaccagattctacgcgaacagcatggaaattcggctcctgctgcacgcatggcaatgacgcgtagagtgcgtcctcttgtttcgttgaacccttatcagggtaattggacaataaaggttagcgttacgagcaaagggaacatgcgtacctataagaatgctaggggtgatggttgcgtcttcaatgttgaattgacggatgaagatggtactcagattcaggcaactatgtttaataatgctgcaaggaaattttttgacaaatttgttctgggaaaggtttactacatttcaaggggaactttgaaagttgctaacaagcagttcaaaactgtgcaaaatgattatgaaatgacgctaaatgagaattccgaggtggaagaggtggtcggtgaagcaagttttgttccggaaacaaaattcaactttgtgcagattgatcaactgggtcctcatgtcaataagtctgagcttgtggatgttattggagttgttaagaatgtgtcttcaacaatgagcattcgtaggaagagtgacaatgagagtattccaaagcgtgacattactattgctgatgacacgaagaagacagtagttgtgtccttgtggaatgaacttgcaactaccacaggagaagagctactggacattgttgataaatctccagttgttgcaattaaatctctcaaggttggggacttccaaggtgtttctttgtcaactataggcagaagtgtggttctggtaaatccagacatacccgaagcaaaaaatctcagaagctggtatgattttgaaggcaaggatgctgcaatggactctgtaggctctggttcaagtccaatatctaacaatgggattagatcagtgtacactgatcgtattcatctttctgacataatctcaaacccatcattgggagatggaaagcctgcttttttcagtcttagaggacatataaccttcataaagcctgatcaggcaatgtggtatcgtgcctgtaagacatgcaataagaaagttactgaaagctttggttctggatattggtgtgatggatgtcagaaaagtgatgaacagtgtagtttaaggtatattatggttgccaaggtttctgatggaagcgctgagacttttatctctgtcttcaatcaggaagctgagaagatcgttggatgctctgctgatgatctagataatcttaaattacaagaaggagaagataatccttatcagatgacattgaaggaagctacttgggctcaacatcttttccgggttagtgttactccgaacgagtataatggcgagaagcggcaaaggataacagttcgagcagttgttcctgttgacttcgctgctgagtcaaggtttatactggaagaattatcgaagatgagagcataagatgcatatgcagattcacagtttctacatcttttggttgaaggttatttagtatgttactggttgttctagctatgtttcctgatctattgaatggtcggtcttctcctttcactagagtgcagacctttgggttaa

SEQ ID NO: 97 - DNA, 2097 bp, Glycine max
ttccttccactaacctccctctctctccaatccatcgctatctctatctcttttttgatacaaagaaaaataaaaagtttcatactttaggacacccttttctgcaactgatgatggaaggaagctgaaacagtgaaaaacaacaaccaacccctgtctttgttttttgtttgttgaattgaaacttgagagagagaaagtgaatgaatgatggaggcaaagggtgtgcggttcttagcgtaccaatcaatattttcgagcgttggatctggggactttgatggggtgaagaaactggtggagaaagtgaagaatgaagaatggtcatcgctctctgatgtgatgtctcttcagaacgatgctggagagactgcgctatacatcgctgcagagaacaatctgcaagagattttcagcttcttgctcagcatgtgtgacttcgaggtcgtcaagattcgctccaagaaggctgatatgaacgcctttcacgttgctgccaagcgtggcaatctagatattgtgagggagcttttgaatacttggcctgaggtctgcaagttatgcgactcctcaaacaccagtcctctatattctgctgcagttcaagaccacttggatgtggtggatgctatcttggatgtcgatgtcagttgcatgttcatagttaggaaaaacggcaaaacttcactgcacaatgctgctaggtatggtgtccttcgtattgtaaaaacacttattgctcgggatccaggaatagtatgcatcaaagataaaaaaggtcaaactgcccttcatatggctgtcaaaggacagtgtacttcagtggtggaggagatattactagctgatccttctatattgaatgagcgagataagaagggtaatacagctcttcacatggcaacaagaaaatgccgttcacagatagtgagccttttgctaagctattctgctatggatgttaatgccatcaacaaacagcaggaaacagccatggatttggcagataaactgccatatggagattcagctttggaaataaaggaagcccttgcagaatatggtgctaagcatgccaggtatgttggcaaagaagatgaagcaatggaactcaaaagaactgttagtgatataaagcatgaggtgcagtcgcaacttatacaaaatgaaacaacgcgccgacgggtttctggtattgccaaggagttgaagaaacttcatagggaagcagttcaaaacaccattaattcggtcacagtggttgctgtcctttttgcttcaatagcattcttggccatcttcaatttgccgggtcaatatataacggaagaaggacaagagattgggaaagctaatatagccgatcatgttagtttccaggtcttctgccttctgaactctacatctctattcatttctcttgcagttgttgtagttcaaattactttggtagcctgggacacaagggctcaaaagcagattgtgtcagtggttaacaagttgatgtgggctgcatgtgcttgcacttgtggtgcttttctagcaatagcttttgaggttgttggaaagaaaacatggatggctatcaccataacccttttgggggtacctattctagttggcactctagcgagcatgtgctacttcgtttttcgacaacattttggcattttccgcagtgattcccagaggcgcatcaagagaacaagtggaagcaaatctttctcatggtcttactctgcaaatatatcagatttggatgaatacaattctgacattgagaagatctatgccctgtgagtcaagaatcatgttaccacacaacagaagagcaatgtttcaaccgtttaactgaaactgttataccactgctaagtgataatgttagctcaccgggatttcatcattcatcttgagttttcagtttttggtttcaggctgtactactaggcaattcggttggatttgcatttgctagtatgtgattatagttcataaccaacacttgtagatttatgtatatgtaattaaaataatatgaaagggaagtccactacttaagtctgatattggaatgagcattttcattacaatacg

SEQ ID NO: 98 - DNA, 1238 bp, Glycine max
gaaaagtaaaaggaagaagcttcgtcctttctatctccgcaggctgcagacaaaccaaattttgagtcacacatacatgataccccctcctcactattcacttcctcaaccgatccatttttcttagtttttcgctttcctcagatggcaagtgggtttggggaatcaacagggaggtcacccccaagcccttcctacttcaacaacaataataacagcgatgctgccaattttgaatgcaacatttgctttgaattagcgcaagacccgataattactttgtgtggtcatcttttctgctggccttgtctttacaaatggcttcactttcactcacaatcacgagaatgcccggtgtgcaaggctctcgtggaggaggagaaattggttcccttgtatgggagaggaaagtcgtccactgatccgagatcaaaatctattccgggcgttaacatcccacatcgtccggctgggcagaggcctgaaactgctcctccacctgaaacaaatcattttcatcaacatgggtttggatttatgggtggcttggggggatttgtgccaccgccgatggcaacaacaagatttgggaattttgcattgtccgcagcatttggtggttttataccatccttattcaactttcagatgcatgggtttcatgatgcggccatgtatgggggaggggctggttttccacatggatttgctaatacatttcatggtgtccatgctcatggattccctctgcgcacccatcaagggcaacaagattattatttgaagaagctgcttctatttgttgttttctgtgttgttcttgcttttatatggcaataggttgaatacattctcagattggtagcagaactagatttctgctctgatagatcttctggtgcgctctttatttcgtaactaaggagtaaggatattgttcatataataatactgtcatattactcttgtagttcttttctttgtgatagttttgtggcacctatggtatccatgtgcgaaatttaatatataaagcatgaaagcaacacacccattgttaggaataaggatctgggtatcagtccgtagatattaatttcatggttattatactaagtttgacactacaagatagctgaaatagtgaagttatgctctttgtttactttgtgttctcagtttttcaagtacatgttgacatgctattgctaatgttatatctaaaattattttgatgc

SEQ ID NO: 99 - DNA, 1093 bp, Glycine max
atcttttccctgaaaatccatagcgttatcctcttttgcctccaaaggttgttatggatagatagatagatagaacgctgctttgagtttcctcaactcaagaatggctgccaacgactcgtccaccgagattgatactaagaagctttcgaattgttggggaaatgctcaaatgccctttgcactccccactctcctctcttcaccaccccaacacctccacacatcattcaccactgccgctgacaattttttcagatttctacactcccttgcttctcataactctttcctcaacaaaattctctctctcccctccgaatttcacaccctttgcgtgcagattgggaagcaaaggaacgtgaggttggtttctggtcataatttcgctgccgttttgcctggggattcggtggcagggctggtggtggcgaatggggttctgaatttcttgaacatttacaacactttgctcattgtcaggcttgttttgacatggtttcccaacactcctccttccattgttagtcctctcagcaccatatgtgacccatacctgaacatattccgtggacttattccccctctgggaggaacgctggatctctctcccatcctagcattcttggtcctaaatgccttcaccagcactgcttctgcactccctgctgagcttccagtcacagaacaatccaaacaaggccttgcagcaccattgcactccactaaccttactacttcacagaagaaatggttgacacggtttcaagggaacaggtcaaggacatctggtgctgatgctaaatagaacatgggagagtttatttgtgcctctgtgtctgtttattaatttagatacgttccatcccgattatgatagttctattctaggcaacacaatttttgagcttatgattccagagattttagagttatggagtttgctgttgaaagctcaaggctcaagcttccacagtcctattgtgttttttcttttaatcctatggtcttcttagtcaataaacttaaggtccttatttaaattggggactggattggattacagaataatcatactagtaattcaattaaa

SEQ ID NO: 100 - DNA, 3052 bp, Glycine max
tcgttcaaaaacaaaaccattctaccttctccaaaaccatccaactctcatgttcgaagaaaacatacacaatctcttcaaactctaattttcttttcctttcatttaatttcctcaatggcggcttccgtcgaccagcgtccgtaccccggcctccacaatggcgtcgttcggcccctcaaaccaggcccggatatcccgcgtcccaagaagctaccccagccgccgccgccactctcggattcctcaagcgacgaagaagaagacaccaccttgaacttgaaggacctgattcgcaagggaacaacggaagttgaatcctccattttcgacccgcgcgacgatggaacctctgaccactggatccaacggaactcttcccttgtccgtttaacgggaaagcacccgtttaactcggagccacccctccctcgcctcatgcaccacggcttcatcaccccggtccccctccactacgtccgcaaccacgggccagtcccccgggcccgctgggaggactggaccgtggaagtcacgggcctggtcaccaggcccacatgcttcaccatggagcaactcctccacgatttccccagtcgcgagttcccagccacactcgtctgcgctgggaaccggcggaaggaacagaacatggtgaaacagagcatcggcttcaactggggggcagccgccatctccacttcggtgtggcgcggcgtgcccttgcgcaccctgctcaagagctgcgggatctacacccgcaccaagggcgcgctccacgtgtgcttcgaaggggccgaggatctgccaggtggaggtgggtccaagtacggaaccagtatcctgagggaggttgcactggatccctcccgcgacatcattctcgcctacatgcaaaacggggagcctttgtccccggatcacggcttccccgttagaatgataatacccggtttcattggtggccgcatggtcaaatggttgaagcgcatcattgttactaccgaccaatctcaaaactattaccattataaggataacagggtactcccttctcacgttgatgccgaacttgccaatgctcaagcttggtggtacaagccggactatattatcaacgagcttaacataaactccgtgataaccacgccttgccacgaggagatcttgcccatcaactcatggactactcagatgccttatttcatcagaggctatgcgtattccggtggtgggagaaaggtgacacgtgttgaggtaaccctggacggaggtgaaacgtggcaagtgtgcacactggactgtccggagaaacccaacaaatatggaaagtactggtgttggtgtttttggtctgtggaggttgaggttttggacctgctcggagccagggagattgcggtgcgtgcttgggacgaggccctcaacacccaacctgaaaagctcatttggaatgttatgggcatgatgaacaactgctggttcagagtgaaaaccaatgtgtgcaggccccacaagggtgagataggtatagtgtttgaacaccccacccaaccaggcaaccaatccggcggatggatggcaaaagaaaaacacctagagaaatcatctgagtccaacccaaccctcaagaagagtgtctcctccccattcatgaacaccacctcaaaaacctataccatgtctgaagtcagaaggcacaacaacgccgattcggcttggatcatagtccacggtcatgtctatgattgcacccgcttcctcaaagaccatcccggtggcacagacagcatcctcatcaacgccggcaccgactgcaccgaggagttcgaagccatccactccgacaaagccaagcaaatgcttgaagactaccgaatcggcgagctcaccaccacctgctacaactctgattcttcatcgtcaaacccctccgtgcatggcagctccgacaccatccctttgacccccatcaaggaagtgattacaccaatgcgaagcgtggctcttaacccacgcgagaaaatcccatgcaagctcatctccaaaacctccatctctcacgacgttaggcttttccgctttgccctcccctccgacgacctactcatgggtttgccagttgggaagcacatattcctatgtgccaccgttgacgagaaactatgcatgcgagcctacactccaacaagcagcgttcacgaagtgggatacttcgacctcgtcgttaaggtttacttcaaaggggtgcaccctaagttccccaacggtgggatcatgtctcaacacttggactctctccccattggttctgtcttggacgtgaaaggcccacttggccacattgaatacactggcagaggaaacttcctcgttcatgggaaaccaaggtttgccacgaggctagccatgttggctggtggcacaggaatcacacccatttaccaagtggttcaagccattctaaaggatccagaggactgcaccgagatgcatgtggtttacgcgaaccgaaccgaggatgatatattgctgaaggaagagcttgatgagtgggctaagaagtatgataggttgaaggtgtggtacgtgatacaagaaagcataagagaagggtgggaatacagtgtgggattcatcactgaaagtatcctgacggagcatattccaaatgcatctcctgataccttggcattgacttgtggaccaccacctatgattcaatttgcagtccagccgaatttggagaagttgggctacgacacccagaataacttgctcgtgttttaggggactaaactagaatacattgtatgtgtatatagtagtttattgttatatataaataatggattctattagctgcttcgtttcaagatttttttatgtttcaatttttaaataaaagtgtacatgggacagctagctagctacgcaggtttacttttcctcgtcaacttttgatgtagacaagtatgtcaattattttgactacttttgcatgtataaataaataaataaaacagtgtgcaactatcactttttcaattta

SEQ ID NO: 101 - DNA, 2694 bp, Glycine max
atttcatcacaccaaatttgaccaattccaacctcgcttgaaaccatggctctctgcacatcttccttcttcttcaccttcttcttcaccttcttcttgttcctcttcaatcttcaaccttctgtttcccaacaacaattcacatccttcaacatctcacactctccatggctcccagcacagaacaaaacccttctctctccaaacaaaaacttcactgcaggcttctttcccctgccaaactcttcaaatgtcttcactttctccatttggtactccaaagtgcctccaagtgcaaacccttttgtttggaatgccacagtccaagtcaacacttctggctcccttgaaataaccccaaaaggtgaacttctcctcaatggttcaccctttcaaagtgctgaaaatgctactactaactccacttccaattcaacccaacttcttctccaaaacgatggaaacttggtctttggggaatggagcagcttcaagaaccccaccagcaccgttttacccaaccagaacttcagcacagggtttgagcttcactccaacaatgggaaattcaggttcatcaagtcacagaatctggttctcagctccacctcagatcaatactacaacaccccaagtcaattgctgaacatggatgataatgggaaaatgagcatgcaaggtaactctttcctcacttcagattatggtgaccccaggttcagaaaactggtccttgatgatgatgggaatctcaggatctatagcttctaccctgaacagaaaaaccaatgggttgaggtttggaaagggatatgggagatgtgcagaatcaaaggcaaatgtgggcctaatgcaatttgtgtgcccaaagaggatttgagcacttccacttattgtgtttgtccatctgggttcacaccagcaatccaaaatgatccggaaaagggttgcagaaggaaaatccctctttcccaaaacacccaatttctgaggcttgattatgtgaactgctcaagtgacggtcatttgaatgaaattaaagctgataactttgcaatgtgcgaggcaaattgctcaagagaaaaaacctgtcttgggtttggattcaagtatgatggatctggctactgtatgttggtgaatggcacaaatcttcaatatgggttttggtcaccaggcactgaggctgccttgtttgtaaaggttgacaaatccgagtcatcagtttccaacttcattggcatgactgaggtgatgcaaaccacatgtcctgtgaacataagcctcccacttccaccaaaggattcaaacgccacagcaaggaacattgccataatctgcaccctttttgctgcagaactcattgctggggtggctttcttctggtccttcctcaagaggtacatcaagtatagggacatggcaaccacattaggccttgagcttctccctgctgggggaccaaagaggttcacctactcagaaatcaaagctgccaccaaagatttctccaacttaataggcaaagggggctttggagatgtgtacaagggtgagttacctgaccatagagtggtggcagtgaagtgcctcaagaatgtcacaggtggagatgctgagttttgggcagaagtcacaatcattgccagaatgcaccacctcaacttggtgaggctgtggggattctgtgctgagaagggccaaaggatacttgtctatgaacacatccctggtggatcattggacaagtacctcttcagggtcaataagtctcataacaataaccatctcaaggagcaatcaagtagtttgaatccaaacacaccacaacaagaaaggcatgttttggattggagcatgaggtacagaatagcccttggtatggcaagggccattgcctacttacatgaggagtgtttggagtgggttttgcactgtgacatcaagccagagaacattctactaggtgatgacttttgtcccaagatatcagattttgggcttgccaagttgaggaaaaaagaggacatggtgaccatgtctaggaggaggggcacaccagggtacatggcaccagaatggatcactgcagacccaattacctcaaaggctgatgtgtatagttttggcatggtgcttttggagcttgtgagtgggattaggaactttgagatccaaggttctgtggttaggagtgaggagtggtacttccctggttgggcctttgataagatgtttaaggagatgagagtggaggagattttggatgggcaaattagggatgcttatgatagtagggcacactttgagatggttaataggatggtgaagactgcaatgtggtgtctgcaagataggcctgagttgaggcccactatggggaaggtggccaagatgttggaagggactgtggagatcactgagcccaaaaagcccactgttttcttccttggtgaagagtagattcatgataaagtttctgtgtgatgttcagcctttcttgtttaagtttctctcgttatatctcttgtaccggcatggtagcatgtatgctcaatagttggaacgatggcaaataaattgggtgatcaagtgtataaatattacctttgtttttcttctaatggtatgttttattcgagtatagtttcattttactgcatatagaatataaatgattatacagtcgcaggg

SEQ ID NO: 102 - DNA, 1017 bp, Glycine max
gaattaatagagatacagataacgtgaaactgaaaggaaaatggcactctcagtctcctcaccctcatgcgtacgcgttccttcatgtttttggaaaccaaatggcaagagttgcaaagagcgtactaaggtttcatgtgcagctcacaatgataataagaatccgttggttggaatcggtattggggttgtaacgtcttgtgtgatgggtttaactgcattggatgcggacgccacgagaatcgaatactacgcaacagtggcagagcctttgtgtgagtacaactatgttaagtctggcctcggctactgcgatattgctgagggcttcggtgacgaagctccactgggtgagcttatcaatgttcactatactgcgagattcgctgatgggatagtattcgatagcagctataaacgtgctagacctctcaccatgcgcattggtgtgggcaaggtaatcaagggactggatcaggggattttagggggtgaaggagtacctccaatgcggataggtgggaaacgcaaactgcagattcctccgcacttagcatatggccctgaacctgcagggtgcttctcaggtgactgcaatatacccgccaatgccactcttctgtatgatattaattttgttgaggtttattcggggaacagatcaaagtgaagtcagtcaaaactggtcagatacatatatacatatgaaccacagatggatgggtttagagcaatgaaatggacattttgctagagaatatggatcaacttgtttggcagaatcttcttcctgattacaactacctcaagttactgttcctggttagtggagttgtacatgattgacctggatatcccttttgagagtaatgagcaatccttcctggtgatatatattaagataattcatgtgtatctctgcacatgacatgcgaacagtttgtgcatctttagtgtaaatgtaattttcaatactgctctgaatgataaaaaattgttaattcttcatttgataaa

SEQ ID NO: 103 - DNA, 1373 bp, Glycine max
gttataaccgaaccacaaaagggtggttgaagttgaagcagagataagtgtctcaacaagtgatatgcaaagcatgtctctctgtgcttcactctcctccacagcttcacacctcacttcccttgcctccgtctcttcttccacctctccactttcccgcaaattttctctcactttccgggaaaaaaacagaaccccaattgcaccacctcacaagctccccttcttctcagcaaggcctgcccccaccagagtagtgttggtgaagtctcaggccacagcacctgcttcttctgaggctgtgaaggtgacaccggtgccttctgagatgaaggcatgggtgtatggagaatatgggggtgtggatgttctgaagctggactccaatgttgctgtgcctgatgtgaaggaggatcaggtgttaatcaaagttgttgctgctgctcttaaccctgttgatgccaagaggaggcagggaaagtttaaagccactgattctcctcttccgactgttccgggctatgatgttgcgggtgtggtggtgaaagttggtagtcaagtgaaggactttaaagtgggtgatgaagtgtatggagatgtaaatgagaaagcacttgaaggtcctaagcagttcggatctttggctgagtacacagctgttgaggagaaattgttggcaccaaaaccgaagaatttggactttgctcaagctgcttctcttcctctagcaattgagactgcttatgagggtttggagaggactggattttctcctggtaaatctattcttgttctaaatggttctggaggagttggaagcctagtgattcagctagctaagcaagtttatggagcttcaagagttgctgccacttcaagcactagaaatttggacctactgaaaagcttgggagctgatttggccattgactacacaaaagagaactttgaagatttgcccgaaaaatttgatgtagtttatgatgccattgggcaatgtgacagggcagtgaaggctgtgaaagaagatggcagtgtggtggcactcacaggtgctgttacaccacctggcttcagatttgtagttacttccaatggagaagttctgaggaaactaaacccttacttagaaagtgggaaggtgaagccaattgttgaccccaaaggtccattcccctttgataagcttgctgaagccttctcttaccttgaaacaaaccgagcaactggaaaggttgttatacatcccatcccttgaatcaagtaaaagggataggcaattttgccgtgtctgtctagtaaacttcatattctatgtaaatcagagtttagattaaagctaaaaaacaaaaataaagaacttcatttttaca

SEQ ID NO: 104 - DNA, 1230 bp, Glycine max
ttcttcttgaatccctcaaacccttccaactttttcttcttctgtcaacgtgaactaagattctacagattcttcctttgaaagaatgaacttgaaacaatactgttgtttcctcaaagatgaaggtctaaacaaaatacaggtttccaacaagaagaacagtagggactatccatgggaaatgtacactttgaaggagttgcttcgtgcaacaaacaactttcatcaagataataagattggagagggtggatttggaagtgtttattttggtcgaacaagtaaaagcgttcagattgcagtgaagcgattgaagacaatgactgcaaaggcagagatggagtttgcagtggaagtggaagtgttaggaagagtgaggcaccagaatttgttgggattgaggggattctatgcaggaggagatgaaaggttgattgtgtatgattacatgcctaaccatagcttgttaactcatttgcatggtccacttgctaaggaatgtcagctagattggcctagaagaatgagcatagcaattggagctgctgaaggtttagcgtatctgcaccatgaatcaactcctcacatcatacacagagatataaaggcaagcaatgttcttctagaccctgaattccaagccaaggttgctgattttggttttgcaaagctggtaccggatggtgtgacccatcttaccacaaaagttaagggcaccctaggatatttggcaccagaatacgccatgtgggggaaggtttctgagagctgtgatgtttacagctttggaattttacttttggagattattagtgccaagaaaccaattgagaaattcccaggaggagtgaaaagggacattgttcaatgggtcactccatatgtcaacaaaggtctcttcaacaacattgcggatccaaagttgaaggggaaatttgatttggagcaattgaaaaatgttaccaccatagctcttagatgcaccgatagtagtgcggataagaggcctagcatgaaagaggtggtggattggctcaagaatggtgtagggagcacttggggagaagagaatattccaactttaagtatcaagaatggagacgaaggaaatgacaaagatgacaaattaaaaaataactagtgatatgtataaagtgatatcaatttgtttgttttttattttggtttatttgtgaaatgagactgacgtttatttatatttcagaaaaa

SEQ ID NO: 105 - DNA, 1200 bp, Glycine max
gaaatacaaattaatgttgtcgaattctggtggaccaagaaagacttagtgtatttaactgatcccattgtttttatcttctcacaacttctctctctctctctatttacacttctcttctgtgtttcttagaagaattaagatggctaccttgactgtacctccagttcctccttcccccagagatgatgccatgcagctttaccgtgcttttaagggatttgggtgtgatacaagtgctgttatcaatatacttgctcatcgagatgctacacagcgtgcctacatccagcaagaatacaaagcaatgtattctgaggaactttccaagcgcttagcttcggagcttagtggaaagttagagactgcagttctgctctggttgcatgaccctgcaggacgtgatgcaacaatcattaggaagtctctaacagcagacaacaaaacccttgaaggtgctactgaagttatatgttcacgcactccatcgcagctacaatatttaaaacagatctatcattctatgtttggtgtttatcttgagcatgatattcaaacaaacaccagccccggcgatcatcaaaagctcttgcttgcatatataagcacacctcgtcatgagggccccgaggttaatagagaaattgctcagaaggatgcaaagggtctttacaaagcaggggagaagaaactgggaactgatgaaaagacttttatccacatattcagtgaacggagtgcggcgcatttggctgccgtcagttcttattaccatgacatgtatggtcattcactgaagaaggcagtaaagaatgaaacatctggggcctttgaacatgcacttttgacaataatccaatgtgctgttaatccaggaaagtattttgcaaaggtgttgcataaggcgatgaaaggcttggggactgatgattccacactcattagggtcgttgtgacaaggactgaggttgatatgcagtatatcaaagctgcatatttaaagaaacacaagaagactctgaacgatgaagtacactcagaaacatccagtcactacaggacttttcttctctcacttttgggccctaatcactagccaagatgttcaatgatgtaagtggaataaattcacccttgatgtgtaaatttgactgtttttagtgctttgtgatcaatgtagccgacaacttgtagaataag

SEQ ID NO: 106 - DNA, 1945 bp, Glycine max
gaagcctttccagtgtgcagctgcagctggttcaatgattcaaaattgttaagttctttgttttggagcattcatcattgtccaaattgcaattttttcagaagaatagcaacaatttaggaagtttctgaagcaatagggagtagtggacacagtttaggatcattgttattataggagaatttgatggtaatcatacacagtggctaggaaaggatataatggctactgctgcagtaattggactcagtggaggaaagaggctcttgagttcatcataccattactctgatgttatagaaaagctatcttatggcagtgattttggatccacacactatcaaattgttcctacaaagtctttaatagctgccaagaagtcatccaactacactccaacttttccagcatcgaaccagcagaatcagtccattaaggctcttaaggagcatgttgatgatgcccctaccattgcggattcatggtttcagagttgcaactctaacgacttagaggtggaaagctctgaaatgggttattctgtggaggctcttcttttgctgcagaagtcaatgctggaaaagcaatggaacctttcttttgaaagggaagtgctaaccgaacattctagtaagggaaaaaaatgtaagaaagtggcggtgacttgttctggggtgtctgcaaggcaaagaagaatgaataccaagaggaagactgcgattaaaacttgtggtgctatgcagctgaagtccaaaatcagtccagagctgcttcaacaccgtttgaagggctatgtgaaaggcatagtgagtgaggaattgctctctcatgcagaagttgtaaacctatcagagagaataaaagttgggctttccttagaggagcataaatccagacttaaggaaagactaggatgtgaaccctctgatgatcaaatggcaatttcattgaagatttctcgaactgaactacgagcaagaatgatagagtgcactctggcaagagaaaagttggctatgagcaatgttcgcttagttatgtctattgctcaaaaatatgataacctgggtgcagaaatgggcgatcttgttcagggtggcttgattggactactgcgtggtattgaaaagtttgattcttcaaaagggtttaagatttcaacttatgtttattggtggatacgtcagggagtttcaagagctttagttgagaactcaagaacattaagattgcctgctcatttgcatgagaggctatctctaatccgcaatgcaaagtttagactagaagagagaggcattactccaactattgataggattgcaaaataccttaacatgtctcaaaagaaagtcagaaatgctactgaggcaatcagcaaaactatctcgcttgatagagaagcattcccctctctgaatggtatacaaggagaaactcatcatagttatattgcggatgatcgagtggagaacatcccatggaatggagtagacgagtgggcactaaaggacgaagtgaacaaactcattaatgtgacccttgtggaacgagagagagaaattattcgactttattatggattggataaagaaggtcttacatgggaagacattagtaaacggataggtttgtcaagagaaagagtaaggcaagttggacttgttgcattggagaaactaaaacatgctgcgaggaagagacaaatggaagccatgctattgaaacattaaatttggactcatcatagaaatatgttacaatgtatatatacacagaggaagtatgtacctagaaatttgacttcctgattcaaaaagaggacaattatataagggaacattggagatttgtaaatccctttaaatatggttttagtaccaataaatatgggtaatttttgttttaatactccaaaaataaaatttttacttttaagttctca

SEQ ID NO: 107 - DNA, 1307 bp, Glycine max
gttttgtacctgggagctctcagctcactaacaccagctactactccctccccccaccccccactctctcacaaaatgtgccagggcctctccgccccatcgccgccgtgttcggcgcttctctccttcacgctcctcctcctcctcctctcggtggtgggcccggtttcggcatggcggccttggccccagagcaacaaaatgaacatcagcgattatgccttcggggactccaagaaatacgaggggtcctcggagttcgtgaagctgaggtaccacatgggaccggtcctgactaccaacatcaccgtccacaccatctggtacggcaagtgggagcggagccagaagaagatcatccgcgagttcataaattcaatctccgccgcgaactcgccgcacccctccgtggccggatggtggcgcaccgtgcagctctacacggaccaaaccggcgccaacatttcaaaatcggttcgactcggcgaggagaagaacgaccggttctattcccacggcaaatcactgacccggttatcaatacagtctgtgataaagagcgccatcacaggcaagacgagacccttgccgatcaaccctagaagcgggttatacctcttgctcacggccgatgacgtgtacgttcaggatttctgcacgtcggtgtgtgggttccactacttcacgtttccctcgttggttgggtatactcttccgtacgcttgggtgggtaactcggcaaagttctgccctggacagtgtgcttatccgttttcggtgcccgcgtatatccctaaccggaaaccgtttaagtccccaaacggcgacgttggggttgacggcatgataagtgtgattggacacgagatggctgaactggcaacgaacccgttggcgaatgcttggtatgcgggtcaggacccctctttccccgtcgagattgccgatctctgtgaggggatttacggcaccggtggcggtggatcctacaccggtcaggttttcgacgctcgagatggcgccacctataacatgaatgggatcagacggaaattccttgttcagtggctgtggagtcacgttctcaattactgtactggacctaatgcgcttgatcactgatcatctcctcagtcaatgtgctagatttttctttctttcttgggtttggtcttgtgcttctgtgggagtctggtaattttgttaagttagttaagtttgttcattaatgcaaataatgtaattttattgttattgttatatcatagtttatatcaagaaagattataagcctttttggtgtctaa

SEQ ID NO: 108 - DNA, 1297 bp, Glycine max
ttttatctatctacatggacattaacgaaatcgatgttccttcgttctttctctgccccatttcgctagaaatcatgaaggatccagtgacggtctcaacgggcatcacctacgaccgtgaaagcatcgaaacgtggctgttctcgaagaaaaacacgacatgccccattaccaaacagcccttgattgattacaccgatctcacaccaaaccacacccttcggagactcatccaatcgtggtgtaccatgaacgcttctcacggcatcgaaaggatcccaacccctaaaccccccgttaacaagaaccaaatttcgaagcttctcaaagacgcttctcattcccctctcacatgcctcagaagactcaaatccatcgcttcaggaagcgaaacaaataagcggtgcatggaagcttctggcgctgttgagtttctagcatcaattgtaatcaacaacaacagcaacattgattcttcaaatgaggctgactcaaacgacggatctggattcgagttgaaaacaagtgcaagcgatgaagcgttgagtttgcttcataatcttcatttatctgaacaagggttgaagactctcttaagcttcagaaacggcgagtttattgagtctttaacaagagtcatgcaaaaggggttctttgaatcacgcgcttatgctgtgttcttgttgaaatctacttccgaagtggctgaaccagtgcaactattgcatctaagacaagaactttttgtcgaactggtacaagtcctgaaggatcaaatttcacagaagacatcaaaagcgacccttcaaaccctgatccaattctctccttgggggaggaacaggatcaaagctgtggaagcagatactgttcctgttttggttgagcttcttctcgattgcaaggagagaaagccttgtgagatgatgctggtgttgttggaactgctatgccagtgtgctgagggaagagcagaacttttgagccatgcagcaggtcttgccattgtgtccaaaaagattctaagggtttcaactttggcgaatgatagagctgttaagattattctgtctctttcgaggttctctgcgactccacatgttgttcaagaaatgctgaaactcggtgtggtcgcgaaattgtgcttggtgcttcaggtggatagtggaaacaaggctaaggaaaaagctagagagatactcaaattgcatgctcgggcgtggaggaattctccatgcataccgaacaatttgcttaattcatacacgaattatgtgtgaaacaaaacgagaatttt

SEQ ID NO: 109 - DNA, 1385 bp, Glycine max
tgtagtaggttcttctatttttagtaaaaaattgtcttaatttttatatttaagcacatcttagggaagaaaataatttgtctttcccaattggtcacaaatgaagagaataatgtattttccaaaagacaattattgaaaactatttaatagggaaagggaaaagtgcaatattgatttgattttgtttccgttgtataaaaagttgttctgagtgagagaaagagaagaaaaatgggaggaagaatgcacacgaaatcagactcggaggtgacgagcaacagcatggagcagtcgtcgccggcgcgttctcctccgcggcggccactctactacgtccagagtccttcaaaccacgacgtggagaaaatgtcctacggctcaagccccatgggttccccacaccaccatttccactactacctctcttcccccatccatcactctcgcgaatcctccacctctcgcttctccgcttccctcaaaaaccctcgcaacttctcctcctcctcctcctggaagaagctccaccctcaccccaaccgcgacgttgaccccgacgaccatgacgacgccgaccaccacctcaagcagtcctcccgcaacctccgcttgtacttgtggttcttcctcctctttcttctccttttgaccctcttctctttcatcctctgggccgccagcaagacctacaagcctcgaatcattgtcaagagtatagtgttggagaacttgtatgttcagtcaggaaacgatggaactggggtaccaactgatatgttgtcgttgaactcaacggtcagaatattgtacagaaatcctgccactttcttcggcgttcatgtcacttctacccctcttctcattagctattaccagcttgcaattgcctctggccagatgcagaagttctatcaatcgaggaagagtcggcggagtttggctgtagtggtttcaggacaccagattcctctctatggtggcgtgtcagttttagggaatactaaagagcatttggagagtgttgcattgccactgaacctgacatttgtagtgagatcaagggccttcatcttgggaagattagttaagtctaaattctttcgaagaatcagatgttctgtcactttgcatggcaacaaacttggaaaacatcttaatttaacggattcctgtgtctacaagtgatatttattccctcatcccttaaatggctcagacgacatgctttcactttattacttgtaacgatagctggtacattttttggctcgttatttttagttttttgttacccatcatctagcagaacgaacttgtccaatgtccatttgtctccgtaaatatctgaacgccaattttaatgtaatatgtgttcattgctt

SEQ ID NO: 110 - DNA, 949 bp, Glycine max
ctctttcccacactcatatccaaaaccgaatccacttctctaactaatgggcgtgttcagcgaagatccgaatcccaacccgaacccgatcgtgatccgagaggtttgggcctccaatctcgaatccgaattcgaactcatccgcgaactcatcgatcgctacccttttatctcaatggacacagaatttcccggtgttattttccgaccacatgtggaccccaccaaacccttcaaccaccgcaaccgtccctccgaccactaccgcctcctcaagtccaacgttgacgctctcaacctcatccaggtcggcctcaccctcaccgacgccgccggcaacctccccgacctcgccggaaaccgctccatctgggaattcaacttccgtgacttcgacgtggcgcgtgacgcctacgctcccgactccatcgatcttctccgtcgtcagggcatcgatttcgcgcgtaacaccgccgacggcgtggattccacgtgcttcgcggagctgatgatgtcttcggggctcgtgtgcaacgacgccgtgagttgggtcacgttccacagcgcgtacgatttcggttacttggtgaagatcttgacgcgccgtaacctaccgacgaggttggaggaattcttgaaaaccgtgaaggtgttcttcggagataacgtttacgacgtgaagcacatgatgaggttctgtgacacgctctacggcggattggaccgcgttgcacggacgcttaacgtggaccgcgccgtagggaagtgccaccaggccgggtcagacagcttgctgacgtggcacgccttccagaagattgttgacatttattttgtaaaggaagagcaccgaaaacatgccggtgtattgtttggactataggcattctgttaattataataacataaaaataataaaaattcaattgattgattatttatttgttgg

SEQ ID NO: 111 - DNA, 1473 bp, Glycine max
gtcgaatccaattctctctctctctctttcttttcttgattatttttggtgtctcaattaaactttgttttggtctgaattgaaaagggtagtgaatagtgatgttcctctcgagatcaattctctttgtgtttgtgttctcagcttgcttgcttctcattccagccaatggaattcgatcatttgccagaacaaatggttatgaaactgaggttgaagaagttgatccttttgcgcaattcagagaggccccagaatacagaaaccagcggaagtgcactctaattgacacaaccaatgcgcaattagtatgtgatccttcacttgttcatgttgccatgaccattgattggcactacttaagagggtctattgctgcagtgcattctgtcgtgaaacacacttcctgcccgctgaatctgttctttcatttcattgcatcggatgcaagattggatagcaaggatgtgtttgaaaggattgttcacacctccttcccttcattgagattcaaagtttatgtgtttagggaaagtcttgttgacaatctcatatctccttcaattagggaggcacttgacaaccctcttaactatgcaagaagttaccttcctgatttgcttgatcaatgcattgaaagggtcatatacttggactctgatgttatagttgttgatgatgttcaagagctttggaaggtttcattgacagggtcaagagtcattggtgctcctgaatactgtcatgcaaacttcaccagatatttctcctatgagttttggtcaagtgctgagttttctgaggtcttccaagggaaaaggccttgttatttcaacactggggtgatggtgatggatttggtgagatggagagcgggcgactacacaaggaagattgagaagtggatggagattcaaaaggagagaaggatctacaagttggggtcactccctccctttttgctggctttcggtggtaatgttgaggccattgaacatagatggaaccaacatggtcttggaggggataatgtaagaaatagttgtaggactctgcatcctggtccagttagtttgctacattggagtggtaaagggaaaccatggactaggcttgatgccaagatgccttgctcagtggattttctttgggcaccttatgatctctacataccccatcaccatacataccatcattaccaccaccatcaaagaattgctattggctcaacacattcatcattttaggacataattttatattggttgattctgattcatttgttctgaatattatttttttgtatagacagaacaattaaaagattttgtaatgtttgttgatacatcttcaatagtattgtaacagagaatgtcatgcgaaacatgttgatgcacaattggataaagtatgagtttaattttcatgtttaaagatatttactatctaaaccaatcagatatcacctattag

SEQ ID NO: 112 - DNA, 1440 bp, Glycine max
gagaaaaagagttctaagctttgtctgtgactggtgagagccaaaagccgaagaaagggaagatggcgctatggatggaaaagggttcagagccattaaccgaaaccgagaaggcagaccttgaagccattgctgcactcaaagagtctgcagcctttgaattcaaggaaaagggtaatcaatatgtgaagatgggcaagaagcattactctgatgccattgattactacacgagggcaattgatcagaaagccttgagtgactctgagacctctattctctttgcaaatagagcccatgtgaatttgcttctagggaatcttagacgtgctctaacagattctaatgaggccctcaagttgtgcccttcaaatataaaggcaatttatagagctgcgaaagcttctctttcactaaacatgttggctgaagcaagagagtattgcttgaagggtcttcagtttgaccccaataatgaggacttgaagaagcttgaccggcagatcggtctcaagatatcagagaaggaaaagcatgaggctgaagcctccaaggctgtcgcggagacaaagaaacttgtgtctgcgattgaaaatagaggcttgaagattggaaaggcaatgtatctagaacttactggactacggaaacctgtgttggataaaagtaatatccttcattggcctgttcttcttctgtatgcagaggttatgtccagtgacttcattgaggatttctgtgagactgacatgttttcggttcaccttgatatgatattttcagaagatcagccgttgtcatgggatgttgaaaacaactacaaacgtgaatttattgaattatactatgagactggttctggactttgtctatcaaaggaaaaacttcttcattgtctattagagggaactgcagctgctcacagggaaggtgttggtgatgaagagaaagacacagttgaggattataagcaacacatgggttcccctaaatggatcaaagtgaatgaaaggagaacactccacgatgttctcaaagagcctaatttcatcattcctgggatcccagtcttctatgttgtttctaagcgatccagcttttatggcaagttcaaagctgggaagtgggcacctccaagtatatgaaggaagcaacatgtagctgatgtccaaacagacatgttttgcacaaactagattcaagagttaatgtctcaactcaacttggaagtcttgaagattgctcatagttcttccaactttttggacttccttttaaactagagttacctgctaattgcaattgtgtgtgccagtgatagtgttagaatacaaggaacctagtcaacaaagtataatttgatatagcttgtgattttttggtacatgtataatttgataagttttgttctagacttttatcaagttctaggtgcataat

SEQ ID NO: 113 - DNA, 1228 bp, Glycine max
ggaacttggaggaacttgtgtctgtgtccctttttacagagtcatgactatggctggagctttgagtctctcccaattcccagttcgtgggtctgtttctttgcccaaaagaagaatacccagaagaagcttttgcattaggggcatgtcagaaatctcttccactttttctgtgagcacccaacaagaagaaccaacttctaatgcttcgtcagtgacaattgcacctccccccaacttcaagccccctgagcctaaacgctttgcaatcagacctgacaagaccagtgaagtatttggagctttgcttcctttgctctttcgctttgctaccggagttttcgtttctgggtattctttttcaattgtttctaaggatgaaattcctccagatgaatatgctttggaacttaatggcgttaccataaaagaaacagcaaaattaggccctcgcccagagaagcctattgagatatatgaatttgagacctgtccattttgccgaaaggttagagaaattgttgccattttggaccttgatgttcttttctatccttgtccaagaaatggcccaaatttccgtcaaaaggttctagagatgggtggcaaactgcagttcccctacatggttgacccaaacacaggcgcttcaatgtatgaatcagatgacataattcggtatttggttgacaaatatggtgatggaaacgttcctctatctttatcacttggatttttaacgaccctaactgctggtcttggtatgcttagtcgtatttcaaaggggactacttatactccagcgaagttccctccaaagccacttaaattatgggcatatggggggtctcctttctgcaaacttgtacgtgaagtacttgtggaattggagctgccacacttgcttgtctgttgtgctaggggtagcccaaagagaaatatactatatcagaaaactggaactttccaggtatttgatttttctaatccatacactgggatagaaatgtttgaaagtgctgaaatcatagagtatctaagagcaacatacgctcttcagtaagtgatgcctatgataggaagaggcttgtgagggtttttaagtaaatgtaattgctaatggttctaacagggttacatcaaattttctctatatagaaatttcaaatagtggaatcaagtgcctcaatattcagcaatggtttcaggtggataaaatttcggttgc

SEQ ID NO: 114 - DNA, 1252 bp, Glycine max
gggtaaggtaagggcgagagagtccagtgagtgttagcggttctggttctggaaattgatcgagtcgaaaagaaccctaacaataacatggattctcaggttgccgtagctcttgctctttcacttgttggtggtgtcagcacttctatcggtgcactttttgtaattgttaataaagctcccagtttgaagatgcttgggctattacagggttttgctgctggtttgatgcttagcatatcgttctttgatttggctcacaatgctttgaactcattgggcttcttgaaaggcaacctttggttttttgctggggtaatattctttgctgttgttgccagttttatcccagagccaacacttacacccacttctgatgtgaagggcagaaagaaaaatggggatgaaggaggcaaggatattatgaaaaagcatcgccggcaagttttgttcagtggaattgttacagccgtaggcataagtttgcacaattttccagaaggaatggcggtgttccttggatccttaaagggcctccgtgttggcatcaacttagcattagccattgctctgcacaatatcccagagggtgttgctgttgcacttcctgtttattttgcgacacaaagtaaatggcaggcattcaaattagcatcactttctggctttgctgaacccctgggagttataattgtagcctatctattccctagcagcttaagtcctgagattctggaaggtttacttggatcagttggtggagttatggcttttctgacccttcatgaaatgcttccattggcttttgattatgcgggacagaagcaatctgtgaaggctgtctttttggggatggctttcatgtctgcaagcctgtattttctaagtatcagcttacctgaggacttaagcttgtaggtgggaacaacctcttctcttctctaaatgtcatgaatttcagtcacattgtgatgtgtttcctgattctatcacctatcgcagcaaagttccttcagaaggggtctcacagagtgtccaaggacaataatgcaccaccatgtgtttaggatacctatcaatcagacatcaattttagggatgcattccacctatgattgtggttcccctatagactaatgtacaaaaaaaaaaaaaagaataagagtacagcccctttaattcttttactgacccaccttgtatactgtatcatcaacgtgattggactttaaattgcgcaatttgcagataa

SEQ ID NO: 115 - DNA, 1426 bp, Glycine max
tttctcttttacagccgtttttcttattttatttatttacttcggcttgattttagtttcgtgttgtgatgttttctgtggttctgttgtgttatgttcagttcgttgcatgcaaaaacgattatgaagacgccaaaacgccactcgccgccgccaaattcttccctgcgagtggagtctgattccggcgaaatcgtcacgaggttcaagaacggtcgccggagaagaattaaaatcaagcgaatgaaatacacttgccagacgaagatccgcgtcaggaatgacgccggcgccggcggcgtgtctcaacttctggcggtggattctgaaggagagaagagagagattcacgagaacgtggagatatcgctgtcgctggcttcgtcgtcgtcggaagaggaagagcgattgtcgtcgaagcaaaacgacggcgttttgtcgtacgggtcggcatcggtgatagggagcaggaaggagatggaggacgcggtgagtgaggagatagggtttgctgcgaagtgcgacttcttcgcggtgtacgacggccacggcggagctcaggtggcggaggcgtgcagggagaggctgtacaggctggtggcggaggagatggagaggagtgcgagtcacgtggaatgggactggcggggagtgatggaagggtgttttcggaaaatggactgcgaggttgccggcaatgcggctgtcaggacggtgggttccacggctgttgtcgccgtcgtcgcggcggcggaggttgtcgttgctaattgcggtgattgtagggccgtcctgggaagaggaggtgaggccgtggacttgtctagtgatcataagcccgacaggcccgatgagttgatacgaattgaagaggctggtggaagggtcattaactggaatggccagcgcgtgcttggtgttcttgccacttcacgatccataggagatcagtaccttcgaccttatgtaatatcaaaaccagaagtgacagtgaccaagcgaagcagcaaggatgaatttctcatactagcaagtgatggattgtgggatgtgatgtcaagtgaagttgcgtgccaagttgtaaggaaatgcttccacgggcagattaggagagtgtgcgatggagttgggaatcatcaaaaccgtgctaccgaggctgcaggcctcttggcagagatagcattggcaaagggaagtagagataacaccagtgtcattgtagttgagctaagaggatcagtaacaactgattgaggcctcatttctgccaaaacatgtatctttatttttattttcttctctacttattggcttgctgcttttggactaatatctactcaggatgtgcctcttcaatgccacaagagattatctacttgataataatgagtacatgctatgtcacattagtgtttttttttttttg

SEQ ID NO: 116 - DNA, 1703 bp, Glycine max
aacacaacacagtaagtaaagagaagcagtttccagtctccgtcagtaaaacgatgggcgacttcacggttgcgttaaaccctcccaaaaccttccgctccgacaatctcctatccaccaccaaccgcatttccccagcggcgcgtggctttcaaacctcactcgcgttcaaaccgcgcgtttttcgaggaatccgcgcttcggtgatgccaagagagggccagccacaacaacaacaacaacaagcgtcgtctctcggagacgctctcgtcaacagtccgcgccgaaacgacgtcgtcgaggccatcggaagaaccgcatcgctctccaactgcctctccgaaacgaacctccacgccaccgttcccggcctcgagtccaaaacccgcggcaaagttcgagatatatacgacgctggggattacctcgttttggtgaccactgatcggcagagtgcgtttgatcggattcttgcttccattcctttcaaaggccaggttctcaatcagacgagtttgtggtggtttgaaagaactaagcatatcgtctctaatgcggttgtatcagctccagataacaatgttacaatagctaggaaatgttcagttttcccagttgagtttgttgctagagggttcgtcactggaagtactgatacatctctatggacagtctacaataaaggcgttcggaactattgtggaaatgtcatcccagatggaatggtaaaaaatcagaagttgcctaaaaatatactcactccaacaaccaaggctgcagatcatgatgttcctatcactccagatgagatcatagaaaggggactgatgactcgagctgattatgtagaagcaagtgaaaaagcattatccttgtttgaatatggacagcaagtggctttggagcatggcctcatattggtagacactaagtatgagtttgggaaggcaaatgatggttcaattatgttgattgatgaggtccatactcctgattcaagtagatattggattgccaattcttacctggagcgctttcaaaatggtcttgagcctgaaaatattgacaaggagttcttgaggctgtggtttaaaagtcactgcaatccatatgaagatgaggtccttcctgatgctcctgaagatcttgtctgtgaattagcctggcgttacattttcttgtatgagactataacaaaatcaaagtttgaggtgcccttgaccgaggagcctatacatgaccgaatttcacgaaatgttgcatctgcactgtcatccttaaagtagcctgggaattatagggcactgttgtaattctgtattttaatatcttaatataaactatatcaaaaacttaaattaatggagaacttctccaagcaagtttttatttttcctaagtataacttaaagcagaaaggcaaaacaacagacagttttcagaaatttgacatgtgattttttttaagaataaagagctgtttttggaagcagaacccattgtgtcctttgccttgtatatttcattgtgacagtacgagaattaaatattatctgttctgtatgaggaattatttgcgcatgttactacattgtgcaatcttacctttccttttcttttctaccattgtttatcatccatttattcttcgggagacagaccgaagagaaatgtcaaaatgatggtgcactgagttagaagta

SEQ ID NO: 117 - DNA, 1401 bp, Glycine max
tacttgaaacagtcgctgctgcgtcttcttcatccgtggtgttagggttttggtcggagtagccttttgcttcgtccaatattttggacatggacgccgaagcggaccctcctcaaaaccctatcacaagacacaaatgcttggcatgctataagcaatataagaagaaagagcatcttattgagcacatgaaaacctcgtatcattctgttcatcagccaagatgtggggtatgtcaaaagcactgcaaatcttttgagtctctgagggaacatcttactggtcctttgccaagaggaatttgttcaaagattttctctcaacagggctgtcaactttgcctggcactatttgatagtcccgggtctctcattgatcatagaaaaatatgtcgcatatctgcccctacttgtccaggaacaagcgcattgccctatattgattcccagtttgattgtcaagatttttctgatgaaaaccatgctggcgagggccctggaggagcagttgcaatggactgtgaaatggttggtggtggaagtgatggttctctggaactttgtgctagagtgtgtttggttgatgaagatgagagattaatcttccatacttatgtacagcctgaaatacctgttactaattacagatatgatataactggattgacagaagagcatcttagaaatgccatgccacttaaggaagttcgagaaaagctactgcaaattctacacaatggagaatccattggcaaagttagactggatggtggaaaagcaaggcttcttgtggggcatgacttagcacacgatttggattgtttaaaaatgaattatcctgatcatatgctgagagacactgcaaagtaccgtccgttgatgaaaaccaacttggtcagccattcactcaagtatctcacccgaacatatcttggttatgatatccaatccggcactcatgacccttatgaagattgtatttctgtcatgagactatacaagagaatacgatctcaacttcatccggaggaagaccatggaacaatgaccctgagtaacaacattgttggcatgcctgatagctggatatctagggaacttgacaacctcacaccggatgaactttatgccatgtctagatcagattataagtgttggtgcttggatttgataccaagattgtcagcctgaattattgatctttgcatttgtccataacatatcataagcatatttcttcaagaactatgagaatggagcatttgcaatgatattttctgtgcatatcttcctatgcatcgagttatcttccagacaagaaaattacgagaaaagataggtgctttatgatggagcttttgtaaatatttagaacgctttgttcaaatcacatgcccttttt

SEQ ID NO: 118 - DNA, 581 bp, Glycine max
ggatgcatattcttatctaacgttctcactcaaacctcttctatctcattgtctccactttcttctcttttttccccttttaacactttctcttccttgcatctctacgttcctcttaccacaaggtaaacaaagatggcagggtgcgataaggaagactatttctctgccccgaatgctgagacaacatccgagggaaagtacggtaggcttgccccaaagaagaagcctttgatatcgaaagataatgaaagagcattctttgattcggcagactgggcattatgcaagcaaggtgctggagtgaatcaacaatctacagcaacagtggagacactgcgaccaaaactacagagaactccacatcagcagcttcctccaagacgacctgcatgcacatctggttgagataatttcgtgaattactataatgtggagagtagacttaataaacggaacaaggatttgctcagccaaatttactattacaaaactcatgatgttcctgatctgatgtatattacaatttacttcatgctttgtgttattagcagttcaataaaaattccatttcaattccc

SEQ ID NO: 119 - DNA, 1014 bp, Glycine max
gggttcttcattttgttcctcccacgcatattttctgaccaaaaccattagcaaactagtgacagaaaaaaaatggttggtgactaaatagaaaaaaataaaaaaagaacacaatcaaagcattaagagagaggaagaatgcaaatggcaattttgttaagaggaggagcacttggagattctagctttcgtttgtgttcattaacatcaacttcttctttgcatgtctcccaaaatgttgccatacccacctcatcatcatcaccaatactacccttgattgcaagtaaatttaaaacggccagcagaaacagaattacctgctctgccgttcaagaatcatctcctagcacagcagctactactgctgaaacaaaggaggaggtaaaggaagccccaaaagccgcagcaccagcaaagaaacctcctgctaaagctccagctaagcctctgcctcagatgatggaggaggatgtgatcccttcactgaaagcaatatttgaagcccaagaagatttctcaaatattgagctggtcttcaaggacaataagttggaaggttcgtttttgaagaaaggtaacccctattcattttgggccttctttcccacaggaaaccttattggtccaaaggggttttctctgtcatcgtataactcgagagcaagcaccgttgagccatttctcgttgatgaaaagaagatcactgcaagacacattatcttttgggttgaaaaacgtttggcagcacaggggatcattcctgtatggaaagattagtcccttgacaatgaaattatactctggttgctgattatcatgtagcatatatacaattcaatattctcttgttcctttcattaatgactatggtatacaaaatggttgtgttggtcaatgtgtcattgtacatgtcttttatcatagaacattttgttgatgaacgcacaagtttttgatgattcggtaacaagacattttttttaatctcatttcactttttccatgacctaa

SEQ ID NO: 120 - DNA, 3151 bp, Glycine max
atacataagcggtgagaatgagacgatagtatctagttaaatattaaccttttctttttccacaaaatctcacatcatgaataatagaatgagttgagagtcttgtgttgttcacctgtaacgtaacaagtaagctccagcactgtcttttattctctttcctttgatccatggaagcctgtgatctcatgtgatagttggtgtgctgcataggaaaggctttctaacgtgtcttctaaggtggtttcactgctccacggttgccgaatctagcttcttgcttctttctccttccaagatatcctttgattcaactttggatcttcacctctgatttcctttcatcgttgggtttatacacccttggggtttcccctcctcacccaactgtgtgcaacaaccacaaagtgtataccgtgtgttcttcctagaggggagaaaaaatggccacactttcagatattggggttgcagctggcttaaacattttgagtgcatttattttctttgtggcttttgctattttgaggcttcaaccttttaatgatcgggtatacttcccaaaatggtacctgaagggtttaagaacagatcctgtccacggaggagcgtttgttcgcaagtttgtcaatttagattggagatcatatcttaggtttttgaattggatgccagctgcacttagaatgccggaacttgaactcattgaccatgctggattggactctgttgtttacttgaggatttacttggttggacttaaaatctttgttccaatagcatttctggcatgggcagttctggttcctgtcaacgccacaagtaccgggctagaaagtgctggtctggacaacataacttcgagtgacattgataaactctcaatttcaaatgtccatagtacatctgaaaggttttgggcacacatactagttgcttatgcatttacattttggacatgctacattttactaaaggagtatgaaaaagttgcctcaatgagattgcaatttcttgcagcagaaaaacgtcgccctgatcaatttacggtgctcgttagaaacattccaccagatcctgatgagtctgtcagtgagcttgtggagcacttttttctggtcaatcatccagataactatctttctcaccaggttgtttataatgcaaacaaacttgcaaagttggttaaaaagaagaagaagttgcagaattggcttgtatattatcaaaacaaagttgaaagaacttcagaaaggcctcaaataaagactggcttccttggtctttgtggaaacaaagtagatgctattgatcatcacaacactgaaattgacaaactgtcaaaggaaatagcgttagagagggataatgtcagcaatgatcccaagtccatcatgcctgctgcatttgtttcgtttaaaacacgatggggtgctgcagtctgtgcacaaacccaacaaactagaaacccaacaatgtggttgactgagtgggcgccagagccacgtgacatctattggtcgaacttggcaattccatatgtttccctcactgttagaaggttgatcatggctgttgcattcttttttctcaccttcttttttatgatcccaattgcaattgtacaaggtcttgcaagtattgacggaatccagaaaagagcgccatggttgaatcctcttattgaaattcctttcattaagtcattcattcaaggttttctaccgggtattgcattgaagctttttctcatctttttgccaacaatattgatgatcatgtcaaaatttgaaggcttcggatctatttcatctctggagagaagagcagcatctagatactatcttttcaattttgtgaatatatttcttgggaacatacttaccgggacagcatttgaacagctggactctttcattcaccaagcagccaatgaatatcccataacaattggcactgcaattcctttgaaagcaagtttcttcatcacttatataatggttgatggatgggctggtatagctgcagaggttttgatgttgaaacccctaatcatatatcacttgaagaattttttcttggtgaagactgaaaaggatagggaagaggctatggatcctgggagtattggtttcaacactggagaacctcgaatacaattgtactttttgctgggtctagtctatgcttcagttacacctactgttcttcctttcataatagttttctttgggctcgcctatgttgtgttccgtcatcagattatcaatgtttataatcaagagtacgagagtggtgcagcattctggcctgatgtccattttcgtgtcattattgcactgatagtgtcacagatagttcttatgggacttcttaccactaaaaaggctgcttcatcaactccatttctaattgtactcccagtactgacgatatggttccatatatactgcaaaggacgtttcgaacctgcgtttgttagatatcccttacaggaagcgatgatgaaagacacattggaacgagctacagatcccaactttaacttaaaagcttaccttcagaatgcttatgttcatccagttttcaaagctagcctttttgatgaggacgaggacgaagaggtaatgagtctaaagttggaaactgagagtttgactgtacccacaaaacggcaatcaagaaggaacacaccattgcctagcagaattagtggtgcatcatctccttctctgcctgatcatggcattcgaaatcatccagagccataaatcatggacaccaaggaatcatatcattattttggaccgaccacaaccacgaccacataggctagtaggatggatagatgaaccatggatgtgtgcatatgtaacataaactgagaaagcaagctagtgtgatcagcacaaactgtaaggtagagattattattatttcgaattttgttaatagtgaatttgttcccttacaccacggaatgctgtaaattatccaagagctgaatcatggtttagatcgtgtgtatatttttttttttcttttaccttctgcttttccttcagattcaactcagtttgcatgaggaaaagaagtgtgtttgtactgtacttgtgctcgtttttaaatcaatgactttccttttcgttta

SEQ ID NO: 121 - DNA, 1352 bp, Glycine max
caacaatctgcaaagataaaataaacaaaaagaactcgaaagaaggaggaaaacaaaaagaaaaatttagtaactaccgataccatataataataagaatagtattattaaaagagaaagggaagggaaggtaacacgctatggcggcggaatcgggtggtacgccgacaaactttgatcttcccgaggaggtggtgcaagtgctaccgtccgatcccttccagcagctcgatgtggctcgcaagatcacttccattgctctatcgacacgtgtcaacaccctcgaatcagagctgtcctcgcttcgcgcccagatcgccgacaaagacaacctcatcgccgaccttcaatctcagctcgactccctcgacgcttccctctcccaaatcgccgacaaactcctccaaaccgaacaagataaggagagcttgctccaggagaatgcttcgctttccaacaccgtcaaaaagctcaatcgagatgtctccaagttggaggttttcagaaagacgcttatgcaatcacttcaggaggaggatgataactctggagcagctccagacattgttgctaaaatacagagtcaagcaagtttgacttccacgtcgcagattggagataatgatgtttcattgccaccgtctgtatcttcttcaacaggaaattcttttgccaaggatcatgaatctgatgccataagacctagagtatcacagaatctcctcttagcatctcaaggttccacccctcggattactccccctggttcccctcctagtttgtcggcatcagtatcacctacgagaacatctaaacctgtatcaccacagcgacattcaatttcctttgcaaccacaagaggcatgtatgatgacaggtcttcaatgttttcctcaatgtccttaactcatggttcaatatcaagctctgatgcaggaacaggatcacaaactggacgaacacgggtggatgggaaagagttctttcgccaagtcaggaaccgtttgtcttatgagcaatttggtgcattcttggctaatgttaaagaattgaattcccataaacaaacaaaagaggaaacgctacggaaagctgatgaaatttttgggcctgaaaacaaggatctgtacactatatttgagggattgattaatcgcaatctccattgacattgtgcttaagagattctttccaaatttgtaataacggatactatcgtgcatgtctccttatttatagcaacttttttttctcccctctgtataatacaatacttttttttgaacatgaaaaccgaatgacagtcttggcaggactacaaggttgcagttggtttccttgcagtagggatg

SEQ ID NO: 122 - DNA, 2969 bp, Glycine max
atccacaaagaacaccacgtgtcctttcctccattctgttacagactccatcttcttccaccacctccatttcccattcattccaccacactctgcgttcaacaacaccatgccactgcgtaaccatttttctaactaacttctcaaaacgacagcgtcgcagaaaatgacaattacgctttcaccctctctctctgtaccccacccttcccctttctccctcaccccaaccaccaccctccgccaactcttcttcactaacttcacaccgtccccgagacgcaggctccaactccaagcacgtgcgggaaagcccaatgtcctcatccccataaacccctcggtggcagttgagaaaggaaagtacagctacgacgtcgaaaccctaatcaaccgcatcaccgcgctgccgccacgtggcagcatcgctcggtgcctcgaccccttcaagaacaagctctcccttaacgacttcgccctcgtcttcaaggagttcgctcagcgtggcgattggcagcgctccctccgcctcttcaagtacatgcagcgccagatatggtgcaagcccaatgagcacatatacaccatcatgatcacgctattgggccgagagggcctcctcgacaagtgccgcgaggtgttcgacgaaatgccatcgaacggcgtcgctcgcactgtctacgtctacaccgccgtcatcaacgcctacggccgcaacggccagttccacgcctcgctcgaactcctcaacggaatgaagcaggagagggtctcgccgagtattttgacttacaacactgtgattaatgcttgtgctaggggtgggttggattgggaaggcttgttagggttgttcgctgaaatgaggcatgaagggattcagcctgatgttattacttacaatactttgcttggtgcttgtgctcatagggggttaggtgatgaggctgaaatggtgtttaggactatgaatgagagtgggattgttcctgatattaatacttatagttatcttgttcagacgtttgggaagttgaataggcttgagaaggtttcggagcttcttagggagatggagtccgggggtaatttgccggatattacttcttataatgttttgttagaggcttatgctgagttggggtctatcaaagaggcgatggacgtgtttaggcagatgcaggctgcggggtgtgtggcgaacgcggccacgtatagtgttttgttgaatttgtatgggaagcatgggaggtatgatgatgttcgcgatatttttcttgagatgaaagtgagcaacacggaccctgatgcggggacttataacattctcatacaggtatttggggagggtggctactttaaggaggtggttactttgtttcatgacatggtggaggagaatgttgagccgaacatggagacttatgagggcttgatatttgcttgtgggaagggagggctctatgaagatgccaagaaaattttactgcatatgaacgagaaaggaatagctgcactgtatgaagaggctcttgttgtgtttaacactatgaatgaagttggaagcaacccaactgttgagacctacaattcattcattcatgcatttgcaagggggggactgtacaaagaagcagaagcaattttatccaggatgaatgagtctggtttaaaacgggatgtgcattcattcaatggtgtgatcaaagcttttaggcaaggaggtcagtatgaagaggctgtaaaatcttatgttgaaatggaaaaagcaaattgtgaacctaatgagctgacacttgaagtggtgttaagcgtatactgctccgctggtcttgttgatgagagtgaggagcagttccaagaaatcaaagcttcaggaatactgcccagtgtcatgtgctactgcctgatgctagctctttacgccaagaatgacaggttaaatgatgcctataatttgattgatgagatgatcacgatgagggtgtcggatattcatcaaggaattggacaaatgatcaagggagattttgatgatgagtctaattggcagattgtggagtatgtctttgacaaactcaattctgaagggtgtggattgggaatgaggttctacaatgcactgttagaagctctttggtggatgttccagagagaaagggctgctagagtgctcaatgaagcatcaaagcgagggctgttccctgaactttttcgtaaaagtaaacttgtgtggtctgtggatgtacacaggatgtcggaaggtggtgcattaacagcactatcagtttggctgaacaatatgcatgaaatgtccaggaccggcaatgatcttcctgagcttgcaacagttgttgtggtccggggtcacatggagaaaagcacagaagcccaagatttccctatcgcaaaggctgccatttcattcttgcaggataatgtcccatcatcctttacttttcctggatggaacaaaggtcgcattgtttgtcagcagtcacagctgagacgaattctctcgggcactgaatcatcttctagtaggaaaaaaatggataaattagtatctttaagtaataccccattgactactgcaggagttataacatccaaatctgatgtgcaaagtggtaaagctaatgatgttgattctagaaccgatagtacaagaacagagcttctaacgagtgcaatttagatcagattagaaagtatagaatttacattcatcactttcccatgccctgttttggtctttttgaaattaagattggggcttatttgttacacttccacgaaatattcccaagtgggcgctggctttcagatcgccaaaattttggtatatatatatattatcaaggtatctgaacagttgtctgtcgtcaccaatatttttcacctgtgtatttgatttcctgattctggatagcatagtggtcactacgaaaaatactatttttttttcc

SEQ ID NO: 123 - DNA, 880 bp, Glycine max
tgtaccttcccttgctccttctcacttcacaacactcaccccatttttctactcctttccttcttccctccttttatttcatttttctaacaaaatggaggaaagggtggtaccaaagaggccaagagaagaagagaccctagagcacaaagatgcatcattagatagttatgaattactagagtcctcatcaaagaggcacatgccatacaaccacatactatccctccttgaatcagaggaagaagactccacacaagacctctctcctctcatcactgccctccaacaagaaatcaccaattgtgccaatgattcggatacccttttgagccaacacaacctcaccaacaccacaacaacaactaataataatttagagtcttgttcatcctcaacaactcaatattctagtaacatggtggaggaacatgatgacaaagaaggggtcatgagacaccttcttgaagcttctgatgatgaacttgggattccaaataaagaggatgaatcactcgatcatggtgaagatgggttcaatttcaacggtggggacatgttttcttccttttgtgatggtttgttgtgggaccttgaagatgaagctgccaactactatgatctcttgcagtctcaactctttctttagttttttttttttttttggtgggggtagaaagtgaaaaaccaaagtttttcatgcgttcaagatgaaatccaaggagaaacaaaggaaaaatttacactctttttttttcagttttttgtcccctctttttgtaaattaagatcatgggaggcttacgtggttggttattacttggcaatatgtcgatctgtagaaaaagcaacttggcttatactcacattacattacaca

SEQ ID NO: 124 - DNA, 1419 bp, Solanum lycopersicum
accccatccaaaaaaaaaccctttgttttgagagcgtgttaacaagaaatttagagatggctggtgaatttagctcccttgttaacaagatcaagccttatttggctatggtgtctttgcaatttggttatgcagggatgtatattgtcaccatgatgtgtttcaaaagaggaatgagtcattggattcttgttgtttatagacatgcatttgccaccattgctgttgcaccctttgctatcgttctcgaaaggaaaataaggcctaagatgacacgcagggtctttattaagatagtggctcttggttttctagagccagtgattgatcagaatttgtactatttgggactgaagagtacaactgcaacttatgcatctgcttttgttaatctcctcccagcagtaacctttattctggctgtagttttcagaattgagaaggtaaatttgaagaaaaaatcaagtatggcaaaggttataggaacagcaataacagtggctggagccatggtgatgactctatacaaagggccaatgttcaacctggtcccacgtcacggtggcgcgcaccacgaagcctctgtcgcggcccctgagaattgggtagccggaaccattgagctcatcgcttgcattgttggttggtccggtttctttattgttcaatcgatgacactgaaagagtatcccgcggagttatctctagcagcatgggtatgtgtgatgggtgtagtggaaggtggaattgttgcacttataatggaacgtgattggaatgcttgggttattggatttgactctagactccttgctgctgcctattctggtattgtatgctcaggaattgcatattatgtgcaaagtgttgttaataaagttaaaggcccagtatttgtaacagcctttagcccattaagtatggttattacttcaattcttgctgctattatcttagctgaatcagtccatcttggaagcttaattggagcaattatcatagtcatgggactatattctgtggtgtggggcaagagtaaagaagggaaaatcaatgatatcactagtaaagatcaagaattaccagttgtggatattaaagaaagatcaactattgttgatgataatattaatgagaagaaaacttcaatctaccaagagcattaacatgatttaaaaaaaaaagaagaagatgttgtatctttaaatctgtaattttaatttttgacttgttgcaatgtttaaattttctaagtgttgctctttaaaacaatgcaactaatgttgtgatcaattgttgcctaatggaaggggaagaaaaaaatgtgtaatctactttttgtgtaaaagttaaggagttgtatctccatttgggaatgaaaaatgaaaatgttttatattatatttatcgttttgatat

SEQ ID NO: 125 - DNA, 873 bp, Solanum lycopersicum
aacgcagttgttatctctcaattttcccgtctgtgtattataaaataatgagccgacatcctactatcaagtgggctcagaggtctgacaagttgtttattacggtggagttaccagatgccaagaatgtgaagctgaaactggaaccagaaggaaaattcttattctctgcaactgcaggagctgataatgtaccttatgaagtggatctcgatctgtttgataaaattaatgttgatgagagcaaaagtagtactacctctagaagtatcgtgtatctagtgaagaaggcggaagacaagtggtggagcagactggtaaagcaggaaggattacgtccggtgtttttgaaagttgattgggacaaatgggttgatgaagatgaagaagacagtaaacctgagccagatatggattttggtgacatggacttctcgaaactcaacatgggagaaggtcctagcgattttgatgttgatgtgcctgagggcgatgatgacagtgacactgaagaaattgaggaagaagaaaactctgaacccaaggcagcagtgcctccaagcaccgaacccggagtgaaagcttgacgcattccagcgtttgtaacattgaaaactttttaactgcttgagtttgagtgtggtacttcttctagctatggttagagctgtagtgcaggaaatgtttgatgatcagttcatgatatatttgaaggatctgaaagggctggtgtcctcattgaactttgttatcatgtactgcacattacatatgatttctcaaacatatataaaaactatgtaatactggctagtgcagtgcaacgttcagtttgcacaataacatgtggaaatccatgttatcgttataaga

SEQ ID NO: 126 - DNA, 1416 bp, Solanum lycopersicum
aaaacgcgtttacttttaacaaacattctttgcttctctttcttcccttgtgattcaaatttcttttgctatggttctttctaaaaaactcatcttttttgttctgtttttgtcgatttctctgtttctatttccagcaagtgctatcagaggttttgttgagaagcccagaaatataaaaattgatgggtatttggattatgttgaatctccagagtatcgtaatagccgtgaatgtccagttttagatacgaatatgttaatttgtgacccaaatttgatacatgtagctatgactcttgatgtcaaatattttagaggatcagtagcagcagttcactctgttctcaagcattcatcttgcccagaaaatgtttatttccattttgtggcttcgaaggataaagattttcaagacctgagaaagatggtgaagtccatatttccatctctgagtttcaaagtttacagctttaatgaatttcgagtgaagaaactgatatcatcttcgattcgtcaagctcttgataatccattgaactatgctaggacttatttagctgagatcatccagccctgtgttgaaagggtaatttatcttgattctgatgttgttttggttgatgacatccaaaagttatggtcaatttctttaactggttcgaaaattattggagctccagagtattgtcaagcaaatttcagaacatatttcaccaacaatttttggtctgacccgaaattatcgaatgtgtttcaagggaaaaagccttgttatttcaatacaggggtgatggttatggatttagggaaatggagaaaaggggattatacagttaagattgagaaatggatgaagatacagaaagaaaaaaggatttatgaattgggatcattgccaccatttatgttggtatttggaggggaaattgaaagaattgatcatagatggaatcaacatgggcttggtggagataatttggtgaatagttgtagaacattgcatccaggtccagtcagtttgttgcattggagtggtaaagggaaaccttgggtcaggcttgatcaagggagtccttgtcctgttgatcttttatggatgccttatgatctgtatagacttagctcaattgattctttgggcgatcaagagcgaagagctatgatttgattgtttaagcaccagtaagtgtatagaagttaaaactctttagcgattctttttctacattgtgaagaagtgagaacttagatccagtattaagtacaggggacgattttgatgagtcccttgtgagtgatttcttttgtgtataagagcaaattatttgtgtaaagcgattattcattcattatatttgtgataatctgagtattcatttgataactttttaattttgaaaatattgtaagata

SEQ ID NO: 127 - DNA, 1666 bp, Solanum lycopersicum
ttttcttataatttaggattatttttctttatgttatttctctttcatattttgttagcgcaatattccccttttagaaaatctgaattgaaagagaccagcataactagcgaggtgtttctcgaagctagagcttctagctttaattaatgccctttgctaaactctctgctcattacacatagatcactaagggggatgaagaatacttcaagattttgagttttttgtatacccttttggttttgtttgcttctttgcaactaggagctaagatggctgaggatatttgtttcttcgccaaggatagtataatcataaaacctgccaagaaatctccagcattgttaaggatggtggttgtagcgtttacgctgatctttggtatttatatctgttcaatttgtcttaaacaaactagcttggagaatacaagtaaatacttgaacattgaagtcatggaaaagccttgccataactatgacatggatcaatcccaaattccatatgtgcattatccgaagccaaaaacttttagccgggctgaatgtagctgtaaccctgttcggcgctttgccattctctcaatgcaaaggtctgggagtggatggtttgagacactattgaatagtcatatgaacgtaagctccaatggtgaaatattctctgtcaaatataggagagaaaatgcttcttcaatcctgaggacattggacacagtttataatttggacttctttacgagtgcttccaaaaatcactgctcagctgcagtgggcttcaagtggatgcttaatcaggggttaatagaacattataaggaagtcgttgagtacttcaataggaagggtgtttccgtgatatttctctttagaaagaatttactgcgacgtatggtttctgttctttcaaattcccatgaccgatatgccaaactcttgaatggaacacataagtctcatgtgcactcacatgaagaggctggtactcttgcgaagtataaaccagaaatcaatacaacattgttgatcacagatttgaaaagaatggaggtttctgccacggaggcactggaccacttcaatagcactcgacatatgattctgtattatgaagatattgtcagaaatcaagctaaattggtagatgttcttgagtttctaagattgcctaagatggatctaagtagccgtcaagtgaagatacataacggggcattgtggaagcatatcaagaactgggatgatgtgaacaagaccttaagtggaacagcttatgagaagttcctccgaggtgattattaatttctgacttatcattttcattgatcgatgaaggaggtgtagatatcaactttgttttcttgtaaatgctgactggtgtactctcaacttggaaaagcttcctgctgcatttgcctctgaagatcagtcgaaattcagcatagtaccaagtttcactctcatgtatctctagtgtttttttctccctattctattccacattgaagtgtgcatagtgaagtagctaaagttgggcagtgccgaaggcaagtaagtagtcataaatcaatatttctctctttgttcttttccgttttgtaatttaataaagtagctagtgagatgttattttctacttgaaattggtactaaatgattttgat

SEQ ID NO: 128 - DNA, 505 bp, Solanum lycopersicum
atgaatgtagttgtatttttgtgcaggccaacaatatttatagaaataattcagagaatcgggtgcatgctcaaagatgaaaaaggacaagtctatcagaagggcggttgtggaggcttcggtaagggaaacttctctgagctgtttagatcgatcgaggaatacgagaagatgcttgaagccaaacatgttaatcaagtagctgctgtcgaatgaatatatacgagcattagcttgcaatctaattgaaatttgaaaggggcatctaagcttccatttgatctttctacaattaattatgaaataaaaaatagctgttgtgtaaatagcatggagggaaacaaagtcaagtaatttaagtataatgttgatcatgaatcccctctaaaatatctttttattagtgctttgagtttcatggtcgatgaaggcaggtggtctttttcctattcctgtcattctaggtaacttatcacttttcctgaaaaatattttcattaaagta

SEQ ID NO: 129 - DNA, 2786 bp, Solanum lycopersicum
gattgaaagagtgatttttttttcttttgttttcacgggtgagcgcacctgtagtgattggatccatacttctactgcattatattctcaaccccttttgtttctctctctattttatttttgttctttctctctcttaacaatccaaaatttgtttcgaatgtgagagaagagtgggagctcaagttcaggaacaagactgggaattctttgatttgtgggaatttgatagaaagttgaaagcttttttgctattaagaaattgggtttcatttatttttgggtttaaggttggaacatgtcaaggccactccatagaggtgtgtcaggtggggggaggttatcagttaatggccctgatttctgggatgactctcaaatgaaagataaaatagaaaaggaagatttggagcgtaatcgctcgcctggtgatctgacttattcacctaccaaattcctttgccggattctgtttccagataattctccttcaaaacataatttgggtgaaaatggcttactttctgatccatttagccctggaacaggaagaaatagactcaagtatgctttggttttgatcaggctgagcttagttgtcataatacttcttgcccttactggatctttttggtggacaatttcgataacttcctcgtcgagaggtcatatataccatggatacaggcagcttcaggagcaagtagtatcggatttgagagacattggacagctctctcttggtgctacaaatgtgaaggatatagagtactgtcctcctgaatctgagaactttattccatgtttcaatgtgtcagaaaatcttgatttgggcctttctaaaggtgaggaggttgaccgccattgtggacctggttcaagacaaaattgcttggtacttccccctgttaattacaagattcctcttaggtggcctaccggtagagatgtcatttggcatgcaaatgttaatattactgctcaagaggtactctcctctggaagtatgacaaaaaggttgatgatgttggaagaagagcagatttcctttcggtcagactctgccatgtttgacagcattgaagactactcacatcaaatagcagaaatgattgggctgcggaatgaatcaaactttgtacgagctggagtccgaactattttggatattggatgtggctatggcagttttggggcacatctcttttctagccaactgttgaccatgtgtgttgcgaactatgaagcttctggcagtcaagttcagctgacacttgaaagaggtcttcccgcaatgattggatcatttaattcaaagcagttgccttatccatctctttcctttgatatgatacattgtgcggaatgtcatgttgactgggatcagaaagatggtatttttcttgttgaagtcgaccgattgttaaggcctggtggatattttgtctggacttcaactattacgaatactcagcgctccgtccgcaacaaagtgagcctcaaaaaatggaactttgtccagaattttgctgaaagtatgtgctggaagctgttagcccaacaagatgaaactgctgtatggaaaaagacaagtttaaagaaatgttattttgcaaggagaccaggtgttgggccttccatctgcagtaaaggacaggacattgaatccccgtattatcgacctctacaagcatgcattgctggaacccaaagccgccgatggattcctattgaagaaaggacaaagtggccttctagggccaaattaaactccagcgaacttaagattcatggtttgttatctgaagctcttgctgaggattcccttaactggaattcagcagttaacaattattggtcacttctttcacctttaatattttccgatcacccgaagagacctggtgatgatgatccttctcctccctataatatgcttagaaatgtgctggacatgaatgcccattttggtggtttgaatgctgctctactggatgctagaaagtcagtgtgggtcatgaatgttatccccactagtgggcctaactatcttcccctaattctcgacaggggattcgttggtgttttgcatgattggtgtgaggcatttccaacatatccaagaacttatgatctggtacatgctaatggacttctgtcaatggaattcggccaacatatcagatgcccgatgtttgacctgtttattgagatggatcgtgttcttcgtccggagggctgggtgattttacgcgacactgtccctcttattgaattagcaagatctcatgcagcacggttgaaatgggacgcgagagttatagaggtagaaagcagtgatgagaagctactaatttgccagaaaccattttcaagaagacaagctagctaaaaattggcaaggatctcaagatttgtagatgataatagtcatttgtttgttggatcatattaattattaaacagcaaaaatttcacacagaaatggcggtaacgaaaacgaaattttttggacagtcagaaaagcaagagagagcacaagaagagaagacaacagaatggttctgcaaagggaccaaaaccacaactcctatgtagccgtaaggcttacatagggccatgtaattacacatttgaggcacagttgcaaatgggaattgttttaggggctatagttttttccttgtgatgtctcattttataactatacaagcaaaaacaatatgttgattgaaattgtgaaggtattatagaataacagcaatcctagctgctgtatcttatct

SEQ ID NO: 130 - DNA, 1370 bp, Solanum lycopersicum
ctgatagagttggttgagataaactttattatcctcaagaagcaaaaaacagaagaaaattttaccaagaatgattcatcttatgcccctaaaaattcaatcttgatgcttcccagtttactcttcagtaatttgaatcataaaaatataccctttttgtagatagaagaaaagaaatgctaatgatacagtccaccatttcacttcctctgcaaaaatctgttcttgttccagctaaaattgcaacaagtgggagtaaaaatggttgttttcttgatttaaatggtcggtgtggttcaaaatcagcttcttatcactttccaagaagacccattaagggaaattcaattcagctgaagatttatgccaggaaatcagaatcactcccaattttgctttcagagaaagttgatgaattgccagagatgttgctgaatggcggagatattaccattagtagtggggagattctttctctatcagctttctcatgtggatctatcttctggttgacatctgggcaagtggcattagcaagtgaaggtgtcagagtaaatatggtttatgaggtcggggaattatttgaactgggaatccagcttacttacctgcttttactactagcattgcttggggttggaagtttctttgtgattcggcaagtccttgtccgcagagagcttgatctttctgccaaagaattgcaagagcaagttagaagtggtgatgccagtgccacagagctttttgaacttggagctgtgatgttgaggagaaaattctacccagctgcaaccaaataccttcttcaggcagtagaaaagtgggatggagatgatcaggatcttgcccaagtttacaatgcccttggtgtcagttatgtacttgatgggaaaattgacaaaggaattgctcagtttgaaaatgctgtaaaagttcaacctggttatgtcacggcatggaacaaccttggcgatgcatatgagaaaaccaaagacttaacatctgctctaaatgcatttgaagaggtacttctttttgatcctaacaacaaaatagctcgtcctaggcgcgatgcattgaaggacaaagtaacaatgtacaaaggagtatcagtgaaatctaagaagagttgatatagctagcccattagttcttttacacacttgtgctgattatctttttgaggagctctttttgttctctttttccgctttctcctacacaagtggaattcgttgtcatggccatgttgaagttttggatgttccataatagaagttgtttgaactttctgtttttggtgtaaatgaaatgaacagtgtctattctactttatttgcatagaatcaagagaactgttgatgatc

SEQ ID NO: 131 - DNA, 3527 bp, Solanum lycopersicum
catcgaatataaatttccgtattctttatatttatatttcttattgaacgtttcgtccaatcaaatatcgtcgtgtaacagtaaaaatgaaatgatttgtgtaactggagataaaacagagtgtgagcagagacacatatatatagtgctttgatacagacatgagaactgtttgtgtacgcagaaataatggaagaagaaaacaagcaatctcctcttataccaccattgccaagagatccaagaggttctctagaagttttcaatccttcaacctactcttcccgatcaacaaatcctgttttccgatcacaaccttcatggaaaaattggaccgccgctgatcccattaccagtagtactatccctgaaacagaggaaaaaacagagcaaatcgcaattcccaaatcgagtaacgaaaatgaacaaatcgctacttcatggatggcaattgctccggcttcaacgaaattggcttctccgattactcaaaaatcaattaccggtggtgagaaggttaattcgaaggcggcagtggatgaagttggtgctgctgctcagagagcagccgagtggggacttgtgttgaaaactgatgatgagactgggaaattgcaaggagttaaagttagaacttctggagatgatacgaatggtaaaacagaaacttctcgaagagattccggcaactctggtcggagttccggcgaattttctgatgatggagctggcaaagagaggggaattccaagagtttcagaggatttaagagatgccttatctacatttcaacaaacatttgtggtgtcggatgcaaccaaacccgattacccgattctgtatgcaagtgctggatttttcaagatgacgggttatacatcaaaggaggttataggaaggaactgtcggttcatgcagggttcgggtacggatcctgaggatgtggctacgatccgagaagcattgcaatcgggttcaacttactgtggaagattactaaattataagaaggatgggacccctttttggaatcttctcactattgcacctattaaagatgatgctggcaaagtactcaaattcattggaatgcaagttgaggtaagcaagcacacagaaggctccaaggaaaaaactgtccgacccaacggccttcctgaatcattgatacgctatgacgtgcgtcagaaggagatggctagtaattcagtgaatgagttattagaagaaataaaaaatccaagaagggcaagagcacttagtgaatcaacaaataatagaccaactttcatgagaaagtcagaaggagatcaagttgaacaagataaacaggatactcataagctaaatttagtgaacaaagcaccagcaagaagacattcacatgctggtactagaaccaccaccatgaagatggagaagattaacgaagtccccgaaaagaaacctaaaaaatctgctcgtctatctttcatggggattatgaagaaaaaacgttctagtactacaatgactactgatgatgatgattttgaggcaaggatgacaatggataatgacgatgacgatgatgatgagagtgacaacgatggacgaccagttagtgttgatgacaaagtgaggaagaaggaaatgagaaaaggtattgatttagcaacgacgcttgaacgtatcgagaagaactttgtcattactgatccaagactgcctgataatcctattatttttgcatcggatagtttcttggagctgacagagtacagccgtgaagaaatcttgggaagaaactgcaggtttcttcaaggtcctgaaactgatccagctactgtgaagaaaatcagacaggcaattgataatcaaactgatgtcactgttcagcttattaactacactaagactggcaaaaagttctggaacttgttccaccttcagcctatgcgtgatcagaagggagaggtgcagtacttcatcggagtgcaactagatggaagtcagcatgtagagccacttcaaaacagtatccctgaagacaaagcaacagagagtgcaaagctgataaaagaaactgctggaaatgttgatgaagcagttcgagagcttccagatgccaattcaaaaccagaggatttgtggagaaatcattcaaaagttgttcagccaaagcctcacaggaaggacagcccatcttggaaagcaatacaaaagatcttggagagtggagaaccgataggcttgaaacatttcaagccaattaaaccactgggatcgggcgacactggcagtgtgcatttagtggagctttgcggaacagaccagcactttgcaatgaaagcaatggataagagtataatgcttaaccgaaacaaggtgcatagagcttgtgcagaacgagaaatcctagatatgttggaccacccttttcttcccgcactttatgcatcttttcagaccaaaacccatatctgtctaataactgattactaccctggtggagagctgttcatgcttctagatagacaacaaacaaaggtgttgaaggaagatgctgcacggttctatgccgctgaagttgtagtcgccttggagtaccttcactgtcaaggtataatttatagggatctgaagcctgaaaacgtcttgcttcagagtggtgggcatgtatctttgacggattttgatctttcctgtttgacatcttgcaagccacagcttttagttccagaaatcaacgaaaagaagaaacatcaaaaaggccaacataatccaatcttcatggctgaacctatgcgtgcatcaaattcttttgttggaactgaagaatacatagctccggagatcataactggagcagggcatactagtgcagtggattggtgggctcttggcattcttttgtatgaaatgttgtatggttatacaccattcaggggaaagacaaggcagaagacattctcaaatatactacataaggatttaaaattcccaggaagcatacagtctagtctccacgcgaagcagttaatgtatagattgttgcacagagatcccaaaaacaggttaggatctcgtgaaggagcaaacgaaatcaagcagcatccgttcttccgcggtgtgaattgggcattaattcgttgcatgaaccctcccaaactagattctgctccttttttgggaactgaatctgagaaagaaggaaaagacatcaatcctgagatggaggatttacaaacaaatgttttctaaaagtttgttgcagagatgaaatatttatatcccaatcaaatcaagtgcatgagtgaagataaagtgatcttcagaacctccctgcaacagttaatcacttgatgattttgtaaaaaataaaatggtggtttttcatttgtttttttttcctttgatggtttgtgtttttctttttatatgcatagtttggttgttttgtaattcttaattcatgaattcctcagtagatattgagttaattaatttgttaagcctaattttcttcatttaacttattatttatt

SEQ ID NO: 132 - DNA, 1538 bp, Solanum lycopersicum
gaactctcttcaccttcttcttcttcttcttcttcatcactcactgtaatgcgagcttgataaaagagaaaaaaactgaatattttctcgagaaaaacccaaaaacccagatgaaaatgggttgttttgggtttgatttttctaattttcaatcgattacagtgttttttttgttattgatgcttgggttatcgttttccccaaatgggtgtcttgggattcgaagttttcctgaagaaagacggtttatagaggcgccggagtatagaaacggcgttcaatgtccggtgacggcggaaactcaagatatggttcatatagcgatgacgcttgattcagaatatctcagaggatctatggcggctgtgcactctgttctccgccattcatcttgccctgaacatatcttcttccatttcattgcggctgagtttgacccatcgagtccacgagttttaacccagttagtccgatctatcttcccgtcactcgacttcaatgtttatatattcagagaagatacagttctaaatctcatttcatcttcgatccgtcacgcacttgaaaacccattgaactacgctcggaattacctcggtgatatgcttgacccatctgtaacccgagttatctacctcgattccgatatcgtccttgtcgacgatatcgaaaagctatggaaaacccctctttccggttccagaatcatcggagcaccggaatactgccatgcaaatttcacaaaatacttcaccgattccttctggtctgacccggatttacctcaagtgttcgggtcacgaaacccatgttacttcaacaccggcgtaatggtaatggatttgcagaaatggagagaaggtaactaccggaaaaagatagagaaatggatggagttacagagacaacggcgaatctacgaactgggttccttgccgccgtttctgctagtttttggtgggctcgtcgagcccattaatcaccggtggaatcaacatgggctcggcggcgacaatgtaatgggctcatgtagatcattacatccaggcccagtaagcttgttacattggtccggtaaaggaaaaccatgggccaggcttgatgaaaaaaggccttgtccattggattatctttgggagccttatgatttgtataagcccaagcccaaatcaaggcccaattatcaaaggagtaaaatgagactttatcaatataataatttggatttttcaactagtaatattctttttggttactccaattatttcatttgattcttttttttcttttttttgacaaggttgatttaagtgattcttttaatagccttgtatatgattagttggaaaaaaaaaaaaaggaaaagagaagagtgatagtgaaaaattaatgtgatttgtttagagattaaagttgattacacgaaattttattaccatagttccattggaacaatttttgagatgattttagtttgttgtattttagggatcgggccgtgtttgatatttgtattgagttgaactaaatttgaattc

SEQ ID NO: 133 - DNA, 1329 bp, Solanum lycopersicum
tgaatcatcggatatcgtagcagtaacaaagttcatcctggatttgttgttctcgggagttttacggtgatgtcgggggaagaacggccgtcgagtttagtggtggatccgttgttgaaggatctgagtgagaagaaacagaatttccggcgaaacgtggtgtcgcttgcggcggagcttaaggaggttcgcagccgtcttgcttatcaagagcagtcttttgttcgtgaaaccctaaccagacaggaagcagagagtaaagctaagaaaatggaagaagagataaacaaattgcaagagactttggaggaaaagaatggagagcttcaattttcagctttaaacactgagaagtatgttaagcagttggatgaccttaaatcacaactctctgcgactcaagcaactgcagatgcaagtgctgcatcagctgaatctgcacagcttcagtgtttggtgcttttgaaagagctggatgagaaaaacagctcactgaaggaacatgaagttcgtgtaaataaacttggtgagcaattagatcttttgcagaaggatcttcaagcaagagaatcatcccaaaggcaattgaaagatgaagtagtgagaatcgagcatgatatcatgcaagcattagcaaaatctggtgcaaacacagattgtgaattgaggaaggtcttagatgaggtctcgccaaagaacattgagaagatgaacaagctgttgactgacaaagatgaagaacttgccaaactccggtacgaaatcaggatcatgtctgcccactggaagctaaaaaccaaagagttggaatctcagttagaaaagcatcgtagggctgatcaagagttgaaaaagaggattatgaagttggaattctgtctacaagagactcgaagtcaaactcgcaagctccaaaggatgggagaacgacgtgacaaagctattaaggaactgagagaccaattatcagttaagcaagttggaacttccagcaacaataatcagaacttctgggatacctcaggattcaaggttgtcgtttcaatgtcgatgctgatgttagtcctcttttcaaagcggtaatagttacaattagtattagttgacaatgtaaaaaggagaagtgtagctactaacaacttagaagctgtagagctgctgcttaatatattagaatgttaatcatactctatggggccctatctttttgtaccttaagggcatcacaactgaatccatcatctcgatgttctattattagatattatatatacatgcggtaatcataacgttacataatcatgttttaaaaatgtatcgttgaaactc

SEQ ID NO: 134 - DNA, 2100 bp, Solanum lycopersicum
tgtgtctcttcaaactaaatccattggtaatcaatcaccagaaagtgaaagaacatggggatagaaggtgaagtaccggaatcaggaggaggaatcaggcgaagaaattgtgtgtgcacaaaagacgattttctgccggaggaatcgttcaagagctggggaaattacacgaatgcgctgaggcaaactccgacgaggttaatcgaacgggcgttgacgcgatcgaatgatgaagcagagctggaggcgaagtcacggagtcaccatgaaatgaagaagacattgacatggtgggacctaatatggtttgggatgggagcggtgattggagcaggaatcttcgtactgacggggcttgaagcgagccaggacgctggccctgctgttgtactgtcatatgcagtttccggcgtctccgccttgctctctgtcttctgttacactgagtttgccgttgagatccctgttgcaggtggttcatttgcctacttgagggtggagcttggtgactttgtggccttcattgctgctggaaacatccttcttgaatatgtgattggtggtgctgcagtggctcgttcatggacctcatactttgcaactttgttgaacttcaagcctgaaaaattcctcatcacggctcatggtttagctaagggctacaaccaacttgacccaatcgctgttgcggtctgcttcatcatctgcatcattgccattcgtagtacgaaaggctcttctcgtctcaactatgttgcctcgatcattcacattgtggtgattgttttcatcatcatctgtggcctaatcaaggcagataccaagaactacaccccctttacgccatttggagttcgtggcattttcaaagcttctgcggtgttgttctttgcttatgttggttttgatgctgtttcgactatggctgaggaaactaaggatccagctcgagatatccccattggcctagttggatctatggtgatcaccactactgtgtactgtttattggctataacactctgtcttatgcagccttatcagagcattgatcctaatgctccgttttctgtggcgttcaaagcagttggatggagttgggcgcaatatattgtagctgcaggtgcgttgaaaggaatgacctcagtgttgcttgtaggcgcggttggtcaggctcgttatctcacacacattgcgcggactcacatgatgcctccgtggttttcctatgttgatgaaaaaacagggacgcccgtcaatgccacagcggtcatgatgtctgctactgcaatcatcgccttcttcacaaagctcgaaattctctccaatctcttgtcgatctccacccttttcatcttcatgctcgtggccctcgctctcctcgttcgccgttactatgtgagtggtgtgaccacaaacgcaaaccgcaacaagctaattatatgcatattgctcatcctcgggtcctcaatcgccacagctgcttactggggacttagtgagaaaggatggattggatactgcttcactgtgcctatttgggtttcagcaactgcagggatttgtattttcattcctcaggctcgtaatcctaagctttggggtgtgcctcttgtgccttggttgccatcattatcaatagctatcaacattttcctactaggctcgatagataaagattcgttcatcagatttgctggctggacaggttttcttttggcgtattacttctttttcgggctgcatgcttcttatgacacagcaaaggaatttgaaaagagcaaagggtggaagaacaacattgaagaaggaaagggtacttctaatgtggttgttagcaaagatgttcctattgctcctggtaactgaattagttgtgtctaaatgatagcacaatgttacgttcctagctagtactcttattttatttgtcttgatatatgcctatgatgttagtccgtttgtacagagtctgtttctaaagtagacaagtaaaagttgctgcattgttctagtattgaacattgtgcagactatcttacgatggctttgtacccttctggcatatgccggagattgggaaggttacttagattgcgc

SEQ ID NO: 135 - DNA, 2640 bp, Solanum lycopersicum
agttgcttgagttgcctctgagggtatgcaaagaatcttaacattttgttgtattttgttttagtaagaaaaagaaaatggagagttgttgaatttcttttatagtgtaaaagaaaaggttgttcttgaaatttttttttcaagatctggtgaatttgttgttgaaagtagcttaaatggctccaagattgaatttttctgactggtggggtaaagataaagaaaggggaacaccagttatagtgaaaatggagaaccccaatttctccattgttgaaattgatggtcctgatgctgcatttaagcctatagagaagagtagaggcaaaaatgctaaacaagtgacatgggttttgttgcttaaggctaaccaagctgttggttgtgttgcttggttagcaacaattttgtggggtttaattggtactatcaagaataggttgattttgagaaaaggggtttctgttgcaagtgaaaaacttggaaagagtaatctactttttagaataatcaaagtttgtttgggggtttctttggttatgttagcttttgaagtgattgcttactttaaaggttggcattattttcagaatccaaatttgtatataccacatacttctgatgttttggggttgtttcacattatatatgttgcttggttggattttcgtgctgattatattgcgccttcagttcaaaaactctccacattttgtactgttttattcctaattcagtcgttagatcgtttagtactttgtttgggttgcttttatatcaagtgcaagaagattaagccaaggattgaaggggatccatttaaatcagatgatcttgagggatcaaacaatggttactaccctatggttcttgtgcagattcctatgtgtaatgaaagagaggtatatgagatgtctatatcagcagtttgccaacttgattggccaaaagaccgtttgttgattcaaattcttgatgattctgacaatgagtgcatccaagagttaataaagtcagaggtcgcgaaatggaaccaaaagggtgtcaacataatttacaggcaccgtctggttagaactggttacaaagcagggaacttgaagtccgcaatgagttgtgactatgtgaaggattatgaatttgttgcaatctttgatgcagactttcaaccaactccagattttcttaagcaaacagtcccgcattttaaggacaaccccgagttaggattggttcaaacaagatgggcatttgttaacaaggatgagaacttgctgactcgtctacaaaacattaatctgtgttttcattttgaggtggaacaacaggtgaatggggtattcttgaacttctttggtttcaacggaactgctggtatttggagaatcaaagctttggaagagtctggaggttggcttgagaggacaactgtggaggacatggatattgctgttcgtgcacatctcaatggttggaagttcatatatcttaatgatgtgcgggtcctgtgtgaagttcctgaatcttttgaagcttataggaagcaacaacatcgatggcattcgggccccatgcaacttttccgagtgtgtcttccggctattgtttcttccaagatatcaatatggaagaaagccaacctcatacttcttttctttttgttgagaaagctcattcttcccttctattcattcacattgttttgtgtagttcttcctctaaccatgttcatcccggaagccaagctccctttctgggttgtttgctacattccaattcttatgacacttctaaacattcttccagcaccaaaatccattcctttcatcgccccctacctccttttcgaaaacactatgtcagtgacaaagttcaatgctatggtatctggacttttccaattgggaagttcgtacgagtgggttgttaccaaaaaggcaggaaggtcttctgaacctgacctactggctgctgctgaaaaagatttgaaagcatttggagcaccacagattagcagaggggcttcggaaagtgaactttctgagctgaatcgattgaacaaacagaaggatgaaacttctacacctgtcaagaagagcaataaaatatacagaaaagaactagctctttctttcttactcttaacggcgtcagctagaagccttttatctgcccatggactccacttttacttccttcttttccaaggagtgacattcctcctcgttggtcttgatcttatcggagagcagattagttaatattgctcaagagaagagaaagaacaacttacatattgtatgtcaagaactgatccacttcctctcatctgaactttgtaccggcagaacaacagagtacggggaatagctcggatattttcagttatcgacttctgctatatgaaatgaagccaattaggattttgtacgcgagactattacgtcatgcctgtgtgagttccctaatatctttagatagggtaattattgtaagtcttttacatagagtcgattgtttgtcaataatactataggtagaagcaatctcatttttattttttttacttaatttgatttctcaaaagcagtacttgtgttgttcaaggcatttcacattcatcatattatgtatataagg

SEQ ID NO: 136 - DNA, 1120 bp, Solanum lycopersicum
acacaaccccatttttgtgggcttttatcagttgccaaattttcaactctagtcactgctgctgctgccatggctactcatagcaatttgaagaatgctttgattgcctttcttgctccacttccctctttacttttctatctatctttccttcgccattatcatgaagatcatccaatctacaattggtgttaccaccaccctcttctgtttgctaatgtcttgtttttcttcaatgtcaatatcctcttctatgccattagttacatccaatctagtcactggatgatagatttgttctggactgtgattccagtaatgctagtgcatttctatgcaaatcatccattggcacagtataatgtgtggaggtctaaggtggttatacttttaacttggatttggagtataagacttactcataactacttccgtcgcgagaattggcaatggggacacaggcaagattggagatttacagatatgagccaccagtatggcaagaactggtggtggatatctttcttttttgtttatttctctcagcagatttttctgatcggtatatgcctgcctatgtatgttgtccactctgaagacaagccatggaatatctgggatttcattgctgtattcatctgcttgtctgccattataattgcttattatgcagatacagagctctacaattttgtgagcagaaaccagaaactaaaagagctcggcaagccaatggttcccaatcttgatgaaggcctctggaggtattcacgacatccaaactattttggagagcagttatggtggtggggactcgtcctatttgcctggaacttgggtcagacttggacttttgttggtgcactcgctaatagcttgtgtcttgcacatgtcactgtgcttgttgagaataggatgcttaagcaagcctacagagctgaagcatacaaactctaccaaaggacaacatctgtgtggataccatggttcaagtcatccgcaaaagggaaagataaggaaacttgagtctattttcaatctctttggtgtcttcctttgttaaatgtcgacgataagatttagaattattgaataaataatctactaatgtgcattctaa

SEQ ID NO: 137 - DNA, 647 bp, Solanum lycopersicum
gcatggaccctagatttttgtatttgacattatgttctcatgccacactcttttatttataaaaccttgttaccagttcagtagaaaccacatgtatcaataatggattttatcatccttctcatcgccatccttgctctttctagcacaccaattaccattatatccggatctgtgacaaaccatacatattcaactacaaactcttacaccaacgttgctctttctgcacgaaaagttgtatttcctcctcccagacagctaggaaaagataattctgatgacgatgacttgatctgcaaaacttgcaagagattatcagaacaccgtacatgttgtttcaactacttttgtgttgatttgttcaccaacaggttcaactgtggctcctgtggcctcgtctgtatcgttggaacaagatgctgcggtgggatctgtgtggacatcaagaaagacaacggaaattgtggcaagtgtaacaatgtatgctctcctggtcagaactgctcatttggcctttgtgtcagtgcctaatttaatgtatttctctatctgtaccaataaccaattcccctatcccctgggtgaaatgttacatcttgttcaagttttttagttagataactaattttcaagttttctagttg

SEQ ID NO: 138 - DNA, 1188 bp, Solanum lycopersicum
aacaatattgacataaacaaaatatttaacaacgaaagttgatcgatacaagtaatcatggaagatctaccagggttccgatttcacccaacggaagaagaacttcttgaattttacctcaaaaataaaatccttggcagaacatcgcgatgtgatgtaattggtctactgaacatttatcgtcatgatccttgggacctgccagggctttcgacgattggagaaagagaatggtatttttttgtggcaagagatagaaaacatggaaatggaggtaggcctaataggactacagaaaagggattttggaaggcaactggttctgataaaaagatcattggtttatcaaatcctaaaaatataattggtcttaagaagactttggttttttatactggaagagcacctcgtggctctaagacagattgggtcatgaatgaatttcgattaccagataccgtctcatggcctcaggacattgtgttgtgcaaaatatacagaaaagcgacatctttgaaggtgttagaacagagggctgcaattgaagaagaaatgaagcacgtacacagctctccttgttcaacaaccctgcagacaatggacgccatgtcatttggtaatgaacatcatgaactgactgataagagccccgatttgtttacgtcaatcagcaaggatgaagtagatgatgataggttatcagtagctgagaacaaagtttcagctgaaaccaaagagaagagtaattgctttaggccaaaattattaaatggacaagatagcctggctgaactgcaagtacccaaattcagcatggactttagtcaggaccctgtgtggatgcaattgcgtagcccttggctggataattttatcttgacaccttccgcgtttgtgcataacttttaggttaagaaaccatccatctcaatttctttttcaacaataatatgctcattgctacaacctaaccagctggcctggggtgtttgttcatatagtatccttaatggttccagaagtagtatatatagctgataaattatgtgtattgactgatgctgtttatgtttatgttggacataagtctggatgggtaacagaaacatggagcagtaatgtaaattttcaaatagtaaattgaataacaaaactaactataagtggcataaattagtatttttgccc

SEQ ID NO: 139 - DNA, 790 bp, Solanum lycopersicum
ccattcttcaccaactgactcaaagaatttacttccattccatggccaaactaatactccaaatcttcaccatttccctcttcctttctctggtggcctttcgcgccaccggagaagaagataattatatttttggaaaatccataaacaaaaaacccacaaggttaagaaaggaaaaaatcagtcattttcgatttttttggcatgatattttaagtggttcaaaaccaacatcaatgatgattattccaccacctaaaaacacaacaacaggttttggacaaatgaatatgatagataatgccttaaccttaggaccaaaactaagttccaagattgttggtagggcacaagggttttatggtgctgcttcacttaatgatgttgggttaatgatggttatgaattttgcttttattgaagggaaatataatgaaagtacttttactatacttggtcggaatccggtgttcgagaaggtgagagagatggcggtgatcggagggagtgggcttttccgatttgctagaggatatgttcaagctagtactcattcatgggatttcaaaactggagatgctactgttcagtatgatgcttatgtctttgcattattgaggtttactaattttatatattttcatcgtgtcaatttatgcgacctagtttacacgaaatttaagaagtataagaatatattttgtattattgcgttccaaaattattcataaaaagggtagacatttgttgacttttttctaattaaatatgtactattttcgtccctttt

SEQ ID NO: 140 - DNA, 2016 bp, Solanum lycopersicum
acatattcatttgagagagaattaaaaaaattataaacacaaaaaaaaaatttcatcttccgccgcccaccgttgcatggccaataaagttttttgtccgaaactccttaagaacctcggatttcatgtccgccgtttaaactcagctccgtcacctctttccgccgtcccaccgctaaattttactggcgattttaacgccgtggaacccgcacaacaaattaacacaacccttcaccaccaccacgaccatcacaacattatcaatttcgatgatgttaaggagcttttctacggtgttcccaccacgaaactgattcgatcttcgatgacgttacaaatggctgctattgatcccatggttgatttgggcatgtgggtaatgaattctaaacttatggaaatgcctatttttagggaggttattcttgggtttgttaaaaatacattttatgaacatttttgcgccggcaaagacttaacggaagctagacggaccgttactaatctatcggattctgggttaaaagccatgcttgattatggggtggaacatgccaccgataatgaatcttgtgaacagagtactgcggcgtttattcaaacgattgaatcaaccaaatcacttcccgaatcttctgcaagttttgtggtagcaaagataactgctatttgtaccccaaggcttctcaaaagaatgagtgatttgttaagatgggaacagaaagatccatcatttaatcttccatggaagcgagagtcgcttccccttttcgccgaatcgagccctgtttatcacacttgtagcaaaccagagcctctatcggtagaggaagagcgtgatcttcaattagctcatgaaagacttagaaaaatttgcgagaaatgtttggaacatgaagttccattactaattgatgcggaagacacaaccattcaacctgcaattgattattttgcgtattcagcagcaattaagtatcacaaagatgatcagcctttgatattcggaacaattcaagcttacttgaaggacgccaaggaacgaatggttattgcgaaaaaggctgcagagaaaatgggagttccaatgggatttaagcttgtgaggggcgcttatatgtgtagtgaaaaggaattggcttctacattaggattcaactctccaattcacgacagcattgagcaaacacacgcttgcttcaattcgtgcgcggagtttatgattgaagagattgctaatggttctggtgcagttgttctcgccactcataacattgaatcaggaaaacttgctgcaaccaaagctatagatttgggaataaaagatgagagacaaaatctccaatttgctcagctatatggtatggcagatgggctttcatttgggctgagaaatgcaggatttcaagtaagcaaatatttaccatttggtcctgtagagcagattatgcattaccttatgaggcgtgctgaagaaaacagaggcatgctgtctacatcggcattcgacagacaactcatgaggaaggaattgagcaggagattcgaagtggctacttcttaaattcatattcagaatatgaaatctatattagtaagtaagaaataataaacgaggaaacatcgccgactactgtaaataattcaatgatgtgagggcaaaaattgatgaggatgatcaaagcaacctggatgggtaaaatgcatgaggaggaagtcagtttttatctttgtgtgtgttatgaaaaataaaaaaattgtacatatttattttaggtccactacttgtatctttctccatgtgctattttttaggttctattatatttactatataatgtactagttccttaagttggtttttatttggtatcgtgttttagaaatagaaatggaagaaggtattcccagagtggagccaaaatgtcgaaattacaaagtgtgtatcagtttctctctctctatcgagacattatgaaataaatcggatttattggcctttaattaacattt

SEQ ID NO: 141 - DNA, 2037 bp, Solanum lycopersicum
aatccatatgtcttatctccaaacgccataactctgaattctcccaaaaaccaaacaaagcttttagggttttcgtagaaaggatatgaaggatcagaatttggacctattcgacccgagaacggcggtcatggacccggaatactcccctactcataccggggaacccgatttcgcctttgccttcgacgacgtcaacttctccgatcgtattctacggatcgagatccttggagattcaattgccggtggttctagttccgacggcggctgcagtagcttagccgattgggctcgtaatcgcaagcgccgacgtgaggatttcaggaaggaaaacgctttggatatcacagcatgccctgaagatcagataatttgctgtaatcaaattgatagtgaagatgctgataacgagaatcaggatgaagcagttgttgcaatgattgaagagacaaactcaggagatgaagctgctaatagtgatgattcaacttggaattgtgattctccaagggttatgagagttaaaacactaaacattagctcccccattttagcagcaaagagtccattcttctacaagctcttctcaaatgggatgagagagtctgagcaaagacaagtaactctacggatcaatgcttcagaggaagctgcattgacggagctcctgaaatttatgtatagaaatatgttgactacaaatacagcgcctgggttgcttgacgtgctcatggctgctgacaagtttgaggttgcatcttgcatgaagtattgcagcaggctactgtgtaatttgcctatgactccggagtcagccttgctgtatctggagcttccttctagtgtcctgatggctgatgcagttcggccattgactgatgcagcaaaacaattcctagctgcaagatacaaagatataaccaaattccaagaagaggtcatgaaattgcctcttgctggtattgaggcaattttgtccagtgatgaccttcaggtagcatcagaagatgcagtatatgactttgtcttgaaatggacaagggctcattatcccttgatagaggaacgccgagaaattcttagttcaagacttggtcgctgcatccggtttcctttcatgagctgccggaaacttaggaaggttcttacatgtaatgactttgaacatgagtttgcatccaaactagtgcttgaggccctgttttttaaagctgaggccccacaccgccaacgaactcaagctgcagaagaatcagcttcgaccagtcgtcgttttgtagagcgtgcatacaagtatcggcctgttaaggtggttgagtttgaacttccacgccaacaatgtatagtctacttagatcttaagcgggaagaatgtgctaatctttttccatctgggagagtatattctcaagcttttcatttgggtggacaagggtttttcctgtccgcacattgcaacatggatcagcaaagctctttccattgttttggtctctttttgggaatgcaggaaaagggttcagtttcatttacagtcgattatgaatttgctgcgaggacaacactagcagaggagtatgtcagcaaatacaagggaaactatacatttactgggggtaaggcagttggctatcgcaatttattcgccataccgtggacttctttcatggctgaggacagtctctattttattaaaggcgtactccatctcagggctgaacttactatcaggccctgatttttctctcctacgatttcaattactactgttgttttgcttattagctgagcctcccgattcccgatcttttttcttggcttttgatcaagcaaaaagaagtgtaacgtgtaggtgtcggtactaactgctgtaggtattaaaacgtttcgtaatgttatccttttgaccatagtagttttatccctgtgctctttaaaacatgagaaaggatgtaaatggaattcagtgagtgagaaatgtttgattgttctgaccctgttttaatgcaatacaaggcacagaggtgaacattg

SEQ ID NO: 142 - DNA, 1382 bp, Solanum lycopersicum
aaacaaagtgaagagaaagagagagttttagagagagaaaaaagagggagttttagagagagaaattaaaagaggagagaagtacggccaatgggagactcgagcggctccgtttcggtggatatggaaacaatctccgtcaccggaaaggagcaccttgtaaaaactggccgtggttatatctctgttgccgtttttggggaccaggacaagccggctcttatcacctaccccgatttagctttaaattatatgtcctgtttccaaggattattctattgtccagaagcattttcattgctgctccataacttctgtatttaccacataagtcctcctggtcatgagttgggagctgctgtcatgagtcttgatgatcctgtcttatcggttgatgatttagcagaccagattgtggaggtgcttgattactttaggcttggtaaagtaatgtgtatgggtgtaacagctggagcatatattcttaccttgtttgcggtaaaatacacacaaagggttatgggtttgatactcgtttcccccttgtgcaaagcaccctcttggacagaatggttgtgtaataaggtgatgacaaatctgctttactattgtggcatgtgtacgttggtgaaggagttactgctgttgcggtactttagcaaggaagtccgcggcagtgttgaagttccagaatctgatgtagttcaagcatgccgaagattgctaggtgagagacagagtccaaatgtattgcggttgctcgaagctatgaatgagagaccagacataacccaaggcttgcggaaactaaaatgtcgttctttaatatttgttggagagagctctccttttcattctgaggctctccatatgacatcaaagttagatagaaggttgagcgcgctagttgaggttcaagcatgtggttcaatggtgactgaagagcagccagaggcaatgttggtcccactggaatactttctaatgggatttggattttatcgaccgtctcagtgcaatgtcagcccaagaagccctttaagtccaaccagcatttctccggagcttttctcgccagaaagtatgggtttgaagttaaaaccaattaaaactagattttctgaagaagtatgagtctgggcttaaagttaaaataagtttttgtaaaatttgtaacaagttccactttgattgaagacagttaggaatgtgaagttatagaggaagagggagggttgtagataagagaattgggaaatagaaagtggaagaaaaaacaataggaaaaaagaggtttttctttttcttttctttgtaatgggaagttttgaatcgatatgtacatgctgcacaataataataataatagtaatttatgttga

SEQ ID NO: 143 - DNA, 2269 bp, Solanum lycopersicum
atacccctaaagccaaagattatctctttcattccctatttggagtagaaaaatgtcctttgcagaagaaccgagtggataaacatagaaacttttctccctttttctcttcaacccaaatctcgatctacaattagttttcatttttcttcgtgtttaatcaatcaaatttattttcgatgtgttaattgatgtctgattgttaaatttctggatcgggatcgaacgaacctcgatcaatctgttcccttttgtgttcaaggtcatttggttggggtaaaacatgtctcatcaacaagaggatgatgctgattacatggcaaacgagtatgacatggaagctatggatgatgatatggatgacgagttccatggccgagatgttggtggctctgattcagatgcagatgattatgacttcacgaataataaaatgcaagatacctctgctgctgaggcaagaagaggtagagacatccaagggattccatgggaaaggcttagcataaccagggagaaatacagacaaacgagattagagcagtataagaactatgaaaatattcctcaatctggggaggcctcagagaaggactgcttagccacgaagaaagaagtttcatactatgacttcagacgtaattcaagatctgttaaatcaacaattttacatttccagctgaggaatttggtctgggcaacctccaagcatgacgtgtaccttatgtcacatttttccgtcattcactggtcatccttgacctgcagcaaaagtgaagttctgaatgtatcagggcatgtagcaccatgcgagaaacatcctgggagccttttggaaggatttacacaaactcaagtcagtactcttacagtgaaagacaagttgctagttgctgggggatttcaaggagaactaatttgcaagtatgtagacaggcctggagtttgcttctgttcccggacaacatatgacgataatgctattactaatgctgttgagatttataacacctccagtggtgcacttcattttattgcttcgaataatgattctggagttagagactttgatatggagaagtttcaactgtccaagcatttccgttttccatggccagtgaatcatgcatcactgagccccgatggcaagcttattgcaatagttggggataatcctgaaggtttattggttgattccaggaacgcaaaggttgtttcacctttgagcggacatattgactactcatttgcgtcagcatggcatcctgatggcctaacttttgcaactggcaaccaggataaaacctgcagagtatgggatatacggaacctgtctaaatcagttgttgctctgaagggtaaccttggagctattcggtcaatccgctacacatctgatggaagattcatggcaatggcagaacctgcagatttcgttcatgttttcgatgtaaaaaatggctacgagcaggagcaagaaattgatttctttggtgagatatcaggtctgtcttttagtcctgatacagagtccctttttgtcggagtctgggatcgcacatatggtagccttcttgagtttggacggcggcacaactactcataccttgatacaattatgtaaacactctcttgaatgctgctttgggtatgtttacttggcttgaagtggcgctggctcaactttgtaaaacgagtagcatagtcaggagttagtagtggatttggctgtaaattggtcatgttgtgcaatttaagtttgtcacataaattgttgtgcaccatttctaagtatcagaagatgtagaatggaggaatgtataaaagagggagaaactccagtgatgtgagcatgaaaaagtagcgttgtttccataaggcataggccagaaacttgatcttgttttgtggtggggtgggtagggttctgttcatcatcacatcatgtattgggatcttaaaatcatcctgaaagttgactcaatcatctgcatttgtctactaagtaattgatttacagtctcctcaagtgtttctgtgcagatttatgtagtcgattctaacttgtttgggactgagacaagcgaagttatggtaagttcgtgtgcttactactctcaggtaatcaacacactgttgatgcgttgggttgaataagtatactattgagactttttacctagattaaagtaagtgattttttaaagtttaaaagagttattggaaggcttttttaacatttgtctttcgtttggtaaggttcttttaa

SEQ ID NO: 144 - DNA, 2446 bp, Solanum lycopersicum
tctagtccacgattcgtgccctagttgtgtatactggtcccatagatctctctttcccccaataaatttgcagtttgccttgtttttcgctgttcatcagattctcctctcctctttgcttggtgaaagttggaaaccgcaattattgcattaaaatagtcaaccttacaggattttttattcaaattcgatttatcgattgctcttttttcgcataattatcctccattgttgtgcacaatttgtctgcgaaaagctgatcattttgaatcatgtaattagggttttcaggaaaaaaattcagtttctcagaagcttcctccatcacgatttcattatagataagttgaatttttttttacctttgatttatttttgctcagaaagtgcatacccagaagctgaaatctcgtaaattaatgattctggttcagattttgttgtatgtatcttttgtattgtaatctagttgcaaaattgtgtatcttgtgagcgaggtgtgtgtgcaagctggctcggacaccatggttattaaaaacaaagaaaattgtgtgtcttgtggttagtgttgtaggaatttttgtatatgattagttaataattagaaatatgaagcatcagaagaagaaaaagagatcaaaagcttgtaaaaaagttggggttggtaatggttcgttgccatctgggaatagtaatgatggaggggagagtgttgtgacggcgttaacggaggcatttacctctgtatctatggaggaagcaacatgtgcttatgaagaggcaaatggggatttgaataaagcaatggagattctgggtgatatggtggagcgtaaggaagaggataagatcactacttgttcaagctcgagtggaaacgttggttcaagcttggattcgagtaactcagaggtgtttgttgggggtcattcctggcagaattcagttcagcgcaaggctaaggtgaagaaattggtggctgctactggaacagtatcgacgatgatagggaaggattatgtgagaacaactacaaagaagagttgttcaaagctcaaggggttacatgatgaaacatcgagcaacgaagatgttgagcagtttttgtattccatgcttggggaagattctgatttgagcttagctgtcgtcagagatgtgttatgtcaatgcggatatgaagttgagaaggctctgagtgtgttgcttgaattatcagcttcctctaatgagaaacctaagcttagcgactgtagtgcaaactggaaagaagaggctgtgtttcttcattcaagtgatggtcttactgactggacatctgattctacttctcattcatctgaaagcgaagttctagataatgtgtggttttatgggcctcctggcaggaattcgttaaaagttcctgctggaaactctgaacattcttcatcatctacagtaggaaattctggatcagtacttcctcaagatattctggaatctttgttctgtatgccaacccccaagagtgttgaacatgaaccaactactatgaactggaagaatgtagtaaagaaaatgacatctttgggacaaagatctggatcttgtcctaatgatattccaccactgcagcatactcatgctgagggagctgagtatcagctgttcagggaaactgcaaagcaacattgggagtcaatgagatcccattatcagaaggctgcaacagctttttcaaatggccaaaagggacatgctgcttatcttgcggatcagggtaggctacacaacagaaaggctcgagaagctgatgcaaaggctagccaggatatatttgcagctagaaacaagaacatagaaaatatgataactattgacttgcatggccaacatgtcaaaccagcaatgaggcttttgaaactgcaccttctgtttggagcatttgtacgctctgttaggttgttcagagttatcacgggatgtggggcacatggcgttgggaagtcgaagctgaaaaactcggtagttgaacttttgaagaaagaacatattgaatggaccgaggagaatagaggaacattgcttatcaagctcgatggacgaatgaattttagctttgtagatactgatgataatgatgaagatgataactgattatcccttagccatggttgctagcagttgggcaccgcggattttagcattaacagtggcagtaaatgtaattaacatcactatattatcttgatgctaggtggtataacaacctagattgtgatattttacgacatttacatttttcttttgttagtgtgagaattgtaaattgtgtatcctagctctgagcattatgcagcgttatagctaagctcatgtatgagtgtagaatgcacattattgtagtatctgtaatactcatttattctggaaatcttatgctttttcatcatgaaaacttcca

SEQ ID NO: 145 - DNA, 1621 bp, Solanum lycopersicum
tctaatttcgacagtaacttttcatgaaatatcaaaattaactctttacctcgtctacgccacatcaaatacaaataatgaaccgtttagccccaatatccccgtgatcattcacacgtatggggagatcgaaacaatgaaaaagtaaataagagagatattaatgtctccactctttctggacccccttttgaaaagtgataagattcttgtgcctaacaaaacactctgcatttgcagcttttgctgacccaaaaaaaaatctctcaaagaaaaaacatgactgaagtaaaaaaagatgaagaaaatcatcaccagcatctttgtgatttttgtggaaacaacacagcacttttgtattgcagagcagattcagctaagctctgttttacctgtgaccgtgaagttcattcaacgaatcagcttttcactaaacacactcgttggttgctctgtaatcattgtgattcttctccagcttctatactctgttgtacagagacctctgttttgtgtcagaattgtgattgggaatctcataacaaactattgtctctacatgaaagaagaccactcgaggggtttaccggttgtccttctgtttctgagctgttgtcgattcttggatttgaagatttggggaagaaggaacttttgtgtggcggggatgatggagcttatggtttctctgattgggttatttgggatgctccgtctgttgttactcttgatgatttgattgctaataataatgagtctcgacataattatcaagctattggggttcctcctctaccgaagaaccgaaatgctgcttgtggaaaacacaaggaagaaatacttggtcagcttcgcgaattatcaaagttggaaccaaattctggtgatgatcaagatgaaaatgtaccaactacaggatttcaatctatggaacctgtccaaaattgtccgttgagatataaaggttcgggatttatgcagaggtcagatcaacatgtagttccttcatctgaggggagtgcctttcattggcacggtgatactggtgaattcgtagatcaaggcttttcttcttctttaacggactgcttcattgagacaaagtgcttactacccgacagagattcagatgtttgtgatgcttctggtggaggaaatgaagaacaatctcatcatcctcccactactgaaacatttcaaatggtacctaaagtcgttcatcgcgagttgaacagccaagaaagagaaactgctgtgtcacggtacaaggagaagaagaaaacaaggagatatgagaagcacatcaggtacgagtcaaggaaggctcgtgcagaaactagaacacgaatcaagggacgttttgccaagatggattacagggattcctccgtgcatcagtaatgtcaaacgttgtttgtttttctccgaatccaggacattctgcttgaagatcatcggtatactgtactgaaaaacgtttagtcgtgtggactgcaaatcttttatcagctcgatcgcaggatctatagaggcaattagggtgtctatcttatttttcagcatgtatttatagactataataatctgtaaagctaaaagaagttgataaaaacatgtagca

SEQ ID NO: 146 - DNA, 2105 bp, Solanum lycopersicum
atacctaaattctcgctcgctctctctattagcattatatttttttaggctttgctttctctctcttcacatccaaaaacaaacaaattttcaagaattgggcttatttgaatctcaataatcctctcaaacaacagcaaaaaatattgaatttggatttaggattggggaatttcaggaagatatctatgaaatactaattttctcctgcaaaatgttaggcccttttactgattttgctcctttctttgtacccttttcaaaacccatgtctcatctttctctcatcggcggtaatcatacatctgcacgtttctgttcccggtaacccattcttttcactaaatccatctcctctcctctccaatctttacccattcttttttcgtcgaaatacttacaaaaagttcgttgtagatattcatttctgaaaactaaaaggagtcattttgatggatcatagtacggggaaaccgggtttttttaggaatgttttggtacgtttatgcctgttttgtgttgtgattgtctgttgtcggtttgcttatgtggtgactctcaaaggggaaacttgtgacctcggcgatttctgtttcttctctttaccggaaaatgtcaatgttattgccggcgtcggaaagctcactgagtctgtatcagcggtgatgactaccgagaatgccgtaaaatctgctcccgcgaagcccaaacttcccgatctatgggcaaacaaggagtttcaaaaatcagcccagttttactcttcggtgtttgaggatcttgttgcagagggttttttgagcccaaattcaaaaactctttgcgttgaaacaccgatgggttctgatgtttttgcgttgagggaaattggggtagccgattccgttgggatttacaagaaaggttcaaagcctttagtgattacaggcaaagctgttaaacaaccctttgaagatgatacgttcgatttaatattttccggtgccggaatgatagacaagtcacttaagccgggagatttcgcggcggagatttgccggactctaaaacccgaagggtatttagttgtccatacaggttctaatgatacatacagtttcaattcattccttcatttgttcaattgttgtacattaattaagtctaggaatattgatggttttgattcgactattcgtgagatcatcatgaaaaaggatatatttgttgaagaaaaagtgagtgattccaagaacaattgtggtcatgttcctgattataaaatgaaactgattagaaaagctgagcctttgattaaagaggaacctaagaaaccatggattactcttaagaagaatgcacagagcattaagtacttgtcatccatggcggatattagttttaagcagagatacgtgtatgttgatgttggttcgaggagttatggttcaagcattgttagttggttcaagaaacagtatcctaagcaaaacaagacctttgatatatatgctgttgaggctgacaagacattccatgggcagtataaggagaagaaaggggttacattgttgccatatgcagcttgggttaggaatgagacattatcgtttgagattaatcaagatccgggtcataaagatgtgtcgaaaggaagaggaatgggaagaattcaacctgttgaatcttctagtgaaggtgcaagtgaggtggatttaatccaaggttttgactttgccgagtggttgatgagcgcggtatcagagaaggattacgtggtgatgaagatggatgttgaagggaccgaatttgatttgatcccgagattgattgaaacgggggcgatatgcttgattgatgaagtatttcttgagtgccattacaataggtggcagaaatgctgccctggggagaggtcttcaaagtatccgaatacgtatagccagtgtttggatctcttcacttctctaagagaaagtggagttcttgttcatcaatggtggtaatacagtctagctctttagtcttttttgttatacaagaggccaaaaaattctctcttttacttcatatgtatctactgtttgccccaatataaagaattacgttcaatgtgtttgcttcta

SEQ ID NO: 147 - DNA, 1710 bp, Solanum lycopersicum
atttcacacaagcaaagcaacctcattcaactccaaaagctgtttaggggaggaggtgatttctaagatccaacacttgtgtaattgtgttatttatctaaaaacatgactgttgaggtgcaatgtgaggcaactcaagtggctgaagtagttgttccacaagaggaattagtggctgctaacaaggttgtggaggaggttgaggtgaatgagaaggtaaaagaagatgaagaagaggaatccaagcctaatacaattgagaaaagctcttcttatagagaagagagcaacttcctctctgatctcaaagagaatgagaagaaggcattgaatgagttgaaatctatagttgaggaggccattgttgggaacactctattcaaaaaagaagagaccaacaagtctctagaggaagagggaaagaatgaggaaaatcccgatgcgaatatagaggagaaggagggtgatttggatgttgttgaagtggatagagagatttctatttggggtgtacccattttgcctagcaaaggggatgagaaaaccaatgtggttctattgaaattcttgagagcaagggattacaaagtgaatgaatctttcgaaatgctcaagaaaacactccagtggaggaaggattttaatatccaatccatcttggaggaagatttgggctcagatcttgcaccagctgcttacatgagtggggttgataaccaaggacaccctatttgttacaacattttcggcgttttggaagatgaagagatttataacaaaacgttcgggacagaggagaaacggaatcagttcttgaggtggagagttcagttaatggagaagggcattcagcagcttgatttcaaagctggaggtgttagttcactgcttcagataaatgatctgaagaactcgcctggaccgtctaagaaagaagtcagggttgcaaccaaacaagccgttgatcttcttcaggataactatcctgaatttgttgccaaaaatatattcatcaatgttccattttggtattacgccgtgcactctctgctgtcgcctttcctaacacaaagaaccaaaagcaaattcgtatttgctcgccctgctaaggtcactgagaccttgctcaagtacattccaatccatgaaatccctattcaatatggtggactcaagagggagaatgactttgagttttcagcctccgactgtgaagcttcggagattctccttaaagctggatcaattgaaactattgaaatacctgcagtagatgtggaaagtacatttatctgggatgttacgattgtgggcggagaagtgagctataaggaggaatttgtgccagaggatgagacttcttacactataatcattcagaaggacaagaaggtgagctcgacaattcgcaacacgttcaagaacactgaagcaggaaaggttgtgctgacaatcaagaacacttctagcaagaagaagaaggcgttttatcgacacaagatcaccaaatcaacaatttgagatgagcaagtttctattttgagtgaagatggagttctttttctctgtttttaagaatatgtataatgtagtaacctttttgtggtggttcatatacttgattatttttggtcctacattcatattgtatatgctgatttattcttttttctccctacaaggaagaatatgatctctctattttttacc

SEQ ID NO: 148 - DNA, 1046 bp, Solanum lycopersicum
gggtcacgaacctttgtcagttgccactctcagtgagggtttaaacttacatcaaaaccctagcgttccttttaccccaattctaaccgctttacttgctccctgaacttacgcagcatagccatggcagaaactgaacctgaagtcgccgccgccgtgcccgccgttgaagccgtggtagaggccgagaaagaggacacttcggctcaggacatggatgtcgaagctcaagccgccgatgatacggaagagaacggcgggtcgaagcgtccaagggaggaggaaaacgaggtggagaaggaagacgccacaaagaagctgaaggtcgataagtctgtggaagaagaacgattcgagaatttagatggaagcaaaacggtggatgaagaaaagaaagatgtgtcaggtccgattagcgtgggccctaagaacttcggatcgtctgtggaggtgttcaattacttttataagcttctccattcttggtctcccaacctcaacctcaacaagtatgagtacattgttttgcttgacttgctaaagaagggtcatttagagccagatagaaagattggtacaggagtccgtgcattccaaatccggtttcatcctcaatataaaagtcgttgcttctttatcattagggaggatgactctgtggatgattttagcttcaggaaatgtattgatcacattagtcctctcccagagaacatgcaagtaaaacacgaggcaaacagagacttggcacgtggtggaaaaggaggtgggcgtggccgtggaagaggagggaagccaagatactgaaggcagctgcatgttctgtcaattgttatgtaagccgtcacatgctgctgcctgcttagtccacattttgttcaatacccctttcaatcctgcagtttatgacataatatgcgttatgactacaaggatggcatctactagttatgatgttaccgtaatatgcgttaaatttatgtaatgtatgaatacatcagacgaaattatcatatgaagaacgtattattcaattttagcatata

SEQ ID NO: 149 - DNA, 1190 bp, Solanum lycopersicum
atcaagaactttcctccttctctcttcttccttcaacttgcccatttccccatccatatatatatatatatatatatatatatatatatatatatatatatatatatatatatatatatatcttctacaataattttgctatatttacaattacagatagtccatctcattggcagtatttaccatgaataacgataccccaagcatgattcatgatccattgattgattccacaggagatggaggctatgcattgagtggaaaaattatgctaagtgctattgttatcttattcactgttgttgttttcatggtgggtcttcatttatatgctcgttggtaccttgtgtctcagcgccgccgtgaactccttcgccgccgtagggtcaaccatcgacggactcatattgttttctacgttgataatcctggttccggtttgtctgatgctaaccggggtttggaacaggcggttctcagttccttgccggtttttgtttattccgacaagactcacccggaaccgctggaatgtgctgtttgtttatcggaatttgaggagaatgaaaagggtcgggttttacccaagtgtaatcactcttttcattcggaatgtattgatatgtggtttcattctcattctacgtgccctctttgtcgctctccggtggaggcagtacttatcgaaccggataataaccgggttgaggtggcagtaacagtgaacgaaccgggttcgagttcgggttgtgaggagaatggtagtcatcattctaatatgacgccgttgggttgccggcgaaaaggattggatctgaccggagtaagaatagaggtaccaagaaggaacgatttcgaagccgatttggaaatgggagtgagagtaagttcaccggcgattcaatcgagatcaccagcgtctcgtttaatgtctttgagaagaatactaagtatgaacagaaaaacacccaccggaactagccattctcctagtggaagttgcgccgcggattttgatatagaaaccggcggtagtagtggtggtggaaaaattcaagtcggcggcgaacgcatcacaactccgtgagttaaaaatgcgggcacacatccctaggcaaaagctgaaaaatattgagtcacgccgattgcgtgaaaacaggagaaacagtgacttgactgacagaaaagtc

SEQ ID NO: 150 - DNA, 1831 bp, Solanum lycopersicum
gaattgtgtttctactcacatatatatatagagagtagtattttcaacaggcccaaagtctctatgcgttcacaccacattttatcccatatatatgaatgaaccttgtttcccagaagaaaattcttcaatttcttgtatcatgaatcatctacccaataaacgccgtagaaggaggaaagaaatcgtacaacaaaccccaactaatagtagcgcaggtggtggtggtaatgatgaatttgggtcggaaaatcaaggggctgtcaaaacgaaggagttgaaacagatattaacctctttgttgttacttgaagagcaagaaaaatcggaatttgcaaaggaagaggaagaggataaacacttactcgaagccaatcataagaaaacaacgaaagtgatgtgggattattattccaatgttcaacagcatcattctgatttagaacagttagatggtgttcgaaagaggaaagggagagggaattctgctgctcttactgctactgcttgtgcccttgcttctgcagctgcagaggaagaaggggtttccagtaataaatctaccgataaaggtgcgcctcataggcgattgtgggtgaagaataggtcaaaagcttggtgggatcaatgtaacagtcctgatttccctgaagaggagtttaagaaagcgtttcggatggggaaagatacatttgaattgatatgtaatgaattgacttctgtggttgcgaaagagaatacgatgctaagagatgctgtacctgtgaagcagcgtgttgctgtttgtatatggagattggctactggagagcctctgagattggtttccaagagatttggattggggatttcgacttgccataagcttgtgctagaggtttgtactgcgattagaactgtgttgatgcccaagtatcttcaatggcctgatgagaagaaaatgagggatataaaggatgagtatgaggatatgtcagggatcacaaatgttgtgggatcaatgtatacaactcatatacctataattgctccgaaaattagtgttgcagcttatttcaataagaggcatacagagaggaatcagaagacttcgtattcgattacagttcaaggggttgttgatccaagaggggtgtttactgatgtgtgtatcggttggcctggttcgatgcctgatgatcaggtactggagaaatccgcccttttccagagggcgaatacagggttactgaacaacgtttggattgttggtagttctggataccctttaatggattgggttttagtgccttatacacagcagcagctaacttggactcaacatgctttcaatgagaagattggtgaggttcaacgggtggcaaaggaggcgtttgtaaggttgaaaaggagatggtcttgtttgcagaaaagaacagaggtgaaactacaagatttgccagtggtgctaggggcgtgctgcgtcttgcataatatttgccagatgaggaatgaggagatggatccagaactcaatttcgagctcattgatgatgaaatgcttccagagattcaattgagatcgaccaatgctaggcttgcaagggatgctattgctcataatcttctacaccataaccatgctggtacttctctcctttaatacaatcaaaggagggaaaactttgattcatgtaattctttcaagttattacttatattttcacatttgtttttcttaagttaagttagtgtgcaaacggatgaaaatgttgcttttctagcatacactgcagacaaatattgtatttcatacttcaattagagattgatagaagaaaattgacttggc

SEQ ID NO: 151 - DNA, 1815 bp, Solanum lycopersicum
aaataaaactttctacaatctacacgccgtacgcgttacactatctctcgaagcaacctctaaattaaactttcattctctattaaataataattcattccctttttcttcatcatctacatcaaatctgcttcaatggagcctccaaatccccagcaattccagcaatttctcagcagtgttctgtctcagcgtggtccagctgcacttccttatgctgaagatgtgaaatggctgattcgtcaacatctcctttctttaatcgatatgtatccttcacttcagccgaaaactgcttcatttactcataatgatggaaggactgtgaatctattgcaagctgtaggtactgttccgatggtttatctagatcgtacgtataatattccggtgattatttggttgatggaatcttacccacgtcatccgccgttggtttttgtgaatccgactagggatatggttattaagaaacctcatccgtttgtgaatccatctgggattgtgtcgattccgtatttgcagaattggatataccctagttcgaatcttgttgaattggttcgtaatttgagtcatttttttggaagggatcctccgctttatgccaaagtacaagcacatccatcaaaccctaaccctagtcctaggcctacccctacccctaaccctcatcctccgccaagtacgagttttcctaatcacagctcgccagtcgggtcatatgggattcggcctgcgatacctcctcggccagttcaacaaccaccttatggtgcagtgaaacatgatgatccggaggaggtttttaagcggaacgcgacagataagctgcttgttgacttgcataatgatatagttgggttgaggaatgcacaggagaaggatatggatgggttgtttaatgctcagggagtgttgaagcagcgggaggagcagttgaaacaagggttaaaggaaatgcaggatgagaaagaggggttggagcagcaattacagatggttttgatgaatagtgatgtattagagggatggctgagggagaatgaggggaaagcgaccaatttagggaatgtggatgtggatacggcctttgagccgtgtgatagtctttccaagcagatgctggattgcacggcatcagatttggcgttagaggatgtgatttattcgttggacaaagctatacaaggcggggcaataccatttgaccagtacttgaggaacatcaggttgttgtcccgcgaacaattctttcatcgtgctacagcatcaaaagttagggctgctcagatgcaggctcaagttgctaatatggctgctagaacatcacaatatgcattgtgatagacatctgatcacttgcaggtgtgtttgcaatagactgaaggtcaatatatttctagattggttacttgtgaataatctgtcaatgtgctatatctttaccaatagattttgacactacattttggtgcgggtgtttaattggtatttattggttttgtatcgttttgttaccaaaagtataatcacataaagggattttccctacaatgatatccacgattttcatttctgtcaagtcatcccacttctatgggattgtgattttggaccaagattagtgttctgtcactctcccaaaattgagtagtaagaggttcaactcttttgtcttccactttagtctttgcaattaggccgtttttaggatggatgtctattctttcaaattatagttatggcgatcaacattctgttcaaatgcatatgcatatctttgtgtacttaactttctagcaatgtagcatg

SEQ ID NO: 152 - DNA, 1312 bp, Solanum lycopersicum
aaattgccctaaattgaaatttttctccaattcccttttgttctctgaaaccctaacaacattttttcttctctcgatcaaaaaatcttctcatcaatggagattgtatcttaaatcctgaaaatttcttcataattactcgttctcttgtatttctcaccatatccagcgaaaagttgcagatttgtacgttcgtggcatgtttctgcatatattgattggctttagctgaaattttcctagtctgcttacatcatcatggcttcactggatatgaccctggatgatatgataaaaagtcggagaaatactgagaggggtggtaggggtcaaggcagggcccgacgcggaagaggggcagggggttcatttagaggtggatcatttagaggtggaaggacaacaggggctcctcgtagagggccacttggcgtgaatgctcggccatcagcctacaccattgccaagactttccgcagaaccaagaatttgccatggcagaatggtttgtttgaagatagccttagagctgcaggactgtcatcagtattggagagtggcacaaagttatatgtttctaatttagacgttggagtgactaatgaagatataagggaactcttttcggagatgggagaactagtacgatttgcaatccactatgacaaaaatggacgtccaagtggcgctgctgaggtggtctttgccagaagaagtgatgcattccaagctcttaagagatataacaatgtgcagttggatgggaagcctatgaagattgaaatagttggttccaacccagaaattcctttgtcagctcgtgtaaatgtagttggaggaaccaaccggaggaggactgtggttatggcgccaggtggtccagctcgtggaagaggagctgctactagtcgtggttctagtcaaaggggccgtggtggtttgaggaatgcacctggacgtggtcgaggtggtggtggcggtcgtggttggggtagaggtcgtggccgcggtggtaggggaagtagcagcaggggcgctgataagtcagctgaggatcttgacaaggaactggacagctaccacgccaacgctgacgccatgcaaacttagatgtggcgcttccataacttgtgagttaactagaagaaccaatcatgtctactatgtctctgtatcacgtcaccaaaactcatgctttccagttgtagtttcttgccgtttatatgattgtacgataaatcgatcatttgatgaatgctttttaatcccctaatgaacgtatcgtaaatagagtggtttatttgtcttcccc

SEQ ID NO: 153 - DNA, 1462 bp, Solanum lycopersicum
tggcagctgaggagtgggtagttagctcagctaatagtacaccactctattattttttcaagaaaatttttcattgtaccttgttagatagccaacattctttcacaattcttccttttggggtatactataattccaaaattttcaaccccatttcatgattttccctttactcaaaccccattatcataaagtttcaatttttatcaagaaaatgagagcagtttcagtatttggtggtgtgttccttgtgttggcagtgtattgtgggttggacccttttaagcatagtgcaatttctgagttcccaaattttgagtcttttaaggttgagatgccagcttggtctgaaatcccagttgaaaaagattcacaaaatttgcttcagaaatctgaagttaagttcttggatcaaattcaggggccagaaagtattgtttttgatcctcagggtagaggaccttatacagggatagctgatggaagagttgtgttttgggatggtgaaaaatggaatgattttgcttatacttcagctaataggtcaggcttgtgtgatccaaaaccgtcagcgttgagctataggaagtacgagcacatctgtggtaggcctttggggttacgatttgacaaaagaacaggtgacttatatattgccgatgcatatttggggttaatgaaggtaggccctgaaggtggattagcagaatctttgacaactgaggctgagggggtacctataggatttgcaaatgacttggatgttgatgatgatgggaatgtttattttacggatagcagcacaaagtaccaacgcaggaattttatacagctggtcttctcaggagaagatagtgggaaggttctcaaatacaatcctaggacgaaagaaaccactattcttattcgcaaccttcaatttccaaatggtctgtcactaagcaaggatggttccttctttatattttgcgaaggttccaagggcaggttacgaaagtactggctgaaaggtgagaaagccggtacatcagaggtaatagcaatcctcccgggatatccagacaacgtaagagcaaacgaaagaaatgagttttgggtagcaatccactgtcgtcgtaccatttacagttacataaatggcatataccctcgactccgtcaattcttgctgaagcttcccatctctgcaaagctccaatacctcattcacattggtggcaggttcactgcagttgtcgtgaagtacagccccgagggcaagctgttgcagatattggaagatcgacaagggaaagtcgttagagctgtcagcgaggtagaggagagggatgggaagctttggatgggaagtgttctcatgtctttcatttcagtttatcagctagaatgaactcttgagcttttgcttttgctttggctcatcatcaattacttctccattggaaaataactcattttactt

SEQ ID NO: 154 - DNA, 2098 bp, Solanum lycopersicum
gagaaacaatggcgaaaatggtcagcccagatgctatttcaactattttagcgaacccatcgccggattcttcttcagatcttcctgaaattattgttcaagtagtggatctcaagcccactggcaacagatacatgttttcagccaatgatgggaaaatgaagattaaggggattcttcaatctagtttgtcatctgaagttatatctgggtctatacagaacctgggtcttattcgggttattgattacaccctcaatgatatcccaactaagaatgagaagtacttgattgtaactaaatgtgaggcagtgtctcctgctcttgaagttgagtacaaggctgaagtgaaaagtgaagacactggcattgtcttgaagccaaggcaggaagagactgggattgttttgaaacctaaacaggaatatcaaactaaatctgctgctcaaattgtacatgaacaaagtggaaacatggcaccgactgctcgaatggcaatgacaagaagaattcagccacttgtctctttgaacccttaccaaggaaattggaccattaaggttcgagtaactagcaagggtaatatgcgaacctacaagaatgctcgtggagaaggctgtgtgttcaatgttgaattgactgatgaggatggtacccaaatacaagctacaatgtttaatgaagctgcaaagaagttttttgacaagtttgaattggggaaagtatattacatttcaaagggaactcttcgagttgccaacaagcaattcaaaactgtacaaaatgattatgagatgactttgaatgaaaattcccaagttgaggaggctagcaatgaagaagcttttattccagagataaagtttaactttgtcccaattgatgaattgggcccttatgtcaatggcagggagcttgttgatgttattggggtggtccaaagtgtatctccaacaatgagcatacggaggaagagtaacaatgagacagtcccaaagcgtgatataactattgcagatgagacgaagaagactgttgttgtttctctttggaatgatcttgccacccatgttggacaagaactgctagacatggctgataaatctcctgtagttgcaatcaaatcccttaaagttggagacttccaaggattgtctttatcagcattaagcaaaagcaatattgttgtgaatcctgatttacccgaagccaaaaaattgagatcttggtatgattctgaaggtaaagaaacttcattggcatctattggttctgggatgagcccttctaccaagagtggagcaagatctatgtatactgatagggtttccttgcttcatataaccagtaacctgtcccttggtgaggagaagcctgtctttttcagcttgaaagcatacataagtttcattaagcctgatcaaaccatgtggtatcgggcttgcaagacatgcaacaagaaagttactgaagcttttgggtctggatattggtgtgaaggatgccagaagaatgatgcagagtgcagtttgagatatataatggcattgagagtgtctgatgcaagtggtgaagcatggctctctacattcaatgatcaagcagagaaaatacttggatgctctgctgatgaacttgacaagctgaaatcagaggaaggagaaactgcatatcaaatgaaattgaaagaagctacatgggttcctcaccttttccgggtcagtgttgcacaacaagaatacaacaatgagaaaaggcaaaggataacagtcagagctattgctccagttgattatgaagcagaatccaaatacttgctggaagaaatgtctaagatgaacattgctatttaatgaggctagcctaacatagaatatttttagatttatttttgttatatttaagtctgaatgctcactaggattcgttagtaaaacagctgtatatatgtctcattgcctttgcttaatagcaattcagcattttgcattttagtgaatgcaccttttgcagtttatcatattttgttatgtattcactatttaatgatggttctacattttatctaatggagcatttcaattcttgtgatcacatc

SEQ ID NO: 155 - DNA, 1714 bp, Solanum lycopersicum
ggaatctcttccatttttttcctcctgaaaatcactttttcttcattcaccatggaaggcgcagcaacagctcaagctttatctcgtattgggttagctggcttagctgttatgggtcagaatttggccttaaacatagctgaaaaagggtttcctatatctgtttacaatagaaccacttcgaaagtagatgaaaccctagatcgtgctcagaatgaaggacagcttccattgattggacagtacaatcctcgtgatttcgtgttgtctattcaacgacccagatctgttatcattcttgttaaagcggggtcacctgttgatcaaacgattgctgcgctttctgagtatatggagcctggggatacgattattgatgggggtaatgagtggtatgagaatactgaaaggaggattgatgaggcgtcgtctaaggggcttttgtatttgggtatgggtgtttctggtggagaagaaggggcgaggaatggaccttcgcttatgcctggtgggtcttatggggcttatacgaatatcaaagatattcttgagaaggttgcagctcaagttgaggatgggccttgtgttacttatattggtgaaggtgggtcggggaattttgtgaaaatggtgcataatggaattgaatatggtgatatgcagttgatttcggaagcttatgatgtgttgaagaatgcaggtgggttgagtaattctgaattggctgatattttcgccgaatggaaccgtggggaattggagagctttttgattgaaattacagcggatatattcaatgtgaaggatgaattgactggaaatggggagttagtggacaagattttggataagacaggaatgaaggggacggggaaatggactgtgcagcaggcggcggagctgtctattgcagctccgacgattgctgcttcgttagacagtaggtacatgagtggattgaaggatgagagggtagaagcctcagagatttttaggaaggaaggtttaaaggaggaaataagttctgatattaatggtattagcagtgttgataagaagagattgattgatgatgtgaggcaggcattgtatgcgtcgaaaatctgtagttatgctcaggggatgaatttgctaagggcaaagagctctgagaaaggttggaatttgaatttgggagagatggctaggatttggaaaggtggttgtattatcagggcagtgtttttggatcgtattaagaaggcgtatcagaggaatcctaatttggctaacttgatggttgacacggagttcgcaagggagatggtgcagaggcaagctgcttggaggagagtggtgggacttgctgttcagaagggaattagtgttcctggaatgtctgctagtcttcagtatttcgacacctacaggcgttctaggcttcccgcgaaccttgtgcaggctcagagggactatttcggggcacatacttatgagagagttgacaagccaggagcataccataccgagtgggcaaaacttgctaggaaagctcgagtgtaatgctgctgcagctattgcggattatgatcaaaatctctggtattagtcgcgctttagtacttttttcgtttagttttgcagttaataatgttgtatgcctttgaacattatagggccttcgctatcgaaatgacttcttccattgaagtaaaagaagttgcttttcctacat

SEQ ID NO: 156 - DNA, 2063 bp, Solanum lycopersicum
caaaatataacattacacaccaaatatttaaatttctttttcaaactttacataaaaaaatcatttcttgatccaatcttgaaccataatggctgattatgaataaagcttacttttttgtcctgtcacccttactcttacctttataaactctcgtgaacagcctccaatggggagttctacagcaacccatttcatatttttttttgcaaattttgagctgctagctatgttagagaaacatagatcttgatatttatatagctaaagtgtttatcttttttcaattttgataaaaatgggttctttatttttgcaaaagggagtgttggtgtggctttttttgtttagtttgagatttatttgtggaacaaaagctcaaggtactgtgtttatagatgggaaaattgctattggaagaatagacaggcattttatttgtgctactttggattggtggccacctgagaagtgtgattatggaacttgtgcttgggactattcttcattcttgaatctggatcttaacaacattatttttctcaatgcaataaaagcattctcaccattaaagattcgtttgggcggaactttgcaagacaaagtcatataccaaactgaagatcatcaacagccctgtgtctcatttgttagaaacacaacagagatgtttggttttactccagggtgccttcccttgtctagatgggatgaactcaacgcattctttaataaatctggggctagtataatttttggattaaatgctctatatggaagatcggtacaccctgatagtttatctgtcggagcgtgggatccaagcaatgctgaatcacttatacgttatactgttaaaaagggatatgatatccatggttgggaactcgggaacgaattgagtggtagcggagttggaaccagagtagcagcagatcaatatgcatctgatactattgccttgcacaaaatagtgaaagatgcttatgagaattctgaaactaaaccgttggtcctggcaccgggaggtttctttgatgaaggctggttcagggaattagtaaataaagctggggcatcatttgatgtggcaactcaccacatatataatctcggtccaggaagagatgaacaccttcttgagaaaatccttgatccatcttatcttgatggagaagctgatacatttagcaaacttcagaatatcctcaagacatctggtagttcagtggttgcatgggttggtgaggctggaggagcttacaacagcggtcgcaaccatgtcacaaatgcctttgcttttagcttctggtatttggaccagcttggtatgtcagctgcctatgataccaagacatactgccgacagacattgattggtggaaactacggtttactcaatacgactacctttgaaccaaatccagattactacagtgctcttctttggcaccgattgatgggaaggaacgttttggcaacgagtttctcaggaacaaagaaattacgtgcatacgctcattgtgcaaagcaatctcaaggtatcacattactgttgatcaaccttgatggcaacaccaccattcatcccagagttgattttaacggtaccatgttacatcaacaaaaacacagacatcatcataaccacagaaagagttcaatcaaactgcctagaagtaacaaagtagcatcaaacacaagagaagaataccatttaacagcaaaagatggaaatttacaaagccagacaatgctactaaatggaaaggcactaattgtagattcatctggaaatatacctacatttgagcctatatatgtcaattcaacagaggcgataaccgtcgcgccactctctattgtatttgtacacataccatatgtacttttgcctgcttgtagctgagtttgtattttgtattatgtattaagtgatgtatggagccaaaaggggttccatttgattattgaaccaataagttacacagagaattatgtaaagagaatacatgtattatttttttctctaagagaaaatataagcatttattcttgctata

SEQ ID NO: 157 - DNA, 1719 bp, Solanum lycopersicum
cacaacatctactgagaatttactcctcattacagaaatggcagcagcaaaacggtttttagataattctaatccggatccaaaacaaccgaattacaaacgcatgagatcttctactataccttctgttattaaggaagcaatgaaggcgaatttcctagagaacgtgtcttctgctttggaacccatgctccgtcgagtggttgttgaggaagtggagaagggactaaggcgttattcatgtcgttcattaacgagatctccttcactaagaatcaaagcattagaaccatcgaatcttcgtctcattttcaacaaaaagctctctaaaccaatatttaccagcagcaaagtcgtcgccggcgacggtcagagtcttcaaattcttctggtggatacaagcggcgaaggcatggttccgacgactttaccttaccctatcaaagtagaactcgtcgtactcgacggagatttcccgtccggagaaactgaaacgaattggtctcgcgaagaattcgacaaacgcgtggttaaggagagaaccggaaagaggccattgcttaccggcgaactgaatttcacgatgcgtgaaggcgtcgttcccgttggggaaatcgagtttactgacaattcgagctggattcggagccggaaattcagaattggcgcaaaagtggttcaaattggaaacaatcaaacttctgttcgaattatagaagccgttactgaatcgtttgtggttaaagatcaccgcggagaattgtacaaaaaacattacccaccagcactaggagatgaagtgtggcgtcttgagaagattggaaaagatggaactttccgcaaaaagctctcttcaaaaggcatcaacactgtacaagatttcttgaagttagctactattgacacacaacaaatcagaactatactgggaactggaatgtctgataaaatgtgggaagtgacatacaagcatgcaaaaacttgtgagatgggctcgaagttattcatggcccgtggctcaaactacgttctaatccttactccgatttgtgaagttgttagggcagttattgatgggcaaatttaccctactcatgacttaactgggatacaaaaggcatatatccagaatttggtgaaagaggcttataccaattggagttctttagaggaagttgatggtctagttaatgagccagcactactaactcaaggagaaccaatggtggatcaatatccaaatgttcatcagcagcaacaaccaatgataagatcctatcaacgaaacacaattttgacagatgcatctgaacaattaatcgaatacaatgactggattggtaatcctaactacatttgatacacctgctgataataacggtggtagttacttttcagacagatagagaattgtgttacattttacactgtcagcatatagaagttaaacagaagacaatgaaggattgaagcttatgcttataggtaaatgtacatagtgtgtaggaacaaaattttgctcaataaagggcggaaaattgttgtacaagtcgcgccacccctttttataagatgtgtggtctggcaatagtatgcaaaagtatgtttcaatttttttttaatttaagattcaaagttgagttgtctattctagagggtgattgttcatttaattgaatgaacaaattaatggaaatttttactttgattatgcattca

SEQ ID NO: 158 - DNA, 1983 bp, Solanum lycopersicum
ggactttcttgtccctctagtctcttccttaatcaattcaacaaagaatacaaaaaccatcaaacaaaacctatcttttctccccttatataaacaaaaaaaaaatcactacaattatttaattcttcaatatttgattcctataccctttccataataaatccattattaatattcctcttcaattttttttttttacttaaattccatatatattcatcactaattacaatttttttttattaaaatggattttttctacaaagccaaagctgtaaaattaaaaagtcatctagacaaataccttgtagccgatgatgatcaagaaaatatccgacaaagccgaaacggctcatcaagaaaagcccggtggcttgttgaacttgttgaagccgaaaacagccactttatacggcttaaaagtggctccggcaagtatctcacggcttccgacgagccgtttcttcttggcatgaccggaaaaaaggtaattcaaactttgcccgaagaaatgaaggacttgagaatcgaatgggaagtaataagggatggatttcaagtaaaattaaggggttttggaggaaaatatttacgtgcaaatggaggaatgccaccatggagaaataaagtaacacatgataatccatatagtggtagtacacaaaattggattttgtggaacgttgaacctattgatgtgcccgaaaatgaatcgttgacggaatatttaactatggtttcaagtttttcatcgatttctgatgagcttttaagcctggatttaggatctccgacttctgtacattcaagtttttcattctcacctaggagggctaagatttctttaccaaaaagatcagcaatggagctatttcacaaagcaaaagctgttcgtttacagagtcaccatgagaagtacttaacagctgaagaagatgaagaatcagtgactcaagatcgtaacggagcatcaaaaaacgcgaaatggacagttgaatttgttgaaaaaaccgaaaatgttattcgattgaagagttgttatgggaaatatttaacagcttcgaatcagccatttcttctgggtatgactggtagaaaagttcttcaaactttgcctaatcgacttgattcttcaattgaatgggaacccattagagaaggacatcaagttaagctgaggacgagatatgggcaatttttgaggggaaatgggggtcttcctccatggagaaattctgttactcatgatattcctcataggacgaaaactcaagattgggttctttgggatgttcatgttgttgaaattttggcgcattcgacggcggagacggtggcggagacgacggtggtgggtggtaattctgattcgtttgcttctgaatcgagttctgctactactactggttcatcaaaatcttacagcttttcgagacaagagtcaagtgattcattgattagttcaccgcctaagttggtagatggaaggcttatatattatcacgttacggatgaatttggagaaattgacgaaggagccgagggactttgcataacttttaagggaaatagtgttgaggatctaaagaagagattggaggaggaaactgggctcgaggatattactgtgtgtactcggagtgctttgaatgggaagctttatcctctccgtttgcagcttcctcccaacaacgcaaatatgaacgttattattttgccatcttcatctaaagaagctagtgatattgcataaccaagaaggccattgtagccctactcgtggagcacttatcgcggattgttgcagtagatggatttttgtatcagtaaaatcgcgtaaacgtgtatctccattgtttattaagcatttgtatataaggttttgagtattcagagagatatacacaatatctgctcttgatgttaatatcatcatcatacatatacacttccacagaataattgaaaattgaaatctggtgg

SEQ ID NO: 159 - DNA, 717 bp, Solanum lycopersicum
aaacactagagaagaagaagatcatcaatactacagtgtatagtatgagtgtcatcagcaaattaacattgctcatcatttcaattgcttgcatttttcaggtatcatcactaagcgcagatgggtcatcacttgtaccactaatcatagaccaaatgataagcagcaatccggctaatacatttcttgatccattcaaagttttagaacaaataccatttggattagaaaacactctgctcgcgagagtcgactggaaagagacggcgaagggacacgtgataagcgtagaagtacctggattgaagaaagatgatataaagatcgaaattgaagaaaacagagtgttgagagtgagcggagagaggaagaaagaagaagagaaaaatgatgaagagaatcattggcattgtgttgaaaggagttatggaaagttctggagacaatttcgtttgcctgaaaatgctgatattgatacaatgaaagctaagcttgaaaatggtgtgcttacaatttcatttgctaaattgtctgctgatagaattaaaggtcctaaagttgtgtctattgagagtaaacaacaaggaaaagagtcctctgttagagaagagctttaattttatgagttcatcctctgttttctgttcatcctctgtttctctctgtggtacgtgtatgatgaaaaaaatgttaaataaaatcgtattttgaaatatt

SEQ ID NO: 160 - DNA, 1706 bp, Solanum lycopersicum
gtgtaaaccagctgtttttcatttctccctctttggaattcagcccctttgaaacaaactttcaaattacaccaactattaaatcgtttcttgtttttggctatctgggattttgttctcttgaagaaagattgaatctttctagattttggtcatctggggttaagtgttttggaaaaagattcaatcttttgttggttttggttatctggggttaagttttttttgaagaaagattgaatctttcttgattttggctatctggggtcaagtatttttggaaaaagattcaatcttttattgttttggttgtgtggggtgtaatttggtgtaagtacataaattttggtgtaaaagaaaggtatttcttagtgggatgaggatgggggttgaaaatgtagtggggtatgagagggaggtagaagaagaggaagaggaaagggaaatggaaatggtggtggctcatgggtctccccagcaacagatgaagttggtggtggtaggctatgctcttacatccaagaaaactaagagctttttgcagcccaagcttgtaggtctagctagaaataagggaatactgtttgttgctatagatcagagcaaacccctttcagatcaaggtccttttgacattgtgctccacaagttgtcaggaagcaagtggagtcgtattcttgaggattataggcaaacacatccacatgtcgcggtccttgatcctccagatgccatacagcaggtatataatcgtcaatacatgcttgaagaggttgcagacttgaacttgtcagatagctatggcaaagtaggtgttcccaggcaattggttatagagaaagatccttcgtctatctcagatgcagtggataaagctggtctttcactacctcttgtggcaaagcctttggttgcaaagtcacatgagttgtctttggcctacgatatggtctctcttcagaagcttgaaccaccgcttgttctgcaggagtttatcaatcatggaggtgtactttttaaggtttttattgttggggaagccgttaaggttgtcaggcgtttcagcttaccagatgttagcaaactcgagctgtccaacaatgctggggttttccatttccctagggtttcgtgtgttgcagcatctgcagaagaagctgatttagatcctagtgttggtgagcttcctccgcggccattacttgagaggcttgctaaggaacttcgtcgtagactgggtctcaggctctttaacttggatataattcgagaacacgggactaaagaccgttattacgtaatagatatcaactatttccctggatacggtaaaatgccagaatacgagcacatatttacagattttctcctgagccttatgaagcagaaataacaagaaaatccatcctgtacataacttgtctatactatagaagagaagaagaggatattatccagtcagtacaagcaaggagagaactcatatacctgcagtgactaaaagctaatattagaaagacgcgggctgagaagcacgaacaaagttccatcaactgtctgaaatagcttctggctgaagcacacagttacagaattctagcaacaaagccttggctccaatttttgtttgtttgtttagaagttttggtcattttattccttaacaacaggagtttgagttcctagtaaatgttttgctggaaagt

SEQ ID NO: 161 - DNA, 3734 bp, Solanum lycopersicum
caacaatccaaaatgtcattcttcttctaaaattttcttgatttttctcccatagctgtagaaaagattgaatcttgatactaaaagaaaaatggggttgattgattctcaatctttatcatcatctccagtgaaaattacagttacttcatctcccactggtgggtgccatggtttaactagtccgattcggagacattcgttatcgacgaatcctaattcacctcttagtggaaaagggttgaggggttcttctggtggaaggtatctttctatgtctaaagagagtactgatgaatttgtagcttatactgttcatattccaccaaccccagataatcgtacggtggtggattctcagaatagtcctattggggttgggagcagtagaaaaagctatgggtatggaaatccgagtgatgggtatattaaagatacgatttttactgggggttttaattctgcaactaaagcacatgttaggaaaagctctgaggatgaacctatggtgatgaaatgtaaaacaatgtgtcaaatggaaggttgtgatgagaaaaaagctgaggagaagtgtgaatgtggatttgtgatttgtagagagtgttatttggattgtgtgggaattgatggagggtattgtcctggttgtaaagagtcttataaggggattagtgatgatgaaagcgatgaacccagatccgaagctaaggatcaagcgaatccgttgccttcgaggggaagaggagggagaatggagaagaatttttcacttgtgcagtcattcaagaatccaaatcaagattttgatcatacaagatggctttttgagactaaagggacttatggttatgggaatgctttgtggccttctgatggtcatgaatttgggagaggtattgatagatctgaaaatcctccagattttagtgacagaagaaataggcctttgacaaggaaagttggaatctcagctgcaattatcagtccatataggttgctcatggttcttcgtcttggtgcgttggcttgtttcttgacatggaggatttctcatccaaatcatgatgcactgtggttatggataatgtcagtagtgtgtgaggtttggtttgcaatatcttggcttcttgatcagctgccaaaactctgccctgttaaaagaattactgacctctctgtattgaaagaaagatttgagagttcaggaccaaaccttcgaaacccgaagggattgtctgatttgccaggcattgatgtgtttgtttcaactgctgatgcagaaaaagaaccaccccttgtaactgcaaacacaatcctttccattcttgctgttgattatcctgttgaaaaggtggcatgttacttgtcagatgatggaggttccttagtgacatttgaggctcttgcagaagctgctagctttgcaagaatatgggttcccttctgtaaaaaacataagatagaacccagaaatcctgagtcatactttgggcaaaagcgcgatccactgaaaaacaaagtgaagctggactttgttagggacagaagaagggtgaagagggaatatgatgaattcaaggtgaggataaatgccttgcctgagtcaataaggcgaagatcagatgcttataacacccaacaggagttgagggctaaacgaaaacaggttgaacttggagaggatctttctgaacccatcaaggtccctaaagctacttggatgtctgatggaactcactggcatggtacttggtcatcagctgaggaaggacattcaagaggtgatcatgagggtattatacagatcatgttggttcctccaaatgcagagccactttatgggaatgaagtagacgagaaaaacatgattgacacaacagttgttgatgtcagattgccaatgctggtttatgtttccagagaaaagaggcctggttttgatcacaacaagaaagctggagcgatgaatgctttagttcgagccagtgcaataatgtcaaatggcgcattcattctcaatcttgattgtgaccattacatctacaactcattggctatgagagagggaatgtgctttatgcttgacaaagggggtgacaggatctgttatgttcagttccctcagaggtttgagggtgttgatccaaatgatcgatatgcaaaccacaatacagttttctttgatgttggcatgagagcactggatggtttgcagggtcccatgtatgtaggaacaggctgcattttccgaagaattgctctctatggttttagtccaccaagagcaactgaacatcgtggatggtttggtagcaggaagactagaaagcttttgaggaaacctaatatacaaaaggatcaagaggatgatgagatgtttttaccaatgattgggaataaagatgatgaggaggaagtaagcagatctttgcttacaaaacagtttggaaactccattccgttggtggactctattgctgtagctgaatttggagggaggctgctccatgagttgagaggcaaaggttgccaaggaaggccagcaggttcacttgctgttcatcgcgagccattggatgcttcagcacttgctgaggctgtaggtgtcataagttgctattatgaagacaaaactgaatggggcaatagagtaggatggatatatggttcgatcacggaagatgttgtgacaggttacaggatgcacaatagaggctggagatcaatttactgtgtcacaaaaagagatgcatttagagggacagcaccaatcaatctaactgataggctcatccaagttctcagatgggcaacaggttcagtcgaaatcttcttctctcgcaacaacgcactctttgcaagcccaagaatgaagttcctgcagagggtggcgtatttcaacgtggggatgtatccgtttacttccattttcctccttgtctattgtctcttgcctgcactttcactcttctcagggaagttcattgtgcagtccctcaatgtcaccttcttggtgttcttgctagcaatcacaatcaccctatccatgcttgcactccttgaaatcaaatggtcaggaatcacgcttcatgattggtggaggaatgagcaattctggttaattggtggaacaagtgcacatccagctgctgtgatacaaggactactgaaagtcatagcaggagttgacatctcattcacattgacatcaaaatctgctacacctgatgatggtgaagacgaatttgcagagctatacgagttccgttggacagtcctaatgattccaccaatcacaatcatattgatcaacatgattgcaatagcagtaggcacattcaggacagtatatagtcctttcccacaatggagcaagctacttggaggtgtattcttcagtttttgggtgttatctcatctctatccgtttgcgaaagggctaatggggaaaaggggaaagattcccaccattgtcttcttatggtctgctctcatctgcattgtcatttcattgctcgcggtttacgtatatcctccttcaggacatcaagatttctcaagttttcagtttccttgagttgtgttgctccatctcggcagctcagttaaggtctctcatacacattgttaaaaaagagtatgaaggttctcatctcattgtttagtagtagtagtgttctttttttctttctattaagagatgtatttacattgtgaaagtttattcaccaaat

SEQ ID NO: 162 - DNA, 2394 bp, Solanum lycopersicum
aaaaccctgtccaaattagaaccagccgcttctaacaaacaatttcaccgtgccgctgccggctgccatcaccgatcgccgtccggcgaaactcagaaaaaggcattactttgtctgccaattgaattacaatggcgtaccaagggggaaacttgaagtccactgccataaatggagtgaagatgtatactgttgctggccaacaccgttctgtggctacatggcttcctccgaagaagctcagagctcttcgtaaagatccaggttatatgcaaagagtggatctgattcaagatttgaaatttgaaactgcaacaacacgtattaaagtgactcctgatggggagtatctaattgcatcaggtatttacccaccacaagtaaaagtgtatgagctgcgggagctgtcgttgaagtttgaaaggcatttggtgtcagagattgttaactttcaagtcttgggtgatgactactcaaaaatagcatttctctgtgctgatcgttctgtttgcctccatgcaaaatatgggagtcactataaattgcggattccaaggatgggaagggatattatatatgatagctggtcttgtgatttgctttgtgctgcctcatcaccagatctgtacagaataaatttagagcagggacgctttctttcctcactgtgcacacggtccccagcacttaatgtggtttcacggagcaaggtccatgggctagttgcttgtggaggggaggacggtgcgctcgaatgctttgatatgagagtaagatcttcagttggtaggataaatgctgttgcacctgctgggggtggggaccaggaggttactgcaatagagttcgagggagatggaggttacctcatggctgttggaagtagtgacggaaaggttctggtttatgatttgcgttcttctcaacctatgcggataaaggatcatatgtatgggagcccaatattaaacattaagtggcataaaacgctcaacactgaacgaacaaagttaataactgctgacagccacattgttagggtttgggaccccgagacgggagaaggcatgacgagcattgaaccgactggtgggagaatcaacgatttgtgtgcattcactggcagtggattgatgttgttggctcttgactctagccaaataccttcatatttcataccttctctgggacctgcgccaaagtggtgttcttaccttgaaaacctaacggaagagcttgaggagcaaccccaaacaactatttatgacgattataaatttctgacaaaggaagatctggaaaagttgaatttgaccaatttgattggaaccaatcttctaagagcttatatgcatggttacttcattgattatcgtctgtataaaaaggcacacgcagcgtcaaatccgtttgcttatgacgagtatattgagcagcggaagaaggaaaaattcgaaaaagagcgtgatagtcgtatcacgattaagaggaggcttcccaaagttaatcgcactctggttgaacaacttcttgagaatgaggaagctgagaatgtgaaggaggatgttgatgacgttgatgcgaagaagacatcaaagaagaagaaaggactgaccatggacgttcttgaagatgaacgtttcaaacgcatcattgaaaataaggactttgaaattgaagaagattctcatgagtatcgggcattgcaccctatgccttccttaaaacgaccatctttagtggaagaacattttgagcctgtgatggaaggtgaggaggctagtgattctgatgcacaatcatcagaagatgaacaagaaaatgacaggaatacaagaaagaaggccagagttccgagaatgtatgaagtcaaggatgataggcatgcagaagcattctcaaaccatatttcacttgcaaaagaggatgctctttcactaggtgaaagggttgcagggttgtcaaatggcagagcttctcatgatatgaacaatattaaggttggtcccggaggttcgagagaagtttcattcttttccaggagctcagccaagtatgtggaagatgatggagagaaggaaacacgaaccgaaaagagaagaggggtccagtccttaaaactgaagcctgagagatcaggttttcaggggtcaggttctcgagggcgggggagaggaggaagaggtcgtggaatgggcagaggaagaggtagaggtagaggaagagggagaggatgattttttttttcatattaacaatttgtgtcaaagggatgttatttatttttttcttgatggtgtatttttattagtaattagtttctcgacacgtgtgttgtacaatataaatcgatcatcaaacattaaatcaaaaagttcaaacaaaattgtttgc

SEQ ID NO: 163 - DNA, 859 bp, Solanum lycopersicum
cactaattaacttaattatcatttaatacataatttttggtacctctagtgttgtgtacctatggctagtgaacctgcaaaggttgttcccccaaccgaagctccggtggtggagcctgaaaaggcggctccaccacctacaacttggcccactgactactttgcggtggctgatgtggtgttaaggttgttagtgtttgcttcggcggttgtgtctgtggtggtcatgtcaactagtaaggaaactaaaatgctcccaaaccctcgtcctgctaagttcactcactcaccggcactcatctattttgtagcagcactctctgtggctggtttcttcagcctaattactacactaggctcattgtactccctcatcaagcctggttgctgtgcaaagatcatttcccacttcattgtcattgatgtacttttgctaggaatagtggcatcagcaacaggagcagcaggatcggtgacttacgtgggactaaaaggcaacactcatgtgaggtggggaaaggtttgcacactgtatggaaagttttgcagatacgtaggagcttctataggagtctcattgttcgcgagtgttatgcttgtgctacttgttctcctctctgtatactccctttctaagaagatccccaagtgacaagacagatgaaaagtgaattcttcatgtatagcagaacaacccttggtaaatgtcagtatgtgaaagtgtgtgtgtatgtgttgttcaaatttgggtaatgtttggccattttcttgtgcagctggtgaaagtagacattgtaccagttcttgtatatgaattcattgatgtacttgtattgatattaaacagaaaattctctat

SEQ ID NO: 164 - DNA, 5290 bp, Solanum lycopersicum
gcagtcttttgatcagttgtcgggtcactctgttcttctgtgcagactttttttcttctctttttccaatgcaaaaacggggttcatacccggtgttccaatcgggacatgggtttcaccggaattcgccggaattttcgaaacgaagaataccaaatttcacaatccaactccgggcaacaccggtgaactggaaactgaactggcaacatctgaacagcttgataacaaaattacccttcaccccagaaaacccatcagttgtagactcaagttatatcgtaggaaccctatcgtatgttgaatggtgtcaaacattagaagttatggtgaagttatgggagttaaggttaagtggtgagcattgttttaacccaattttaaaagcaaaagttgaacttccatctgataaagaagaattgaatgagagaatagaaggggttttcttggagaaactgaataggttaatcaatggtgttttagtacaaaaatggcagaaaaaattgggttttgtgattgatgagattgggaaaatttctttgttgttgaagaaaccaaacaggattggtgtttaccaggagctatgtaagaaaaaaaagggtattgaaggtgaaagagatttgatattatcaaggattgatgaatacaagaatgggattaaatgtatcattgataatttggaggattcaaagaattatgaggatgttaaagtgtttgattttggtgaagggattgattggaatagaattcactttatcatgatgagagaatgtagaaggcttgatgatggattaccaatttatggttttaggcagcagattcttcaacaaattctttctcatcaggtgactgttttggttggggagactggatcaggaaagagtacacaattagtgcaattccttgctgattcaggaatagctggcgatggttctatagtttgtactcagcctcgaaaacttgctgccaactctttagcaagtagggttagagaggaaagccaggggtgctatgatgattgttcgatctcctgtaatccaccacattcatccgatcagcagttggattcaaaggtgatttttatgacagatcactgcctattacagcactatatgggcgacaagaatttgtccaacatttcatgcatcatagtcgatgaggcacatgaaagaagccttaacaccgatcttcttttagcgttgattaagaaactacttcatcagaggtttgatctgaggcttattattatgtctgctacagttgatgcaaaccagcttgcaggctacttctttggttgtggaactttccatgtggctggtaggacttttccggttgatataaagtatgtaccctgtgaagataacgcccattatgctgtaggtgcaattgcctcttatgtccacgatgttatcaagatggtgactgagattgatagaactgagggagtgggggctattttagccttcttgacatctcagagtgaagttgagtgggcttgtgagcagtttaaagcaccactcgccattgctttacctttgcatggcaagttatcctatgatgaccaaaaccgagtgtttctctcctatccagggaagagaaaggttatattcaccaccaatctagctgagacatcactgacaatccctggtgtcaaatatgttgttgattctggcatggttaaagaaagcaggtttgaacctggctctggcatgaatgttctcaggatatgcagtgtgagccaaagttctgctaaccaaagagccggtcgtgcagggagaactgaacctggaaagtgtttcaggctgtactctcaaagtgattttgaggatatgcctcgtcatcaggaacctgaaattcggaaagttcatcttggtgttgcagtgctgaggattcttgctttaggtatcaagaatgtgcaggattttgactttattgatgcaccgagccccaaagctattgagatggccaccagaaatctggttcaactaggagctgttacacaaagagatgatgcatcatatgaattaactgaaggaggactaaaactggtgaagttgggtattgaacctcggttgggaaaaatgatccttagttgctttgatcaacgtttgggtaaagaaggtgttgtgcttgcagccgttatggcaaattccagcagcattttctgtagggttggttctgaaggagacaagcttaaatctgattgccacaaggtgcaattttgccatccaagtggggacctctttactttactatctgtttacagggaatgggagattgtgcctagggaaaagaagaatagctggtgttgggataatagtatcaatgctaaatccatgagaagatgccatgagacagtgctggaaatggaagcctgtcttcagaatgatctcaatatgatcttagccagttactggtgctggcatcctcaagtgcataacaagtgtgacgaagtattgcaaagtataattctttcttcacttgcggaaaatgttgctgtgtactcaggttatgatcagcttggttatgaggttgcactaactgggaagtgtgtccaactacatccttcctgttcgcttttgaattttggccaacgaccacgttgggtagtctttggggatgtccttgcatcagctaacgagtatctggtctgtgttactgcatttgagtttagttctcttgttagcctcactcctgctcctttgtttgattttctgaagatggatgcacgaaagttagaaaaaaaggttttgacaggctttggagtcttgctactcaaaagattttgtgggaaatttaacagtagcattaataatcttgtctcgcgcattagaacttcttgtaaggatgaaagaataggcattcaagttaatgttgatgagaatgaggttcttttatatgcttcttcgagagatatggagtgtgttacactccaggtaaatgatgctctagagtatgaaagtaagctgttgcggaacgaatgcttagagaaatgtctattcaatggaggatcggcctctgttgctctctttggagctggagctgtgataaagcatttggagcttgagaagagatgtttgactgtggacatatttccttcaaatggaaatgccattgatgacaaggaattgctgatgtgtttggagagagcaacatctggtaatatttgtatggtgcacaagtactataatatgggccaggacaaagtggagaacaagtggggcacagtaaaatttcttacccctgatgctgcagaacaggctacatccttaaataaagtggaatttaatggtggctttctgaaaatggttccatccaggagcataaattgtagtgatcaaaaaatgtttcgctcagttctcaaagctaaagtttcttggcctcgtaggtacagtaaaggagtaggctttctgagatgtgatcctatggatgttcctttaattttagatgacctctctgatcttatgattggtggaaatgtcatccgttgtgaggcaagcgataagaaccctaataacatagtcattgctagacttgataaggacatggctgagacagagatacttgaggtgttaagggcaacaacaaataggagagttctggatttcttcttggtgagaggagattctgtagaggatcctcccatagctacttgtgaagaagcacttcggaaagaaatatctcccttcatgcctaaaaaggttccatttgttaactctgttcgtgtccaggtgttccagccgaaactaactgagtatttcgcaaaagcaactataacatttgatggatctcttcatcttgaagcagccaaggccttggagcaaatcgacggcatggttttgcccggatgccttccctggcagaaaataagatgtgagcgactgtttcacagctctgtttcctgtcctgcagcagtttatcatgtcatcaggaaccagctggattttttacttgctagcctccgccaaagaaaggttggaaaatgcgagctacagagaaatgataacggttcctatacagttaggatatctgctactgccaccaaagttgtggcagatttgagaaggccactggagcaacttatgaaaggcaagattgtagatcacgtggacattactccgaaggttgttcgacttctgttctctcgggaaggaaacaacattatgaggacaattcaacgggagacaggaacctatatttattttgacaagcatagcttgcttgttagtatatttggttctttagacaacgttgatagggctcgacagagatttatcgattcccttctggcgctacatgaaaataaacaacttgaggtgcatcttcgtggaggacatttgcctcatgacctgatgaaaagagttgttcagacatttggaccagaccttagtgcgcttaaagaaaaggtgcctggggcagagttctctctgaacacaaagcgccattgcatctatatgaatggtacaaaagatatgaagcaaaatgttgaggacataatctctgaaattgctcaaagaagttttccaactcaaacgacaggagatgatgctgactgtcctgtttgcttgtgtggactggaggatccttataaacttgaagcttgctgccatctattctgtcggacatgcttgctagagcagtgcgagtctgcaatcaaaagccgggaaggtttccccatatgctgtcttcatcaaggttgtgcggaacccatattgcttgctgatttgaagtctttattgtcaattgagaagttggaagaacttttcagggcttctttgggggcttttgtggcagccaatgggagtacctaccgcttttgcccctcaccagactgcccttcagtttatcgcattgcagatcccgatatggttggtgcaccttttgcctgtggtgcatgctatgtggagacatgtacgagttgccacatggagtatcatccttacctctcatgtgagatgtaccagaaagttaaaaacgacccagattgctctctagaggaatggtccaaggggaaagagaacgtaaagaaatgtcccgtttgcagatgtacaattgagaaggtggatggctgcaatcatatcgagtgtaagtgtgggaatcatgtttgctgggtttgcttgcgcttctttgacaccagtgataattgctatgatcatttgaggtctgttcaccgatccattacatgagaaataggaaccgtagtttatgtaagcgtgttcatgtaacatatttgcaccgagcatgtaatcaagagctttttatgtctatacatatctatgtttgtgtcttc

SEQ ID NO: 165 - DNA, 1625 bp, Arabidopsis thaliana
gcacaagcacttagcagagcaaatgaagaagacgaagcacactgagaattcaccggccagagatcaccaataagtgttgtagtttccggttacttcgaataaccttcaatggagcttccgttactctcgtatgctagctccgcgtcgttttcacggacaggcttatgctcttcttcttcttcctcctcaactagtatctatgagtttccggagagaagacggagtttaaaattgagattcaatggtggagaaaggtcacgaagcgttatagcttccgctgaacggagcagtgaagggattgagaagacaacagacaccgtcggtggcggaggaggaggaggagcaggcagatttgctggtactgccatggaggttactacacttgatcgtggttttgctaactccaccaccgttgattttccgatctgggacaaaatcggcgccgtcgttagacttacttatggaatcggaatatatggagcaatggctgtagcaggaagatttatatgttcagtgactggaattgattcatctggtggatttgatccttctcttgatgcactacttgctggacttggctatgcaacaccaccaatcatggctcttctcttcatactcgacgatgaagttgtgaagctatcaccgcatgctcgggccattagagatgtggaagatgaagaactaagaagctttttcttcggaatgtccccatggcagtttatactcattgtcgcggccagttcaataggagaagagctcttttaccgtgttgctgtacagggtgctctgtctgatatattcttgaaaggaacacagttgatgacagattctagaggcatggcatctctgaccggagtgtttcctccatttgtcccatttgctgaagtctttgcagctgtaatcaccgcgactctcacaggctctctctactttcttgctgcgtctccaaaagacccgacatacatagttgccccggttttaaggtcacggcgagatgattttaagaagcttttgtcagcttggtatgagaagagacagatgaagaagatttactctccactccttgaaggactcttagccctctatctcggtattgaatgggttcagacggataatatattagcaccgatgatgacgcatggtatatactcggcggtcatattagggcatgggctgtggaaaattcacgatcaccggagaaggttacgccggagaatcgaacacattagatcggaggccacggataagttgatttaaatcaaatatagatggtttaattggttggggggtggatttgtgtgtatttttttggtatggggtcgtatagtgattagggaaattagctaggacctcttccaattaattagagagctacatgatacagtagataattaattacatatacgtacatatataatattccctaagaactaagaagtaacttttttctttctcctttttgcaacctttctgtggttatattgatccaacaacatatacaaaaatttgagcattatttggcgatggtacatgctttattgacgagatacgcgtgacaatgtccagtagtgcagtagcactgcaattacaataatttccattgggccttgtgctttgtgccctgc

SEQ ID NO: 166 - DNA, 2810 bp, Arabidopsis thaliana
acatgaaattagaaaaccagaaaaactgagccacaatgatgatacgatgatgatcctaaccgttggcgaggaatgagagactttgttattgtctttggctcctcctccgccataaccaatcctcaccatcaccaccgtcgctgttacgccacagcaccagagtccaaccggaaaactaaatccaattcttctttcaccaagctacttccgtcactaccgcagcaacattcaccttctcctgcttcagtctccgcgactcattctctctctagccacttctccaatgtcgtaagatggattccagatggctcgcttgagtattacgctgattttgcctcgaagctagctgaggatggtcgaattgaggacgtcgctctcatcgccgagactttggctgcagagtccggagctaatgtggctcgtttcgcttccatggttgattatgatctcttatcgaaagggatttcgtcgaatcttcgacaaggtaagattgagagcgtcgtttacactttgaagagaattgagaaggtaggaattgctccattggaccttgtcgatgattcgtctgtgaaattaatgaggaaacagtttcgagcaatggctaactctgtgcaagtggagaaagctattgatctaatggagatacttgccggtctcggattcaaaatcaaagagttggtggatccttttgatgttgtaaagagttgtgttgaaatttccaatcctcaattagctattagatacgcatgtcttttgccgcatacagagttattgctttgtagaattattcatggtttcggaaagaaaggagatatggtctctgttatgacagcatatgaagcctgcaaacagattttggatactcctaacatgtatatatgccgaacgatgatagatgtttgtggcctgtgtggtgattacgttaaatcgaggtacatatatgaggatcttctcaaagaaaacattaagccaaatatttatgttattaacagtctaatgaatgttaattcccatgatcttgggtacacactaaaagtatacaagaatatgcagatacttgatgttacagctgacatgacatcctacaacatactactgaaaacatgttgcctggctggacgggttgatcttgcccaggatatatacaaagaagcaaaacgaatggaatcttccggattgttgaagttggacgcctttacatattgtactattataaaggtttttgcagatgcaaagatgtggaaatgggcactcaaagtcaaagatgatatgaaatctgttggtgtaaccccaaatactcatacatggtcatcattaatcagtgcatgtgccaatgcaggtttagtagagcaggcaaatcacctatttgaagaaatgcttgcatctggctgcgagcctaattctcaatgtttcaacatcctactgcatgcttgcgttgaagcttgccagtatgacagagcttttcgtctttttcaatcttggaaaggaagctccgttaatgaatccttatatgcagatgacatagttagtaaaggtcgcacttccagcccaaatatattgaaaaataatggtcctgggtctttggtgaatcgcaattctaattcaccttatatccaagcttcaaagagattttgcttcaagccaacaactgctacatataatatactcttgaaagcctgtggtactgattactatcgaggaaaagaattgatggatgagatgaagagcctaggtctttcacctaatcaaataacatggtcgactttgattgatatgtgtggaggttcaggcgatgtagaaggtgctgtacggattttgagaactatgcattcggctggaaccagacctgatgttgttgcatacacaacagcaatcaagatttgtgcggaaaataaatgtttgaagttggcattttctttgtttgaggagatgaggagatatcagattaagccaaactgggtgacatataatacacttcttaaagcacgaagcaaatatggttctttacttgaagtgcggcaatgcttggctatatatcaggacatgcgaaatgcagggtacaaacctaacgatcactttctcaaggaacttattgaggagtggtgcgaaggagtcatacaggaaaacggtcagagccaagataaaataagcgaccaagaaggagataacgcagggagacctgtaagcctactcattgaaaaagtagctacacacatgcaagagagaacagctggaaaccttgcaattgaccttcaaggacttaccaagattgaggctcgacttgttgttctagcagttttgcgaatgatcaaggaagactatatgcgaggtgacgttgtaatagatgatgtgttgattatcataggaaccgatgaagcaaataccgtttcaggaaagcaagagattactgtgcaagaagcgctagtgaagcttctacgagatgaattgtctcttgtggttcttcctgctggacaaagaaatatcatacaggatgcacactgtgtagatgatgcagaccaagagaacactaagtcatttgttagtatatcctcaacgaggagacctgcgattctggagaggttgatggttacaaaggcgtctctgtatcagtggttgcagcgcagaaagtagctgcctccgactgttacattactaatcagtcatcattgtattttatgctaattcaaaccatatgcagaaaagaatggggaaagattgcatatcatctcaatgcccatcatattgtatacaatcttctaaataaacaaaagagttgtcttctaaataatcatctgacagctatctttcca

SEQ ID NO: 167 - DNA, 890 bp, Arabidopsis thaliana
tctctctttcaagtttcaacaaacaatatcaatggcgaattcagagtcctcctcctcaccagtaaacgaagaagagaacagccagagaatctcaacactccatcaccaaaccatgccttccgatttaactcaagacgaattcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaaccggaacaacaacaacaacaactcttctcaggttaggtaatgatgaaatttgggggaaagaaaaatgtttctaaattgggggagttttaatttttattttgatttgtaaaacgttttttttcttctcttgaattgtaatttccttgtttgattttatggttatgttttattttttaaaaaaaatcagtctcctggataattggaatggtcgagataggttaaatttaataaca

SEQ ID NO: 168 - DNA, 707 bp, Brassica juncea
gggggatctcttcccatgcgaaagacagccttaccgctccgaaccagaggcggaaacgccgcgggagcgagaatgtcagccacggcggcgggaagctacgcgatggctctcgcggacgtggcgaagaggaacgacacactggaactgacgagcgcagacgtcgagaagctcgagaaggtcttctccgatccgcaggtgctcaacttcttcgcgaatccaaccgtcgagctcgagaagaagcgtctcgtgatcgacgagatcgtgaaatcgtccgctctccagagccacacctccaacttcctcaacatcttggtcgacgcgaatcgtatcaacatagtgagggacatcgtgaaggagttcgagatggtgtacaacaagataacggacacgcagctggcggaggttagatcggtggtgaagctggagccgccgcagcttgctcagatcgccaaacaggttcagaagctgaccggggcgaagaacgtgagggtgaagacggtgcttgatccgagccttgtcgctgggtttacgattaggtacggtgactctgggtcgaagcttattgatatgagtgtgaagaagcagcttgaggatatcgctgctcagctagaactcggcgagattcagttagctgcatgagaaaattgtattgacaaccgcttctttttttacttgtgcaagttaattctttctctcttcttttctcc

SEQ ID NO: 169 - DNA, 538 bp, Brassica juncea
gggtgctctgtccgatatgttcttgagaggaacacaactgatgacagattctagaggcatggcatctctgaccggcgtatttcctccgtttgtaccatttgctcaagcatttgcagctgtgatcaccgcaacactcacaggctctctctactttcttgctgcttctccaaaagacccgatatacattgttgccccagtcctaagatcacgccgcgatgattttaagaagcttttgtcagcttggtacgagaagagacagatgaagaagatttactctcccctcctggagggactcttagctttctacctcggtattgaatgggttcagacggataacattttagcaccgatgatgacgcatggtatatactcgacggttatattagggcatgggctgtggaaaatacatgatcaccgtagaaggttacgtcggaggatcgaacggcttagatcggagaccgctgatgaatgaacggttttaaaatcatctatagattgtaactggttgtggggtggatttgtgtgtttttttttttca

SEQ ID NO: 170 - DNA, 623 bp, Brassica juncea
gggcattgtcgagtctgctaaaccatccagaggaattgagcaaggcgagagaagaaatcgacagtaaagttggtttcaacaggcttgtagaggaatcagacatctccagccttccctgtcttcagaacattgtgtcagaaacatttcgtctataccctgcgggacctttgatggtgcctcacgtcgcatcggaagactgtaaagtaggagggtatgatatgccacaaggcacaacattattggtgaatctgtgggctatgcacagagatcctcagctatgggatgatcccgagactttcaagccagagaggttcgagaaagaaggggaggctcataagctaatgacgttcgggttaggaagaagggcgtgtcctggatcaggactagcgcaacggctggtgagcttgactctggcgtcattaattcaatgttttgaatgggagaggattggagaagaaggggtggatatgactgaagctggaggagtcacaatgcataaagctaagcctctggtagccatgtgtagagcacgtacctttgttggtaaaatccttcaccagaacgcttgataaatgtatgttttattttttgataattctcgttttgttggagatcggaagagc

SEQ ID NO: 171 - DNA, 2972 bp, Brassica rapa
caagagacaaacagttaggtggataaagtagaaaacaaaaatgtagacaagtttgatggtttgatatttttgatttttagaaatgacaaaattaggatagtatctagacttgtataaagagatgaagcggggatgggagaagatggtaagcgaagtagaagcgaaaagaaaaaaatgttttgtaaagagtcgtcgtcgggtctccagaccctgagcatagcaaagagcctcagctctccgttccataaaccatcaccactcatcaaccccatttggacaggacgtcgagacaagctgtgtcgtccccgaaacctcggtggacgatgtaaggtcacggcatcacagtcaaatagtgaaccgaaaggtaacataatgaaagaaaaagttaaaaaaatcaaagtaaagggatatatacaggccgaagaagggacggtgctggagggcctacgttggtcgagaggtctcgatgacatttcagatattgccggcagatcactgctcgttgagcttatttccgccgagactgacaaccggacgctgatggagaaggatccggtagaagactatgcacaacgtgtatggttcgatggcgaatcccctgatgagaagtacgagtgcgagtttaacatgcctgaagactttggaaccgtgggagctataaggatacaaaaccagcaccatcgagacatattcatcaaggagagggagcttgagttacccagcgggtccgttacgttttcatgccactcatgggtggcccccaagtccgttgacccagccaagaggatattcttctccagcaagtcctacataccttccgcaaccccagagccccttaagaagctgcggaaggaggagctggagaccttgcaaggcaacaaccgcaagaaggttggtgaattcgagaaacacgaacgcgtttatgactatgacgtgtacaacgatgtgggtgaccctgacaaaaatgacgaactcgcccgtcctgtcattggaggcctctctcatccgtacccgagacggtgcaagactggtcgcaaatccagcaaaaaagacccctccacggagaaacgcgaaggggacttctatgtccctagagacgaggagttctccacaaccaagggaacggcattcacaggcaaggccatcttggcagctcttccatccgtgttcacacagctcgagtctattctgctggatcccaaatctcccttcccacacttcaagtcaatagaagatctctttgacgttggcatcaatcttcccaaggatgctggccttttacctatgctccccaaacttattaaagttctttctgaagctcaagatgatcttctccagtttgatccccctattcttcttaacaaggatagattttcatggatccgagacgacgaatttgctcgccagacacttgcaggccttaacccctattgcattcagctagttacggagtggccgttgcaaagcaaactagaccctgcggtttatggtgatcccaactcactcattacttgggaaattgtggaaaaggaaattagaggagtcatgtcagttgatgaggctctaaagaataagagattgttcatgttggattatcacgacttgctactaccgtatgtgaacaaagtgagggagttggatgacaccatgttatatgcttctcgaacactattcttcctcagcgatgatagcacactaagacctgttgccattgagttgactcgtcccccagatgtcaacaggccccaatggaagcaggtcttcacgccaggttatgatgctacctcctgctggctatggaaacttgctaagactcacgttgttgctcatgacgccggttatcatcagcttatttcccactggctgaggactcattgctgtatggagccatacataatagcggcaaacagacaattaagtgccatgcatcctatctataggcttttgcatccccacttccgctacaccatggagatcaaagcaagtgcacgccaaagtctcgtcaacgcaggtggaatcattgagacttgtttctggccaggcaagtattccttagagctaagttcagatgtctatggtaaactatggaggttcgacaaggaaggtttacctgcagacctcatcaacagggggctggctgtggaagatgagaaggcggaacatggggtgcgactgacgataccagactacccattcgcgaatgacggtctaatgctgtgggatgcactaaaggaatggatcacagactatgtgaatcactattatccagatgcaggactgatcacgtcggatgaggaactccaagcatggtggagtgaagtgaagaacatagggcatggagacaaaaaagacgaaccatggtggcctgagctcaaaacacaagatgacttgattggcgtggcgactacgattgcgtgggtggcttcaggtcaccatgcagctgtaaactttggacagtacgggtacggagggtacttccccaaccgaccaaccacaacaaggagaagaatgccagtggaagagcctacagaggaagagctaaaagagttctacgaggagccagagaaggtgttgctgaagacattcccgtcgcagaagcaggcgacgcaagtgatggtgactctggatctactatcgacccattcaccagacgaagagtacttgggagaagagccagaagcatcttggatcgatgaacctgtcatctttgctgcatatgaacgattcaagggcaggctccaatatctagaaggagtgatagatgagaggaacgtgaatgtttctctaaagaacagagctggcgcaggtgttgtcaagtacgagcttttgaagcccatctctgagcccggttgtaccggaatgggtgttccctacagtgtctctatctaatgcatctgaacatgtatttacttgctaaaatcattgatcaagtggtcagcaataaaaaataaaacaagtgaatttccttcggg

SEQ ID NO: 172 - DNA, 1583 bp, Brachypodium distachyon
tcaatggccaagatccagcccctcccagcctccgccggcgccgcctcgccctccgacgaggcggcctgcacgacgacgacgacgtacacggtgtggatgaagtcgctggtgttcaacgggaacggttgcacggtgtacggcgccgacggggccgtggccttccgcgtggacaactacggctgcaggggcggccgggaggcctgcttcttcatggaccgggccgggaaggccctcatagccgtccgccgcaggggcttcggcgccttccggcggtgggaggtcagccgctgctgccacggcgccgccggcgcagaggatgaagacgagaccgagacggcggcgccatggttcgcggtgcggcggggcaaaggcggcgcccccatggtggcgatgcacggcggcgcgggcccctgctacagggtggacgctgagggggggaagaaggagaagaagaataaggcggggtacagggtcgtcggcgccgtggacggcgcggtggcggccgaggtggcgaggaagacgacggcggctggggtcccgcttggagacgacgtgctctcgctgacagtgggccccggaacggatcgcttgcttgccttgggattggtggtcgtctccgccgccgccgccgacgcggtcgcctacgccgtcatcgtcctcaaccagcgcctcccccgcttcgcctccctgctctggacccgcgcgcagctgagggtgtgcgcggacgggggcgcgaaccggctgttcgacggcatgccggagctgcaccccggcgaggaccccgacgaggtccgcgcgaggtacaagcccgatgcaatcaaaggagatatggactctataagaccagaagtgaaggaattctattccaatttgggcgccaaaatagttgacgaatcacatgatcaggacaccactgacttgcacaaatgcatatcgttcatcaccagaaatccacctggccccgacaaggctaatctgtgcattcttgtccttggtgcacttggtggaaggttcgatcacgagatggggaacatcaatgtattatatcgcttctcaaacatcaagatcatcctcctgtcagacgagtccttgatctttctgctcccaaagacacacaatcatgagatccttgtcgatcaatcgatcgagggtcctcattgtggattgatccccatgggcatgccctcaagcagcagcaccaccactgggctacggtggaatttagataataccagcatgagttatggtgggctggtaagcacatcaaacatcgtggatgacaagaaagtaatggtgacttcagattctgatcttatctggacaatatcacttcgaaaccacacttaaattgtagtatatttgttccatcatggaccgtgctctaaattttggctcgtcaaatttgcgtcgatggattttacatttttaacccctctgtgatgatatcatcttcgactccactttccaattgataccagtaaacccgatccacgaatccattccacattgccaaaatgaggcatatatgttgtatggtttgagaaagttcattagttctttgcacatttatgtactacactttc

SEQ ID NO: 173 - DNA, 2047 bp, Brachypodium distachyon
accgcaattggccggatccctttacccccacgcagctccatggccagcggtgacccgttcgccgccgccggggacgtcaccggcgactcatcctcctccagtccaaccaccgcgcgtctgctggaagcactcgccgctctctcccaagtgttcgagtccggcgatcctgcctcctccggcgcagccaccgccgccgttgtagaaatattcggcggaagcgccgatgccgacgcgggaggcgatgccgcgcggcccgacacggctaacatggtctcagagcagctgctccgcgaggttcacgcgttcctctcgtgcccgtcctcgaaccagatggccatagacgccctctctctagagcttccgaaacctgtggcgaagttgggtgctaggatggggaattgccgggacattgccaagactatcattgagctcctcgtgtcaaattgcaacccaagagacatgctctccatcctctgtgaggcattagatacaccactagcatttaatgggtcagcatacttcgtccttatacttgatatgcttgcgagagtgcttattatgattcagaggagacatatcgagcaagtaaaggttgtacttcctgctgtccttcgagttatgcatgctattatatcagagtgtgatgaggaacatggaacaactgcggttgatctgttcaatgcagcactccaaatcggcaatgccattcaagaaatgtgcaaaacaatggttaaccacaagaaagaagagctatgtttgatacttggtctatactcccttcagaacatagcccttatatcagaaagcaaacatcagcatattctctctgcttgtggttcacttgttcttcagcatttcaaaattgttacattttgtggattcacctatttgggtcttttaactggtaatgaggtgacctcagccaccaacaaactctctaaagaagaagatgctgattttctgggctgcttctctttcaccgtggaaggcgcaagtcttctagctgtctggacctatatgcatgatgacatgtcaaaatatgctggggcagagttggaatctgcaattaaggaagttcaggacaactatatcaggaaatgggaagcaattaacatgtttagatatgtcttgtcctcagttaattacccatgggtaatcaaatcttatagtatagacttattgttgactctagttgatgaaaattgtattgaggaaaccaaggatcatgaagatttcctatattctactcaattttttgccacactcaaggccattgaaagcgtcatgatagctgccccagatccattgatgcggaagaaagcttttgctactttgaaaaaggttatttccgtggtgccatcctctcagagatttgatatcttacagtccctcataaagaatagtatgtttccctccttgactgcaattcacttggatctggtgaaaaacgaagttgtgagagagagtagtcgagctaaggacttgattgaatctgatcaatcacaagatgctggggattcaccacattgggcttctcaatcgcttgaattagtggagctgatcttgaggcctcctgaaggtggtcctccttgtcttcctgatcacagtgaacaggtattatctgctctgaaccttctcagattgatcctgataatagattcaagaggatccagatcactaaaactgttccgacaagagacgacacgaaaagtgtactcagagtggttgatcccactaagaccagttgttgcaggggttcagtcggaaatggagaaggacgacagcgagggtgcaaatcagatgatgtgcatgttaaatcctgttcaactggtgcttcaccgctgcattgagttggtggaggaaaagatgaaaggttcctaatgttttgaggtttcgctcatgttggtagtgttgagtcaatgagttgtgcaggaaatgatgtgttcaatcagcaggattcagaattgaacattactatcctgaattggatatggcatatagccgtccttctctgttattttatgctgaattgctgacccattgcttg

SEQ ID NO: 174 - DNA, 775 bp, Brassica napus
ctctctctctctggaactctcatcatcttatcatctcccgtaacaaaaccaaaatgttcctcttaaagacatggagatcaaccgctttcgggatttatggctatatgaatttcaccaagaatggtttcctagaccattcaaagaagttcaaacctgaagatatgcagatacaaatccaaggaaagaactgtgtggtcactggagctaactctggtattggttacgccgctgctgaaggtcttgcttcacgtggagcaactgtttacatggtgtgtcggaacaaggaaagaggagaagaggctctttctaagattcaaaactctacaggaaaccagaatgtctaccttgaagtttgtgatttgtcttctgttaatgatataaagtcatttgcttcgagttttgcttcaaaggatgttccggttcatgtgctggttaataacgccggtttgcttgagaacaaacgaacgactacacctgaaggattcgagttgaacttcgcggtgaatgtacttgggacatacacaatgacagagctgatgcttccactgttggagaaagcgtcgcctgactccaaagtcatcacggtctcctctggtggaatgtacacgtcgccacttacaacagatcttcagtttagtggtgaaaagttcgatggagtgttacaatatgcacggaataaaagaatccaggcggctctgacagaaaaatgggctgacaagcccaagaacataggcataggtttctactccctgcaccctgtctgggctgacacacc

SEQ ID NO: 175 - DNA, 972 bp, Brassica napus
ggtgaaggtgatcaaaggagacgtgtcttcctcagagatcagcctcttgaagaagctgaaccattccaacatcatccgtctctctggcttctgcatccgcgaaggagcctcgtaccttgtctacgagtactcggagaacggttcggttagcgattggcttcactcgtctaacaagaagaagagtctgacatggagacagcgagttgagatctgtcgggacatagctgaggcgttggactacttgcacaactacgtgacaccgcctcatatccacaagaacttggaatccaacaacgtgcttcttgactccaacttcaaagccaagatttcgaatttcggcgtagcgaggattcttgatgaaggtgatctcgatcttcagttgacaagacatgttgaaggaacacaaggctacttagctccggagtacgtcgagaacggagtcataactccgaagctggacgtgtttgcctttggagttgtggttcttgagcttctttcggggaaagaagcggtgacgacggtggataaggaggagaaggaagagatgttgttgtgtagagagataaacaatgtgcttggaggagagaatgtgagagagaagctgaaggagtttatggattcatctctaggggatgagtatcctttggagctggctttcaccatggctcagcttgctaagagctgtgtggcacctgatattaactcgcgaccgtctattgctcaggttctaaccacgctcttgatgatcgtctcgtcatctattgattgggagccttctcatgacctccttcatgattcgggatctcttggcaactagttattctatttttttttgttttgtttgtcaataattgagtatttagattttagattttgtgtaatatataagataaggaccatatggctataaaatctacgagcaaaataattaccacagtgttcaacaaaagcaatgagaagatttgaatgttt

SEQ ID NO: 176 - DNA, 1518 bp, Brassica napus
gcgtcgtcgaataggaggatgcctgagtatcttgagaggggtgtggatgtgaagtttacggatgttgcggggcttgggaagattcgtcttgagttggaggagattgttaagtttttcactcatggagagatgtataggaggagaggtgtcaagatcccaggtggtattctattatgtgggccacctggggtggggaagacgttactggcgaaagctgtggctggtgaagctggagtgaacttcttctctatatctgcttctcagtttgttgagatatacgttggtgttggtgcgtctcgtgtacgagcgttgtatcaggaagctagagacaatgctccatctgtggttttcattgatgagttggatgctgttggaagagagcgtgggttgataaagggatctggaggacaagaaagggatgccactcttaatcagctccttgtttctttagatggttttgaaggaagaggagaggtgataaccatcgcgtccacaaatagaccagacattctagatcctgcgcttgtgaggcctggaaggttcgaccgcaaaatcttcattcctaagcctggtcttatcggacgtatggagattctgcaggttcatgctcgtaagaagccgatggctgaagatttggactatatggcagttgctagcatgacagacggcatggttggagcagagcttgctaatatcgttgaaatcgcggctatcaatatgatgcgtgatggaagaactgagttaacaacagatgatttgcttcaagctgcacaaatagaagagagaggaatgttagacagaaaagataggagctctgagacgtggagacaagttgctataaacgaagctgctatggctgttgtggcagtgaactttcctgatctcaagaatatcgaatttctgacaatcaaccctagagctggtagagaattgggttatgtccgtgtgaagatggaccacatcaaattcaaagaaggcatgcttagccgacaatccctgttggatcacataactgttcagctagcacctcgtgctgcagatgaactatggtacggtgaggatcagttaagtaccatatgggctgaaacatcggataacgcaaggtcagctgctagatcactggttcttggtggtctctctgagaaacatcatggcttgaataacttctggatggctgatcgaatcaacgatattgatgtggaggcattgcggatattgaacatgtgttacgaccgtgctaaagagattctccaaaagaaccggacgctcatggacgaggtggtagataaactggttcagaagaaaagtctttcgaaacaagagttcttcactcttgttgagctctatggctctattaaaccaatgccaccaagcattcttgaactcaggaaaatcaaacggctccagctccaagaggccgtgatgaaacaggacatgactagtgcaaggaacagttgataagatgatttgtggcaaacgtagaccttgttgtaatcttagtggcatgtgaacgagctt

SEQ ID NO: 177 - DNA, 988 bp, Brassica napus
agagagagagcatcatttgaagttggtagtccaatggcggcagcaaaggcaggtctagtcccgtggattatcccatcatcctcggcggcgacttcttctccgctgttttcagctgctgttaagttgcccctgagagggaggaaagcagagaaggatgtatctgtctctgtcgccttcaatccttctggcaatttcgacatctcagccttcgactctcacgacgatacagataaagtggaacctccgatgcctccaacgagcggcagatacgaagtagtcatagacaacgactcaattcagcggcttgacttatcgccctttcagaccgccaccggcattacctcgccttcctcagctgatccaagagagtatctggatcggagcatcggattcacgatcaattacaggagagaagacgcaggggatccgcgtgagctttcggagtatccggacataaggctgtggttcgtgaggctggatgccacgtacccttggcttcctctccttctagactggagagccggagagcttgctcgttacgccgccatgctggtccctcaccagatgagcttgagaatgggtgttgttttcaatcccgaggccttggagctgttcgtcatgagcaaagtgtttgtcgtttatccatggctcaaacgtcacgctgtccccaagccccggctcaagacctccgacatggccaggatgctcggcttcggtatcggcgaccagctcttcgacttgatcgatcaatacgatcattatcaaacaaccaccgattctctttaggcccttgtttcctccctcccctttaactgtgtgcttcatctctcagaaaaaaataataattatgtaagaaccattctctagcagagatttaaatttaaaatctgtaaaagaagagagtaaaattctactacctagacgttaacttgagctacaagaaacgtcttggcggcagcgagtctctcaacaaacacatccttttgga

SEQ ID NO: 178 - DNA, 1306 bp, Brassica napus
gttcaagaattaataaaatcaaaaccaaacaaagttccagagaggttcataagagaagccaatgagagaggtgtcttagtgtctcataagactcaccttcatcatcatattcctgttgttgatctctctaaactgtcgaaacctcacactgatgatgattttctctttgagattcttaagctctcacaagcttgtgaagactggggatttttccaggttataaatcatgggattgaagtgggtgtggtggaagatatagagaaggtggcgaaggagttcttcgagatgccactggaggagaagaagaagtatccaatggagccagggaccgtacaaggttacggtcaagctttcatcttctctgaagatcagaagcttgattggtgcaacatgtttgctcttggtgttcatcctccttctattcgtaaccccaaactatggccttctaaaccggcccggttcagtgaaaatcttgaaggttactcaaaagagataaggaaattatgcaagaggttgttgaagtacatagcaataagcttggatctaaaggaagagagatttgaagaaatgtttggggaagcagtgcaagcagtaaggatgaactattacccaccatgttcacgtcctgatcttgtcatgggactcagcccacattctgatggaagtgctctcactgttcttcaacagagcaagaacagctgtgttgggcttcagatcctcaaggacaacacttgggtccctgtactacctcttccaaatgcccttgtcatcaacattggtgatacagttgaggtgctaactaatgggaagtacaagagtgtagagcatagagcagtgacaaatagagaaagggagaggcttacaatagtgacattctatgcacccaactacgaggttaaaatagaaccaatgggtgagttggttgatgatgaaaccaacccatgcaagtatagaagctacaatcatggtgactatagttatcactatgtctccaacaagctccaaggcaagaagtcacttgattttgccaagattctcaattaactatattactttcacacccctttcaccttccattaactaccacttaatttgttttatttttaagaatttagttgtgggactcttgtgtgtatgatgtacaggaatgtttcccacttaggggttttagtgtcatgattaaattccccagtgtaactacaacttgtaatatattatgtgtgtgtgtgggtggagttgggtgtgtttatgtatccatatgtatgccgagaaggaacataaagaataagaaagaacaatatcagat

SEQ ID NO: 179 - DNA, 609 bp, Medicago truncatula
tgttctttgcttttgtttctgaaaatatgtctagctgtggttgtggaagcagttgcaactgtggtgatagctgcaaatgcaacaagaggtctagtggattgaactatgccgaaggcgaaaccacagaaaccgtgattttgggcgttggtccggccaagatccaattcgaaggtgctgaaatgggtgtagcagctgaggatggtggctgcaagtgtggggatagctgcacatgtgacccttgcaactgcaaatgaagtgcatcatatgcctcttgaagcagagatatattggaaccaatatgtgtaattgtgtgtatattagtacacatttaatatataagaagcatgtgtttccttttttagaataatatgaggtggtcatggatctaaccttcatcaaattcaaatgttcttagattttgttgaaggtgttatgagagctatgatcgctttgtgtttggttgtcttgtataatgtataactaaaggctaatatgatcataaatctctgcgtattataaatgaaatgtattattgtgtgttgtttgaatagaattttttttattcatcaacatcgagttggcatatatcgacataagttggtccatttg

SEQ ID NO: 180 - DNA, 1309 bp, Medicago truncatula
caaaagttagccttttttttgttgttgaaggaaactaaaagttagccatttgttatgcttttcgacatttactatcttttattatttattgtcccctccttccatctctgaaaacaagaaccccttgaaaatttcttcaccatatctctatccaatggattcaagctctaacgaagtagtccttgatctctcacccatgattaaaatctacaaagacggtcacatagaaagactcataggatccgacatcgtacctccatcttttgatccaacaacaaacgtagaatccaaagacattctcatctcaaaagaccaaaacatatcagccagaatcttcattcccaaactcaacaacgatcaatttccaaaccaaaaactccctctccttgtttacttccatggtggtggtttctgcgtagaaacacctttctcaccaccataccacaatttcctcaacaccatcgtttcaaaagctaatgttattgctgtttcagttgattacagaagagccccagaacaccctcttcctatagcatacgaagattcatggacttccctcaaatgggtcgtttctcatttgcatggaaatggttctgatgaatggatcaaccgttatgcagattttggaaaaatgttctttgcaggagacagtgctggtgcaaacattgcaaatcacatggctattcgtgttggaactcaagggcttcaagggattaaccttgaagggattgttttggttcatacattcttttggggtgttgaaagggttggatctgaggctactgagaaatctgaacacttatctttggctgataatttatggaggtttgtttgtccaacaagttcgggatccgatgacccgtttttgaatccgggtaaggataagaatttggggaggttgggttgtaagagagttttggtttgtgttgctgagaatgattcgttgaaggatagaggttggtattataaggagttgcttgagaaaattggttatggtggtgttgtggaagtgattgagacaaaaggtgaaggacatgtttttcatctctttaatccaaattgcgataacgctatttctttgctcaatcaaattgcttcctttattaatcatagtggttaaccttaagcatgctgttatgcattgctaaatgctaattactattatgaatttatgattatgaataatgtaatgtaactctcgtgcatttgtggaatacctgttttcttggtctacactctactagtagtattctacttgcagttacaagattattaataatttgactttagcatctgcttattaataaat

SEQ ID NO: 181 - DNA, 1885 bp, Medicago truncatula
gaacttgaggaagaggctctgcgtcccccagatctttccaatctgcagaggaggattaaagagattgtccgtgttctttccaattttaaggcgttgagacaagatggggcgacgaggaaggattatgttgatcagcttaagactgatatacgttcatactatggctacaatgagtttctaatcggtgctttagtggagatgtttccagttgttgaactgatggaactgattgaagcctttgaaaagcctcgccctatatgtctgaggacgaacactttaaagacacgaagacgggatttggcagatgtcttgataaacagaggagtaaatctggatcctctcagcaaatggtcaaaagttggacttgttgtgtatgattctcaagtacctattggtgccactccagagtacatggctggtttttacatgcttcaaagtgctagttcttttctgcctgtgatggccttggctcctcaagaaaaggagcggattgttgatatggcggctgcacctggtggtaaaacaacttacatagctgctctaatgaagaactcaggaataatttttgcaaatgaaatgaaggtgccacgactaaaatctctgactgcaaatctgcataggatgggtgtatcgaacactgtagtctccaactatgatgggaaagagcttccaaaggttttgggtttcaattcggttgatagggtattattggatgccccttgcagtggaaccggggttatatccaaagatgagtcagtcaaaacttcaaagaacttggaagatataaagaaatgtgctcatctacagaaggagctccttcttgctgcaattgacatggttgattcttattcaaaatctgggggatacgttgtatattctacatgctcaatcatggttgctgagaatgaagcagttattgattatgtgctcaaaaggagggatgtaaagctggttccttgtggacttgactttggacgtccagggtttacaaagtttagggaacagcgttttcacccttcattagataagacaagacgtttctatccacacgtacacaatatggatgggttttttgttgcaaagttgaaaaaaatgagccacccaaaacctgctagaacatcagaaacatttgagaaggatgaaaaagaaaccgagcttgttatcgacgacgataaacctagtaatggcgttgaagaaaatggcaaacattcttttgaacttgaatccaagaagaggaagaaagataaattcccatcaaaaccaagtaatgatgtaaaagccaatgtcaaagaagcttctgaacctgaatccaagaagaggaagaaagataaattcccctcaaaaccaagtaatgatgtaaaagctaatgtcacagaaacttctgaacctaaacccaagagggtgaaaaggaaacctccatctagagaggagatttcaaaagccagagaggagaagagacttgctttaatagaaaagaagagaaaaagtggtaagcaacagagaggaaaaaatgatgaatgaccagtggcagtacaagtagtattgatgaccaactgtgcaattatagcgcagaattgacgcaaaactccatcaatatgggagtactgaggtgttgcatgtcgaaagaatgtaccctggagtcagtggcatgacctgatcgaaggtcccaattttgttttgttctgtttaagttatttagccatggcatttttaaacatagatctgtttattaagctgtaaaatcagaatggagaaaagctacttttaggcatgattaatttgaatttattttctaattcttgtcttcatgtctattgcccctctttatttgttatcctttgtaagaattattacacttgcgtttaatgatattataaaatttatg

SEQ ID NO: 182 - DNA, 1920 bp, Medicago truncatula
agctgtggacaatcctgaaatgtataatcagattgcaaaaccattttatttgaagacctcaatcagatttattattctgctttggggagaaaaatcaagccttgtcaatgaagcagacaaaggggtgccaatctatacattcatggaagtcataaattttgggcgtcaaagtcgcagggcattgcacacctccgatgatgctagtatgccacctgcaccttctctgtaatatacattcatacctattagtctttctcttaatcatcaaaaggaacagtaatcaggttcacaacaaactcatctacaatgtgattgcaggagaacactatatctttgaaacaataaaattggatgacattgctactcttgtgtacacaagtggtactactggaaatcctaaaggtgttatgctaacccatcagaatcttttgcatcagatcaaacacttatcggacgttgtacctactactgaagctggagataaatttctaagtatgttgcctccttggcatgcatatgaaagagcttgcgagtatttagttttctcacgtggtcttgaacatatatacactactgtaagaaacttgaaggatgatttgggacgttataaaccacatttaatggtttctgttcctttagtttttgaaactttatacagtgggatcatgaagcagatatctacaagctcacttgttagaaagcttgtcgctctcacattcataagggtcagcttaggatacatggagtgcaagcgaatttatgagggtaaatgtttaaccaagaatcagaaagcaccttcctatctctatgcaatgttggattggctatgggcaagaattatggctacaatattatatccagttcatatgctggcaaataaactggtctacagtaaaatccgttcaactattggaatatcaacggctgcaataagtggtggtggtagcttaccttctcatgttgataagttttttgaggctattggtttgaatttgcagaatggatatggtttaacagaaacttcaccggttattgctgctcgacgacttggttgtgacgtaattggatctgtggggtatccacttaagcatacagaattcaaagttgtcgattctgaaactggtgaagttcttccacctggttcaaagggaattttgaaagtcaggggcccacaattgatgaaggggtactacaagaatcctttagctacaaatcgggtcattgatagtgatggctggctaaatactggtgacataggttggattgctgcccaccattcaactggacggagtcgtaattctggtggtgtgattgttgttgaaggccgtgctaaagacaccattgtgctttcatcaggtgaaaatgttgaaccgggagagcttgaagaagctgccacgaggagtaacctcatacaacaaattgttgtcattggtcaggataaacgacgtctaggagctataattgttcctaacaaagaagaagtcttaaaggcagcaaaggaattgtcaattatagattccaatagttcagatgtcagtcaggaaaaagtgaccagtctaatatataatgaattaaggacctggacgtcagggtttccatttcaaattgggccaatccttctcgtaaatgatcccttcacgattgataatgggctaatgacacccacaatgaaagttcgaagggatagagttgtggctcaatacagggaccagatagagaatctatacaagtaaacttacctaatgtcaatggtatgttacaaatacttatagctcaacacaggatcaaatggagaacctatacaagtaaaattacctaatgccagtggcacaatagactcgtactaagtgataacagttataccatgaccacaatagttagattagtaataacattttatgatttctatagtgactcttg

SEQ ID NO: 183 - DNA, 1090 bp, Medicago truncatula
ttgctgtgttgtcgtcgtcagcggcggtagtgggaaaaatgtcgcggcggacgatggagtgggcggcgaagtcggaccaccttcacggcataccacgcaaagtcgtaatagcagcagtcggttccttcgcgaaaacagtttcatctctcatcaacacaaccttcgttcataacgccgacactctcctccgcctcgttcgttccagacccaaaggcatccccctcatcaccgtcagcaatcacatgtcaactttggatgatccggcgatgtggggatttaagggttttcctatctttgatactaagttagcgagatgggttcttgctgctgaagatatctgttttagaaatccactttattcatatgtttttcgcaccggaaaatgcatacctattacaagaggtggggggatttatcaaaagcacatgaatgaagcgcttgggcgcttaaatgatggagaatggctgcatacttttccagaaggaaaagttcatcaagacgatgcacctataaggcgattgaaatggggaactgctagtctaattgtccgtgcacctataactccgattgtattgccaattgttcatcatggttttcatgaggtgatgccagagaaatatatgtttggtagacggcctcctttaccattatgcaataagaagattaacataattattggcgatccaattgaatttgaccttccagcaatgagtgaaatggctattgcccagtctcggaatgattcattccctactattgggtggcccagaacttccgatggtttggatgaggcagctcaacgacatctgtacactacactttcagagaaaattcgtgttgccatggagaaattaagatgttatggtaaaagttttctgaagtcttaagttaaaccccacctaagccttttaagatgccacaaatttgttcattgtattgtatcattctttgtttagttgacggttgagtgagaactgtcaacctgggattcttaaagtcgagttagcaatataatatttaagttttgtagggccatggcccatagactaccctccatgtaatgcctaaaattagatagggtaatatttga

SEQ ID NO: 184 - DNA, 1731 bp, Medicago truncatula
cactgacatgtcacggataatattaattcctaccattatcatatcattcaaaaatcttatgccaccaattatctcccaaaaatgacttcttcctcttcttccaaatctcctcctttaatcccttcacgccattctccacaattcacaccaattcaagaggaacatgaatttgatgaatacagaagccaaagtagaagaacaacaccaacaagtgcttcaactccaaagcatcatcatcatccaccaacaccaatcaatatcaacaaaaacacaaaaccaaatcacaagaaaaaacgttctgaaactgaactagaagatggttctgtttcatgcaacaaatgcagaccacattctcgtgacaaaatctttatccttccctttgatcattccaacaacagcaacagtaacagcaagtattcatctttgttgcaaagtccaaatgggattttcaaatccattgtttcaaagctaacaagaaaaagtccaatgtcaacatcaacaacaaacaacaatgaagaacaatggaaaatggcagtggcagaactttctcacaaacttgttcatgccacaagaaaaagagatgaagctcttcaagaagcttcaaggctcatgaattcaatgtcagagttagagaaaaagttgaacaagcttgaaatttattgtcacactttgaaatctggtcttgaagaatgtaacattggttcttctaatgtcgttgctcagaagaattttcatcatcatgttcaagacaatgacaacgttgtacaacatttcttggtggctgtttctgaagcaagatcttcagtgagacttctaagtcgttcattaacaatgcaacttagacacacaggaagcaaagtgtatgaaaaagtttctttacttttacaaccttatgatataaaaatatctttttcaaagaatccaagaagtttgcttttttacttggaagcacttttgaacaagacattttttgaggattttgagtcaatagggtttcaaaagaatgcttgtaataggatattgaaccctatggaaaggtgtgaatcaagttttgcttcattcaacatgatacatgggttgacttgggatgaagttttgagcaaagggacaagacattttagtgaagattttagtagattttgtgatagaaaaatgagtgaaattgttgctatgttgggttggaatagggcttggtctgaaccactattgcaagctttctttgttgcttcaaagagtgtttggatggttcatttgttggctaattcagttcatccaagtttacaaatatttagagttgataaaggagtcaactttgattctgtttacatggaagatatgggtggggacaagtcttcaaggttggtaccaaacatggttaggattatggttgcacctggtttttatgtctatggtagtgctgttaaatgtaaggttctttgcaggtacttgaccaataacctcagcaacaacaaacaagacaaaggtttaaacccatcaccttaaataaacccattttattttttatttttaatgtggaattggaaagtgtactctatttggtttggaatttagaatttggatcaggttctattgttgttatgattcatggcttggttttttgttgttgatattttatagtatgtatttttcatgcttgagttgggatatgatatgtcggtatatggagtcaacgtgaacaatttggcattttatggttaccctttgttttat

SEQ ID NO: 185 - DNA, 1843 bp, Medicago truncatula
atggcggttcctccctccgccactccagcttctctttacgtcggcgatctccatcccgacctctccgactctcagcttcacgatgctttctccgatttcaaaactctcgcttctgttcgcatttgccgagactcttcctctggtaaatcactctgttatggttacgtcaacttcctctcccctcacgacgcaattcgtgccattgaggtgaagaatcattctacattgaatggaaaagctattagggtgatgtggtcacgtcgtgatcctgatgcaaggaaaagttgtatagggaacgtgtttgttaagaatttagctgaatcaatagataattctggattagaggatatgtttaagaagtttgggaatattttgtcaagtaaagttgtaatgtctgaggatgggaagagtaaaggatatggctttgttcaatttgaaacagaggaatctgcaaatgctgctattgagaggttgaatggatatcttgttggtgataagcaaatatatgttggaaagtttgtcaagaaaagtgaccgcatatcgtctggcccggatactagatatacaaacttgtacatgaagaatttggacttagatatttcagaaacacttctgcgtgaaaagttttcctcttttgggaaaatcattagcttggctgttgcaaaggacagcaatggtatgtcaaagggttttggcttcgtgaacttcgataacccagaagatgctaaaagggcaatggaaacaatgaatggattgcaactaggttcaaagattctgtatgtagccagggcacagaagaaggctgagcgtgagcagatcttgcaccagcaatttgaagagaaacgaaaggaacaagtcttgaaatataaggggtcaaacatttatgtgaagaatattgatgacaatgttagtgatgaaggactgagagatcactttagtgtatgtggcactataacttctgcaaagattatgcgagatgacaaagggataagcaaaggatttggttttgtgtgcttctccactcctgaggaggctaataaagctgtgaactcttttcatggattcatgttccatggtaaaccgctatatgtttctcttgctcagcggaaagaggacagacaggcacagttgcagctccaatatgcccagcaaattgcaggactcgctgggccttcaactgccattgtccctggtggatatcctcctttctactacacagctactggtgttgtttcacacgcgcctcctcgtgctgggctcgtgtatcagcctatggcattgaggcctggatggagggctaatggctctgcacctcctgccagatcattccaacagtcacctacgcctgttgtttctaacaataatactaggcagcataggcaaaataggggtaggatgaatggccatgcagtatcacagggaaatactcactctggtacatatatgccacaagcccagcaggcttctcagtcagcgatctcttcaagagagtcaagtactcagcagagaactgggcaagctaagtatgtacctagtgggcgccaccgtgagatggaaaaaggatctggattatcatctagtggaggatccttgggaccagaagtgctgcatagcatgcttgctaatgctactccagagcagcagaaggagatacttggcgaacatctatacatgcttgtccagaaaatcaagcctaacctagcagcaaagattactgggatgcttttggagatggacaatgtggaagaagctttccaagtgctgaagaactctaaagctaaagtttctggtcaggatgtacttcattcaaatttcctttcagctgaggttgctgtgaactaag

SEQ ID NO: 186 - DNA, 1680 bp, Oryza sativa
accagtccactcacgcggtcactctcctccagttgtccagtctccgctcgctatatccgctcccgcgcgactcactcaacccagtacacacactccacctaatcttcttctcctcacacattcacacacacacaccccgcagaccccggcaccttaccgagcggcggctcagcacgctgctgctacgcacatggacaagagccagggagtcctactgtccagcaacgtcggggccggctcccggccgtggccggagctgctcggctccgcccactgggacggcctcctcgacccgctcgacctcacgctgcgccgcctcatcctgctctgcggcgacctctgccaggtcacctacgactccttcaactccgactcccactccaagtactgcggcacctgccgcttctccaggtccacgctcctcgaccgcacgcagttcccggccgccggcgacctctccgtcgccgcctacctctacgccacctccgacgccacggcgttcccggggagcatggtgtactcgatgtcgcgcgaggcgtggagcaaggagtccaactggatcggctacgtcgccgtgtccaacgacgccgcagcggccgcctcgggccagcgcgtcatctacgtcgcgtggcgcggcaccatccggtcgctggagtgggtcgacgtgctcaagccggacctggtcgaccacgacgacatcctccccgaggggcacccggggcgcggccggtcgcgcgtcatgaaggggtggtacctcatctacagctccaccgacgagcgctcccctttctccaagtacagcgcccgcgaccagatgctcgccgccgtgcgcgagctggtggcgaggtacaggaacgagagcctcggcgtcgtctgcacggggcacagcctcggcgcgtcgctcgccacgctctgcgcgttcgatatcgtcgtcaacggcgtgtccaaggtcggcgacggcgcgcacatcccggtgaccgccgtggtgttcgggagcccgcagatcgggaacccggagttcaagaagcagttcgaggagcagcccaacctgcgggcgctgcacgtcaggaacatgcccgacctcatcccgctctacccgagcggcctcctcggctacgccaacgtcggcaaaaccctccaggtcgactccaagaagtcgccctacgtgaagcgagacaccagcccaggcgactaccacaacctgcaggggatcctacacacggtggccggctggaacgggaaggacggcgagttcaagctccaggtgaagcgcagcgtcgcgctggtgaacaagtcgagcggcttcctcaaggacagcaaccttgtgccggagtcatggtgggtggagaggaacaaaggcatggtgctcggccagaacggggaatggcagctcgaggggcccgcagaggagaacctgcccgtgccaccggtggtgaccgggaagatcatcgacgacgacgtcgctgccgtggccacctccagcagtgccaaggaggataagaagacgggcaaagggtctaagcttctgtctggattgattgatcaactgctttgtgtgcctgatacatgtaaagccggagctgcgtgagttgttgaagaccacatcagaaaaagactcgagagcggtggcgtcgaactgatatgcttgtgaagtagctggagcttgggagttgggagcga

SEQ ID NO: 187 - DNA, 1718 bp, Oryza sativa
cgcccgtccgttcgattcgacgacaccttcatttttattttcttccttgtgtaataagaagacgactagtggtaacaaaaagattcgctccctacgcgacgccccgaccccgattcccttcgcttcctactccttcctcttccttgttccttccttccttcctcaccccacgaacgcgcacaccaacctttcccatccctagctgctgcccttccatcggatccacggatcgagacctggcacggcggcggaggacgggccggcggagatggaggtggaccacgcggaccgcgacggcgcgcggcgccggtgccgcgagtacctgctcgcgctcgaggaggagcgccgcaagatccaggtgttccagcgggagctccctctctgcttcgacctcgtcacccagactatcgaggggatgaggagccagatggacgccgccggcagcgaggagacggtcagcgaccagggcccgccgccggtgctcgaggagttcatcccgctcaagcccagcctctcgctgtcctcctccgaggaggagagcacccacgccgacgccgccaagtcaggcaagaaggaggaggccgagacgtcggagaggcattcgtcgccgccgccgccgccgccggaggccaagaaggtgacgccggattggctccagtccgtgcagctctggagccaagaagaaccccagcagccatcgtctcctagcccaactcctaccaaggatttaccgtgcaagccggtggcgctgaacgccaggaaggccggcggagcgttccagccgttcgagaaggagaagcgcgccgagctgccggcgtcgtcgaccacggccgcggcgagctcgaccgtggtcggagacagcggcgacaagcccaccgatgatgacacggagaaacacatggagacggacaaggacaacgacaaggacgccaaggacaaggacaaggaaggccagtcgcagcctcaccggaagcctcgccggtgctgggcgccggagctccaccgccgcttcctgcaagcgctgcagcagctgggcgggtcccatgtagcgacgcccaagcagatccgggagctgatgaaggtggatggcctcaccaacgacgaggtcaagagccatttgcagaagtatcgtctacacacgaggaggccgagctcgacggggcagagcagcgccgcagccggcgtccccgccccgcctgcgccgcagttcgtcgtcgtcgggagcatctgggtacccccgccggaatacgctgccgcggccgccgcacagcagcacgtgcagcttgccgccgccggcaataatgcgtccgggagcgccaaccccgtgtacgctccggtggcgatgctgccggcaggcttgcagccgcattcgcatcggaagcagcaccagcagcagcagcaaggacagagacattccgggtcggaaggccggcggagcggggacgccggcgatggcagctcgtcctccccggccgtctcgtcgtcgtcgcagaccacctccgcttgattagtgtagattcgtcgattacatcattatatgtacgtagtacgagagtgcatcacatcaaagtgcagcttgattttggagctagctagcttaaattaagggttaattactgattgcttcgtgatcgcacacaccacatttgctgttttgtttgtaaaaaagataataaaatacataaatattaaggaaactccatagacattattctccc

SEQ ID NO: 188 - DNA, 1242 bp, Oryza sativa
gagaattgttagatttaggtctcccccatatccccattcccatctctctctctcgagtctcgacggcggctgctgctgcggcgtcgcctgcggtgcgatgtcgtcgtctccggcgcatgctcagcgcttctactgccaccagtgcgaccgcaccgtccccatcccgccgcccacctcccccgacgccgacgtcctctgcccgttctgcggtggaggcttcgtcgaggagcttggggaggacatcaaccccaaccccaaccccaaccctagccccttcctgccacaccaccccttcttccccttcgcctccccatccttcgacctccgcaaccctagcgacctcgcggccttcttcgggcccccctccccctccccctccccctccccagccgccaggcacttcgacccctccaacttcctccatgatcacttcaccggcctcctctctggcggcgccaccatccagatcgtcctcgagggctcctccgcctccctccccctcgggggcgccgccgccgggcccggggggatcagcctcggcgactacttcgtcggctctggcctcgagcagctcatccagcagctcgccgagaacgaccccaaccgctacggcacccctcctgccgccaagtccgccgtcgccgcgctccctgacgtcgccgtctccgccgacatgatggccgccgatggaggggcccagtgcgccgtctgcatggacgacttccacctcggagctgccgccaagcagctcccctgcaaacacgtcttccacaaggattgcatcctcccctggctcgaccttcacagctcctgccccgtttgccgcttcgagcttcccaccgatgaccctcaccacgcccacccaacccttggatctcaccgccccgccgcacccgcctctgcctctgcctctccctctccagctccaccacctaggctggctgagagaaggttcaggatatcgctgccatggcctctccgtgctgcgtttggcggccaggcggagagcagcaatcctaccaatcaggatcctgttggtggttctactgatgcttccggttctggcaacaacaatgcaactggaggtcatcgtggctacgatgatcttgactgaagagcatcggacaaagaggggatgaggaggggcgagggacattgtttggagaagaggtgcgccgcggcaatgaagctagcctattccgttctattcacctatcaatgacgagaagaaatgttggattt

SEQ ID NO: 189 - DNA, 1280 bp, Sorghum bicolor
ggcgacgggcgaacaaggacgcagccgggattggaccccccccatcgacgggggcagcccgcagcccatcggtttcgccgaccggcgcctcgttcgtatcgactccactcctccgccgccgcccgctataaactggactaggcccgtggatgcggcaccgcctgctccgccgcgcgatgccgatccctccgccgccgcaatctccccggacgccgggggtcgccggcgggcgtctcttcgcttcgctcccgctgccgccgccgctccagtctcgaagagaggtgcatgtttggtatcttttgcctgatgagttgaatgatgcctccctactgaagatgtacacggagctcctttccccttctgaaaggaagactgctttgtcaatgaacggggaaaagttgcagaaaggtgctgtgctgtcccgtgcactggtgcgcaccaccctctcgagatatacagattgtaaagttgatccaagatcatttgagtttaagaaaaacaagtttggcaaacctgagatactgtggcaatctgatgacagcaggatggaatggcctttgcatttcaatatttcacacacatcttctttgattgcctgtggcataaccatggatgctcctattggcattgatgttgaagacaagaaacgaaagacagccaagaatattctatctcttgctcgccgttatttcaccccatctgaaattgattatctagctaaaattccagatcctgatggtcagcaaaaggagttcataaaactatggactcttaaagaagcatatgtaaaagctctcggaagggggttttcaggcgctcctttcaacaaattctcgatcatcttggcagcaaataacagaatcaaaatttctgtggcaccaaaagcattcaatgattctgactctagctgtgactgtctgtccgagaattggcaatttgcagttgctgagctaaatagttctcattacatggcaatctgtacagaggatgactcaacaagttcagattctggaaacggcagactgccactaggattgaaagtatggaagaccattccattcgttgaagatatacttgtttcgggaacagaagctgtaaaacttgtcagttgagtatgtgagaggatctgctattggtctattaatgatttcaccagatgacacattgtggtgcaacgaatatatttggacaaagtatgcatggagactgaacattcttggagcatatattcatcaactgaccactgacactgtgctctaattaagccttgggaaatgcaa

SEQ ID NO: 190 - DNA, 519 bp, Sorghum bicolor
cgatcgaccgccagggagcaagaggccggcccggccacccacccatagcctgcctggtagccatggaccggtccaagtcgtacgcgggcgggcgcatgcagatcgagccgtactacggcggcggcggcgcgcggccggacttccggtcctactcgtacagcgccggcgggggcgggatggggacgtcgtcctactcctcctcctcctactcgtaccagtacgagtacggcggccctgcggcgggggcggcggcgggggaggaggtgaagcggagcaagtcgaagcggcggtggctggcgctggcggacccggacatggatcgcaagcgccgggtggcggcgtacaaggcgtacggcgtggagggcaaggtgaagggctccttccgcaagagcttcaagtggatcaaggaccgctacctcaacctcgtctacggatggtcctgatgatgatactccatgggtttttttttgggggggctctgcctcctctgtcctctctcttctttttcatgcttgcagt

SEQ ID NO: 191 - DNA, 2813 bp, Glycine max
ggacgaaaaaggtgttcagtgtccaagcgttgagaagggaagaggtacacatggcaagtggcaactgacctcattgttgatagttgatacttggcctcgaagatgcacttgctactatccaagtccccactattactgatacataattcttctatgctcctgcaccgcttctctcctcttctccttcctcgttttctctttcgccaaccccccttcccctcttcgaatttcaaacctctcacactcaaggtcctctccatggcatcgtctcattcctcccaccacatacacactaatcgactcgcttccgaacagagcccctatcttctccaacacgctcacaaccctgttgattggtatccctggggcgaagaagccttcgccgaagcgcgccggcgagacgcgcctatcttcttgtcaattggttacagcacttgtcactggtgtcatgttatggaggtcgagtctttcgaggatgaagcggttgccaagttgctgaacgattggttcgttagcattaaggtggatcgagaggagcgaccagatgttgataaggtgtacatgtcgtatgtgcaggctttgtatggtggaggaggttggcccctgagtgtgtttctttcacctgacttgaaacctttaatgggtggaacttacttcccccctgatgataagtatggacgaccaggatttaagactatacttagaaaggtaaaagaagcttgggatagtaagagggatatgctaattaagagtggatcatatgcaattgaacagctttctgaggcaatgtctgctagttcagattctgataaactgcctgatggggttccagctgatgcgttacgcctatgctcggagcagctctctgggagctacgattcaaagtttggtgggtttggatctgcaccaaagtttcccagaccagttgagataaacttgatgctatatcactccaaaaagttggaggatacggggaagttgggtgtagctaatggaagccagcaaatggttttctttagcttgcaatgcatggcaaaaggtgggattcatgatcatattggagggggatttcacagatacagtgtggatgagtgctggcatgttccgcattttgagaagatgctttatgatcaagggcagcttgccaatgtttatctggatgcgttttctatcacaaaagataccttttattcttatatatcacgagatatccttgattatttaaggagagatatgattggtccagaaggtgaaattttttcagcagaggatgctgacagtgcagagactgaaggagctgcaagaaaaaaggaaggagccttttacatatggacaagcaaagaggttgaagacttacttggagagcatgctgctctttttgaggagcactattacatcaagcaattgggtaactgtgacctatctggaatgagtgatcctcacgatgaattcaagggaaagaatgtcctgattgagagaaaggaaccttcagaactggcatcaaaatatggcatgtcagttgagacatatcaagaaattcttggagaatgcaggcataagttgtttgaagtaaggtcaaggcgtccaaagccacatttggatgataaggttattgtatcgtggaatggactggcaatctcatcttttgccagggcttctaagattctcaagggtgaagctgaagggaccaaattctactttcctgtcattggcactgaaccaaaggagtacatgggaattgcagaaaaagcagcatcctttattaggaagcaactttacaatgtagaaactcacaggctacaccatagtttcagacattcgccatctaaagctcctgctttcttggatgattatgcttttctgatttctggattgctggatctctatgagtttggtggtggaattagctggcttctatgggccattgaattgcaggaaacccaggatgctttgtttcttgataagacaggaggaggatatttcaataatacaggagaagatgcttccgttctcctccgtgtaaaggaagaccatgatggggcagaaccctcaggaaactcagtttctgctataaatcttataagattggcttccatggttgctggaagtaaggctgagcattataagcgaaatgcagaacatctattggcagtttttgagaaaaggttgaaagatatggctatggcagtgcctctaatgtgttgtgcagcagatatgttgcgtgtactttctcggaagcaagtggtcgtggttggtgaaaggacgtctgaggactttgaaaacatgcttgctgcagctcatgcagtatatgatcccaacagaacagttattcatatagatcccaacaacaaagacgagatggaattttgggaagtaaataacagtaatgttgctctcatggcaaaaaataactttgcagtcaacaaggttgtagctcttgtatgccaaaacttcacttgtagcccctctgtgactgaccattcgtcacttaaagctttgctctccaaaaaaccttcctcttcgttcacgtaagctattggttctgatgagtaggaaaatagttaacgtcggcgaaagctccctcttagagatccccctttcaatctacagaactagttggttctgacttctctgtcaaaataaagataggtaacattctctgttgacttgaggaattgatgcatgtccttttcgtatgcctgtgctcaacaagccatgatttttcttcaaatgtgatacagaatgatggaatcatggaagtatgtataattgtatatgcaatgtaagctatcgttgaaataattatcttttcc

SEQ ID NO: 192 - DNA, 2047 bp, Glycine max
attatcccatgagttctctattcttttaaaccttagtctcccacggaagacttcaacagaagaaaaaggaagaattaatatcactcttccatggttgccgacgaagcttcaccattcgagaccagcgatatgctggcaacgctcctggcgtcgacgccgctgttgtcagagtcatggcggctgtgcaccaccgtggccgccaccgcgccgaggagtttcatgactgagcagcacggtggcggcggtgtggtgtacgtcgctttccccggcgtagaaatggcggcgggatcggactctatctgcagaaacttggtggcgttggaaagcatcggcgacgtgccactgttctcggcgcggcgtcgcaacaaggaaggcgatgaacctgtgatggtgcatgctgggatgctgaatctcttgtccacctttttcgaaccatttcaaaaacagatgttggcactcatgggaaattccaagaccaaatcaattgtcctaactggccactccattggaggagccacagcctctctatgtgctctttggctactatcttacctccaccagacatattcctctatttctgtgtcagtcttgtgcatcacattcggttcccccatgctagggaatggctctttctcacgtgccattctcagagaaagatggggtggtaacttctgtcacgcttctctttgctcccataacaccttacactgctcaaataaacttcctgcttcagttttggcaactgtccatgactgctccaggctttgggaagcttgcaccacacaagatgaagaagggtctgcacctgttttgtttcacccatttgggagctacctttttgtttcatcagatggagcagtgtgtgtggattgtgcaacttctgttataaagatgttgcatttgatgtttgcatcagtttccccagcttgtagtattgaggaccatctaaagtatggagactatgttaagaatttgtcattacaattcttgaaccagaacaattccgtgcaggggaatattcctgattcaagctatgaagcaggacttgaattgtcggttcaatcttcaggtttgggtaaccaggaatcggcaatcgaacctgccaaggagtgccttaagatgacaaggaggatgggtccttcaccaaccaagaatgctgctaacttatcaattacattatcaaagtttgtgccttataggaccgaaatagaatggtacaaagcttggtgtcaccagcaagttgatcaaatgggatactacgacttattcaagaggagaaggagcacttcaaaaatggctatgaaagtcaacatgaatcgtcacaaacttgccagattttggaacaatgtgattgaaatgtgggagagaaatgagctgcctcatgatgtggcggtgcgggctaaatgggtcaatgcttcacatttctacaaactattggttgagccactagatattgcggaatattatgggaaggggatgcacacaaccaaggggcattacatacagcatggcagagagaagaggtatgagatttttgataggtggtggaaggatgcaatgggcaacaccgaagaaaataatgagaggaggagcaagtttgcaagtttgacccaagattcatgcttttgggcaagggtggaggaagcaagggactggctgaatagtgttagaagtgagagtgacacaacaaagttggctgtgctgtgggataacattgagaaatttgagaagtatgctatggaacttattgataataaggaggtgtctgaagatgttcttgctaagaactcaagttacagtatatggatggaagatttaagaggactgagggaactcaaagcaaaggtgaagacgttttcacaccactttaacccgtttctggatggagaagtaattccttagtaattttaaatgaaatcaataaataagcttgactctgtaatctgtaatatgcctatgaactacttgtttgcaaaataactagtgtgcttatggcttgatctaatcagtattttacttaaatgcttacaagaagtgtgacaaaaac

SEQ ID NO: 193 - DNA, 1074 bp, Glycine max
atgaacttgaaacaatactgttgtttcctcaaagatgaaggtctaaacaaaatacaggtttccaacaagaagaacagtagggactatccatgggaaatgtacactttgaaggagttgcttcgtgcaacaaacaactttcatcaagataataagattggagagggtggatttggaagtgtttattttggtcgaacaaattcacatgcgtataataaatggaatttgcagattgcagtgaagcgattgaagacaatgactgcaaaggcagagatggagtttgcagtggaagtggaagtgttaggaagagtgaggcaccagaatttgttgggattgaggggattctatgcaggaggagatgaaaggttgattgtgtatgattacatgcctaaccatagcttgttaactcatttgcatggtccacttgctaaggaatgtcagctagattggcctagaagaatgagcatagcaattggagctgctgaaggtttagcgtatctgcaccatgaatcaactcctcacatcatacacagagatataaaggcaagcaatgttcttctagaccctgaattccaagccaaggttgctgattttggttttgcaaagctggtaccggatggtgtgacccatcttaccacaaaagttaagggcaccctaggatatttggcaccagaatacgccatgtgggggaaggtttctgagagctgtgatgtttacagctttggaattttacttttggagattattagtgccaagaaaccaattgagaaattcccaggaggagtgaaaagggacattgttcaatgggtcactccatatgtcaacaaaggtctcttcaacaacattgcggatccaaagttgaaggggaaatttgatttggagcaattgaaaaatgttaccaccatagctcttagatgcaccgatagtagtgcggataagaggcctagcatgaaagaggtggtggattggctcaagaatggtgtagggagcacttggggagaagagaatattccaactttaagtatcaagaatggagacgaaggaaatgacaaagatgacaaattaaaaaataactag

SEQ ID NO: 194 - DNA, 1297 bp, Glycine max
ttttatctatctacatggacatgaacgaaatcgatgttccttcgttctttctctgccccatttcgctagaaatcatgaaggatccagtgacggtctcaacgggcatcacctacgaccgtgaaagcatcgaaacgtggctgttctcgaagaaaaacacgacatgccccattaccaaacagcccttgattgattacaccgatctcacaccaaaccacacccttcggagactcatccaatcgtggtgtaccatgaacgcttctcacggcatcgaaaggatcccaacccctaaaccccccgttaacaagaaccaaatttcgaagcttctcaaagacgcttctcattcccctctcacatgcctcagaagactcaaatccatcgcttcaggaagcgaaacaaataagcggtgcatggaagcttctggcgctgttgagtttctagcatcaattgtaatcaacaacaacagcaacattgattcttcaaatgaggctgactcaaacgacggatctggattcgagttgaaaacaagtgcaagcgatgaagcgttgagtttgcttcataatcttcatttatctgaacaagggttgaagactctcttaagcttcagaaacggcgagtttattgagtctttaacaagagtcatgcaaaaggggttctttgaatcacgcgcttatgctgtgttcttgttgaaatctacttccgaagtggctgaaccagtgcaactattgcatctaagacaagaactttttgtcgaactggtacaagtcctgaaggatcaaatttcacagaagacatcaaaagcgacccttcaaaccctgatccaattctctccttgggggaggaacaggatcaaagctgtggaagcagatactgttcctgttttggttgagcttcttctcgattgcaaggagagaaagccttgtgagatgatgctggtgttgttggaactgctatgccagtgtgctgagggaagagcagaacttttgagccatgcagcaggtcttgccattgtgtccaaaaagattctaagggtttcaactttggcgaatgatagagctgttaagattattctgtctctttcgaggttctctgcgactccacatgttgttcaagaaatgctgaaactcggtgtggtcgcgaaattgtgcttggtgcttcaggtggatagtggaaacaaggctaaggaaaaagctagagagatactcaaattgcatgctcgggcgtggaggaattctccatgcataccgaacaatttgcttaattcatacacgaattatgtgtgaaacaaaacgagaatttt

SEQ ID NO: 195 - DNA, 2786 bp, Solanum lycopersicum
gattgaaagagtgatttttttttcttttgttttcacgggtgagcgcacctgtagtgattggatccatacttctactgcattatattctcaaccccttttgtttctctctctattttatttttgttctttctctctcttaacaatccaaaatttgtttcgaatgtgagagaagagtgggagctcaagttcaggaacaagactgggaattctttgatttgtgggaatttgatagaaagttgaaagcttttttgctattaagaaattgggtttcatttatttttgggtttaaggttggaacatgtcaaggccactccatagaggtgtgtcaggtggggggaggttatcagttaatggccctgatttctgggatgactctcaaatgaaagataaaatagaaaaggaagatttggagcgtaatcgctcgcctggtgatctgacttattcacctaccaaattcctttgccggattctgtttccagataattctccttcaaaacataatttgggtgaaaatggcttactttctgatccatttagccctggaacaggaagaaatagactcaagtatgctttggttttgatcaggctgagcttagttgtcataatacttcttgcccttactggatctttttggtggacaatttcgataacttcctcgtcgagaggtcatatataccatggatacaggcagcttcaggagcaagtagtatcggatttgagagacattggacagctctctcttgatgctacaaatgtgaaggatatagagtactgtcctcctgaatctgagaactttattccatgtttcaatgtgtcagaaaatcttgatttgggcctttctaaaggtgaggaggttgaccgccattgtggacctggttcaagacaaaattgcttggtacttccccctgttaattacaagattcctcttaggtggcctaccggtagagatgtcatttggcatgcaaatgttaatattactgctcaagaggtactctcctctggaagtatgacaaaaaggttgatgatgttggaagaagagcagatttcctttcggtcagactctgccatgtttgacagcattgaagactactcacatcaaatagcagaaatgattgggctgcggaatgaatcaaactttgtacgagctggagtccgaactattttggatattggatgtggctatggcagttttggggcacatctcttttctagccaactgttgaccatgtgtgttgcgaactatgaagcttctggcagtcaagttcagctgacacttgaaagaggtcttcccgcaatgattggatcatttaattcaaagcagttgccttatccatctctttcctttgatatgatacattgtgcggaatgtcatgttgactgggatcagaaagatggtatttttcttgttgaagtcgaccgattgttaaggcctggtggatattttgtctggacttcaactattacgaatactcagcgctccgtccgcaacaaagtgagcctcaaaaaatggaactttgtccagaattttgctgaaagtatgtgctggaagctgttagcccaacaagatgaaactgctgtatggaaaaagacaagtttaaagaaatgttattttgcaaggagaccaggtgttgggccttccatctgcagtaaaggacaggacattgaatccccgtattatcgacctctacaagcatgcattgctggaacccaaagccgccgatggattcctattgaagaaaggacaaagtggccttctagggccaaattaaactccagcgaacttaagattcatggtttgttatctgaagctcttgctgaggattcccttaactggaattcagcagttaacaattattggtcacttctttcacctttaatattttccgatcacccgaagagacctggtgatgatgatccttctcctccctataatatgcttagaaatgtgctggacatgaatgcccattttggtggtttgaatgctgctctactggatgctagaaagtcagtgtgggtcatgaatgttatccccactagtgggcctaactatcttcccctaattctcgacaggggattcgttggtgttttgcatgattggtgtgaggcatttccaacatatccaagaacttatgatctggtacatgctaatggacttctgtcaatggaattcggccaacatatcagatgcccgatgtttgacctgtttattgagatggatcgtgttcttcgtccggagggctgggtgattttacgcgacactgtccctcttattgaattagcaagatctcatgcagcacggttgaaatgggacgcgagagttatagaggtagaaagcagtgatgagaagctactaatttgccagaaaccattttcaagaagacaagctagctaaaaattggcaaggatctcaagatttgtagatgataatagtcatttgtttgttggatcatattaattattaaacagcaaaaatttcacacagaaatggcggtaacgaaaacgaaattttttggacagtcagaaaagcaagagagagcacaagaagagaagacaacagaatggttctgcaaagggaccaaaaccacaactcctatgtagccgtaaggcttacatagggccatgtaattacacatttgaggcacagttgcaaatgggaattgttttaggggctatagttttttccttgtgatgtctcattttataactatacaagcaaaaacaatatgttgattgaaattgtgaaggtattatagaataacagcaatcctagctgctgtatcttatct

SEQ ID NO: 196 - DNA, 553 bp, Solanum lycopersicum
tatcaataatggattttatcatccttctcatcgccatccttgctctttctagcacaccaattaccattatatccggatctgtgacaaaccatacatattcaactacaaactcttacaccaacgttgctctttctgcacgaaaagttgtatttcctcctcccagacagctaggaaaagataattctgatgacgatgacttgatctgcaaaacttgcaagagattatcagaacaccgtacatgttgtttcaactacttttgtgttgatttgttcaccaacaggttcaactgtggctcctgtggcctcgtctgtatcgttggaacaagatgctgcggtgggatctgtgtggacatcaagaaagacaacggaaattgtggcaagtgtaacaatgtatgctctcctggtcagaactgctcatttggcctttgtgtcagtgcctaatttaatgtatttctctatctgtaccaataaccaattcccctatcccctgggtgaaatgttacatcttgttcaagttttttagttagataactaattttcaagttttctagttg

SEQ ID NO: 197 - DNA, 1779 bp, Solanum lycopersicum
aaagtctctatgcgttcacaccacattttatcccatatatatatgaatgaaccttgtttcccagaagaaaattcttcaatttcttgtatcatgaatcatctacccaataaacgccgtagaaggaggaaagaaatcgtacaacaaaccccaactaatagtagcgcaggtggtggtggtaatgatgaatttgggtcggaaaatcaaggggctgtcaaaacgaaggagttgaaacagatattaacctctttgttgttacttgaagagcaagaaaaatcggaatttgcaaaggaagaggaagaggataaacacttactcgaagccaatcataagaaaacaacgaaagtgatgtgggattattattccaatgttcaacagcatcattctgatttagaacagttagatggtgttcgaaagaggaaagggagagggaattctgctgctcttactgctactgcttgtgcccttgcttctgcagctgcagaggaagaaggggtttccagtaataaatctaccgataaaggtgcgcctcataggcgattgtgggtgaagaataggtcaaaagcttggtgggatcaatgtaacagtcctgatttccctgaagaggagtttaagaaagcgtttcggatggggaaagatacatttgaattgatatgtaatgaattgacttctgtggttgcgaaagagaatacgatgctaagagatgctgtacctgtgaagcagcgtgttgctgtttgtatatggagattggctactggagagcctctgagattggtttccaagagatttggattggggatttcgacttgccataagcttgtgctagaggtttgtactgcgattagaactgtgttgatgcccaagtatcttcaatggcctgatgagaagaaaatgagggatataaaggatgagtatgaggatatgtcagggatcacaaatgttgtgggatcaatgtatacaactcatatacctataattgctccgaaaattagtgttgcagcttatttcaataagaggcatacagagaggaatcagaagacttcgtattcgattacagttcaaggggttgttgatccaagaggggtgtttactgatgtgtgtatcggttggcctggttcgatgcctgatgatcaggtactggagaaatccgcccttttccagagggcgaatacagggttactgaacaacgtttggattgttggtagttctggataccctttaatggattgggttttagtgccttatacacagcagcagctaacttggactcaacatgctttcaatgagaagattggtgaggttcaacgggtggcaaaggaggcgtttgtaaggttgaaaaggagatggtcttgtttgcagaaaagaacagaggtgaaactacaagatttgccagtggtgctaggggcgtgctgcgtcttgcataatatttgccagatgaggaatgaggagatggatccagaactcaatttcgagctcattgatgatgaaatgcttccagagattcaattgagatcgaccaatgctaggcttgcaagggatgctattgctcataatcttctacaccataaccatgctggtacttctctcctttaatacaatcaaaggagggaaaactttgattcatgtaattctttcaagttattacttatattttcacatttgtttttcttaagttaagttagtgtgcaaacggatgaaaatgttgcttttctagcatacactgcagacaaatattgtatttcatacttcaattagagattgatagaagaaaattgacttggc

SEQ ID NO: 198 - DNA, 1878 bp, Solanum lycopersicum
gaaaaagttaggctaacatcgactaagacgccaacctctcgttggttgttttggccactaccctttcactccctcgacgagtccgtcactctcctattacctaaaaacccaccaaacatttctcatttttcactatatattcatcttcttcactccattttcaaggaatctcttccatttttttcctcctgaaaatcactttttcttcattcaccatggaaggcgcagcaacagctcaagctttatctcgtattgggttagctggcttagctgttatgggtcagaatttggccttaaacatagctgaaaaagggtttcctatatctgtttacaatagaaccacttcgaaagtagatgaaaccctagatcgtgctcagaatgaaggacagcttccattgattggacagtacaatcctcgtgatttcgtgttgtctattcaacgacccagatctgttatcattcttgttaaagcggggtcacctgttgatcaaacgattgctgcgctttctgagtatatggagcctggggatacgattattgatgggggtaatgagtggtatgagaatactgaaaggaggattgatgaggcgtcgtctaaggggcttttgtatttgggtatgggtgtttctggtggagaagaaggggcgaggaatggaccttcgcttatgcctggtgggtcttatggggcttatacgaatatcaaagatattcttgagaaggttgcagctcaagttgaggatgggccttgtgttacttatattggtgaaggtgggtcggggaattttgtgaaaatggtgcataatggaattgaatatggtgatatgcagttgatttcggaagcttatgatgtgttgaagaatgcaggtgggttgagtaattctgaattggctgatattttcgccgaatggaaccgtggggaattggagagctttttgattgaaattacagcggatatattcaatgtgaaggatgaattgactggaaatggggagttagtggacaagattttggataagacaggaatgaaggggacggggaaatggactgtgcagcaggcggcggagctgtctattgcagctccgacgattgctgcttcgttagacagtaggtacatgagtggattgaaggatgagagggtagaagcctcagagatttttaggaaggaaggtttaaaggaggaaataagttctgatattaatggtattagcagtgttgataagaagagattgattgatgatgtgaggcaggcattgtatgcgtcgaaaatctgtagttatgctcaggggatgaatttgctaagggcaaagagctctgagaaaggttggaatttgaatttgggagagatggctaggatttggaaaggtggttgtattatcagggcagtgtttttggatcgtattaagaaggcgtatcagaggaatcctaatttggctaacttgatggttgacacggagttcgcaagggagatggtgcagaggcaagctgcttggaggagagtggtgggacttgctgttcagaagggaattagtgttcctggaatgtctgctagtcttcagtatttcgacacctacaggcgttctaggcttcccgcgaaccttgtgcaggctcagagggactatttcggggcacatacttatgagagagttgacaagccaggagcataccataccgagtgggcaaaacttgctaggaaagctcgagtgtaatgctgctgcagctattgcggattatgatcaaaatctctggtattagtcgcgctttagtacttttttcgtttagttttgcagttaataatgttgtatgcctttgaacattatagggccttcgctatcgaaatgacttcttccattgaagtaaaagaagttgcttttcctacat

SEQ ID NO: 199 - DNA, 820 bp, Solanum lycopersicum
ctcaacgttttcggaactttcaagattcttaaacgaccccctttttctctatataaattgcaccaatcaaacccccaaactcaatcatagaaaatcatcaatcaaacactagagaagaagaagatcatcaatactacagtgtatagtatgagtgtcatcagcaaattaacattgctcatcatttcaattgcttgcatttttcaggtatcatcactaagcgcagatgggtcatcacttgtaccactaatcatagaccaaatgataagcagcaatccggctaatacatttcttgatccattcaaagttttagaacaaataccatttggattagaaaacactctgctcgcgagagtcgactggaaagagacggcgaagggacacgtgataagcgtagaagtacctggattgaagaaagatgatataaagatcgaaattgaagaaaacagagtgttgagagtgagcggagagaggaagaaagaagaagagaaaaatgatgaagagaatcattggcattgtgttgaaaggagttatggaaagttctggagacaatttcgtttgcctgaaaatgctgatattgatacaatgaaagctaagcttgaaaatggtgtgcttacaatttcatttgctaaattgtctgctgatagaattaaaggtcctaaagttgtgtctattgagagtaaacaacaaggaaaagagtcctctgttagagaagagctttaattttatgagttcatcctctgttttctgttcatcctctgtttctctctgtggtacgtgtatgatgaaaaaaatgttaaataaaatcgtattttgaaatatt

SEQ ID NO: 200 - DNA, 3499 bp, Solanum lycopersicum
aaaaatggggttgattgattctcaatctttatcatcatctccagtgaaaattacagttacttcatctcccactggtgggtgccatggtttaactagtccgattcggagacattcgttatcgacgaatcctaattcacctcttagtggaaaagggttgaggggttcttctggtggaaggtatctttctatgtctaaagagagtactgatgaatttgtagcttatactgttcatattccaccaaccccagataatcgtacggtggtggattctcagaatagtcctattggggttgggagcagtagaaaaagctatgggtatggaaatccgagtgatgggtatattaaagatacgatttttactgggggttttaattctgcaactaaagcacatgttaggaaaagctctgaggatgaacctatggtgatgaaatgtaaaacaatgtgtcaaatggaaggttgtgatgagaaaaaagctgaggagaagtgtgaatgtggatttgtgatttgtagagagtgttatttggattgtgtgggaattgatggagggtattgtcctggttgtaaagagtcttataaggggattagtgatgatgaaagcgatgaacccagatccgaagctaaggatcaagcgaatccgttgccttcgaggggaagaggagggagaatggagaagaatttttcacttgtgcagtcattcaagaatccaaatcaagattttgatcatacaagatggctttttgagactaaagggacttatggttatgggaatgctttgtggccttctgatggtcatgaatttgggagaggtattgatagatctgaaaatcctccagattttagtgacagaagaaataggcctttgacaaggaaagttggaatctcagctgcaattatcagtccatataggttgctcatggttcttcgtcttggtgcgttggcttgtttcttgacatggaggatttctcatccaaatcatgatgcactgtggttatggataatgtcagtagtgtgtgaggtttggtttgcaatatcttggcttcttgatcagctgccaaaactctgccctgttaaaagaattactgacctctctgtattgaaagaaagatttgagagttcaggaccaaaccttcgaaacccgaagggattgtctgatttgccaggcattgatgtgtttgtttcaactgctgatgcagaaaaagaaccaccccttgtaactgcaaacacaatcctttccattcttgctgttgattatcctgttgaaaaggtggcatgttacttgtcagatgatggaggttccttagtgacatttgaggctcttgcagaagctgctagctttgcaagaatatgggttcccttctgtaaaaaacataagatagaacccagaaatcctgagtcatactttgggcaaaagcgcgatccactgaaaaacaaagtgaagctggactttgttagggacagaagaagggtgaagagggaatatgatgaattcaaggtgaggataaatgccttgcctgagtcaataaggcgaagatcagatgcttataacacccaacaggagttgagggctaaacgaaaacaggttgaacttggagaggatctttctgaacccatcaaggtccctaaagctacttggatgtctgatggaactcactggcatggtacttggtcatcagctgaggaaggacattcaagaggtgatcatgagggtattatacagatcatgttggttcctccaaatgcagagccactttatgggaatgaagtagacgagaaaaacatgattgacacaacagttgttgatgtcagattgccaatgctggtttatgtttccagagaaaagaggcctggttttgatcacaacaagaaagctggagcgatgaatgctttagttcgagccagtgcaataatgtcaaatggcgcattcattctcaatcttgattgtgaccattacatctacaactcattggctatgagagagggaatgtgctttatgcttgacaaagggggtgacaggatctgttatgttcagttccctcagaggtttgagggtgttgatccaaatgatcgatatgcaaaccacaatacagttttctttgatgttggcatgagagcactggatggtttgcagggtcccatgtatgtaggaacaggctgcattttccgaagaattgctctctatggttttagtccaccaagagcaactgaacatcgtggatggtttggtagcaggaagactagaaagcttttgaggaaacctaatatacaaaaggatcaagaggatgatgagatgtttttaccaatgattgggaataaagatgatgaggaggaagtaagcagatctttgcttacaaaacagtttggaaactccattccgttggtggactctattgctgtagctgaatttggagggaggctgctccatgagttgagaggcaaaggttgccaaggaaggccagcaggttcacttgctgttcatcgcgagccattggatgcttcagcacttgctgaggctgtaggtgtcataagttgctattatgaagacaaaactgaatggggcaatagagtaggatggatatatggttcgatcacggaagatgttgtgacaggttacaggatgcacaatagaggctggagatcaatttactgtgtcacaaaaagagatgcatttagagggacagcaccaatcaatctaactgataggctcatccaagttctcagatgggcaacaggttcagtcgaaatcttcttctctcgcaacaacgcactctttgcaagcccaagaatgaagttcctgcagagggtggcgtatttcaacgtggggatgtatccgtttacttccattttcctccttgtctattgtctcttgcctgcactttcactcttctcagggaagttcattgtgcagtccctcaatgtcaccttcttggtgttcttgctagcaatcacaatcaccctatccatgcttgcactccttgaaatcaaatggtcaggaatcacgcttcatgattggtggaggaatgagcaattctggttaattggtggaacaagtgcacatccagctgctgtgatacaaggactactgaaagtcatagcaggagttgacatctcattcacattgacatcaaaatctgctacacctgatgatggtgaagacgaatttgcagagctatacgagttccgttggacagtcctaatgattccaccaatcacaatcatattgatcaacatgattgcaatagcagtaggcacattcaggacagtatatagtcctttcccacaatggagcaagctacttggaggtgtattcttcagtttttgggtgttatctcatctctatccgtttgcgaaagggctaatggggaaaaggggaaagattcccaccattgtcttcttatggtctgctctcatctgcattgtcatttcattgctcgcggtttacgtatatcctccttcaggacatcaagatttctcaagttttcagtttccttgagttgtgttg

SEQ ID NO: 201 - DNA, 5093 bp, Solanum lycopersicum
atgcaaaaacggggttcatacccggtgttccaatcgggacatgggtttcaccggaattcgccggaattttcgaaacgaagaataccaaatttcacaatccaactccgggcaacaccggtgaactggaaactgaactggcaacatctgaacagcttgataacaaaattacccttcaccccagaaaacccatcagttgtagactcaagttatatcgtaggaaccctatcgtatgttgaatggtgtcaaacattagaagttatggtgaagttatgggagttaaggttaagtggtgagcattgttttaacccaattttaaaagcaaaagttgaacttccatctgataaagaagaattgaatgagagaatagaaggggttttcttggagaaactgaataggttaatcaatggtgttttagtacaaaaatggcagaaaaaattgggttttgtgattgatgagattgggaaaatttctttgttgttgaagaaaccaaacaggattggtgtttaccaggagctatgtaagaaaaaaaagggtattgaaggtgaaagagatttgatattatcaaggattgatgaatacaagaatgggattaaatgtatcattgataatttggaggattcaaagaattatgaggatgttaaagtgtttgattttggtgaagggattgattggaatagaattcactttatcatgatgagagaatgtagaaggcttgatgatggattaccaatttatggttttaggcagcagattcttcaacaaattctttctcatcaggtgactgttttggttggggagactggatcaggaaagagtacacaattagtgcaattccttgctgattcaggaatagctggcgatggttctatagtttgtactcagcctcgaaaacttgctgccaactctttagcaagtagggttagagaggaaagccaggggtgctatgatgattgttcgatctcctgtaatccaccacattcatccgatcagcagttggattcaaaggtgatttttatgacagatcactgcctattacagcactatatgggcgacaagaatttgtccaacatttcatgcatcatagtcgatgaggcacatgaaagaagccttaacaccgatcttcttttagcgttgattaagaaactacttcatcagaggtttgatctgaggcttattattatgtctgctacagttgatgcaaaccagcttgcaggctacttctttggttgtggaactttccatgtggctggtaggacttttccggttgatataaagtatgtaccctgtgaagataacgcccattatgctgtaggtgcaattgcctcttatgtccacgatgttatcaagatggtgactgagattgatagaactgagggagtgggggctattttagccttcttgacatctcagagtgaagttgagtgggcttgtgagcagtttaaagcaccactcgccattgctttacctttgcatggcaagttatcctatgatgaccaaaaccgagtgtttctctcctatccagggaagagaaaggttatattcaccaccaatctagctgagacatcactgacaatccctggtgtcaaatatgttgttgattctggcatggttaaagaaagcaggtttgaacctggctctggcatgaatgttctcaggatatgcagtgtgagccaaagttctgctaaccaaagagccggtcgtgcagggagaactgaacctggaaagtgtttcaggctgtactctcaaagtgattttgaggatatgcctcgtcatcaggaacctgaaattcggaaagttcatcttggtgttgcagtgctgaggattcttgctttaggtatcaagaatgtgcaggattttgactttattgatgcaccgagccccaaagctattgagatggccaccagaaatctggttcaactaggagctgttacacaaagagatgatgcatcatatgaattaactgaaggaggactaaaactggtgaagttgggtattgaacctcggttgggaaaaatgatccttagttgctttgatcaacgtttgggtaaagaaggtgttgtgcttgcagccgttatggcaaattccagcagcattttctgtagggttggttctgaaggagacaagcttaaatctgattgccacaaggtgcaattttgccatccaagtggggacctctttactttactatctgtttacagggaatgggagattgtgcctagggaaaagaagaatagctggtgttgggataatagtatcaatgctaaatccatgagaagatgccatgagacagtgctggaaatggaagcctgtcttcagaatgatctcaatatgatcttagccagttactggtgctggcatcctcaagtgcataacaagtgtgacgaagtattgcaaagtataattctttcttcacttgcggaaaatgttgctgtgtactcaggttatgatcagcttggttatgaggttgcactaactgggaagtgtgtccaactacatccttcctgttcgcttttgaattttggccaacgaccacgttgggtagtctttggggatgtccttgcatcagctaacgagtatctggtctgtgttactgcatttgagtttagttctcttgttagcctcactcctgctcctttgtttgattttctgaagatggatgcacgaaagttagaaaaaaaggttttgacaggctttggagtcttgctactcaaaagattttgtgggaaatttaacagtagcattaataatcttgtctcgcgcattagaacttcttgtaaggatgaaagaataggcattcaagttaatgttgatgagaatgaggttcttttatatgcttcttcgagagatatggagtgtgttacactccaggtaaatgatgctctagagtatgaaagtaagctgttgcggaacgaatgcttagagaaatgtctattcaatggaggatcggcctctgttgctctctttggagctggagctgtgataaagcatttggagcttgagaagagatgtttgactgtggacatatttccttcaaatggaaatgccattgatgacaaggaattgctgatgtgtttggagagagcaacatctggtaatatttgtatggtgcacaagtactataatatgggccaggacaaagtggagaacaagtggggcacagtaaaatttcttacccctgatgctgcagaacaggctacatccttaaataaagtggaatttaatggtggctttctgaaaatggttccatccaggagcataaattgtagtgatcaaaaaatgtttcgctcagttctcaaagctaaagtttcttggcctcgtaggtacagtaaaggagtaggctttctgagatgtgatcctatggatgttcctttaattttagatgacctctctgatcttatgattggtggaaatgtcatccgttgtgaggcaagcgataagaaccctaataacatagtcattgctagacttgataaggacatggctgagacagagatacttgaggtgttaagggcaacaacaaataggagagttctggatttcttcttggtgagaggagattctgtagaggatcctcccatagctacttgtgaagaagcacttcggaaagaaatatctcccttcatgcctaaaaaggttccatttgttaactctgttcgtgtccaggtgttccagccgaaactaactgagtatttcgcaaaagcaactataacatttgatggatctcttcatcttgaagcagccaaggccttggagcaaatcgacggcatggttttgcccggatgccttccctggcagaaaataagatgtgagcgactgtttcacagctctgtttcctgtcctgcagcagtttatcatgtcatcaggaaccagctggattttttacttgctagcctccgccaaagaaaggttggaaaatgcgagctacagagaaatgataacggttcctatacagttaggatatctgctactgccaccaaagttgtggcagatttgagaaggccactggagcaacttatgaaaggcaagattgtagatcacgtggacattactccgaaggttgttcgacttctgttctctcgggaaggaaacaacattatgaggacaattcaacgggagacaggaacctatatttattttgacaagcatagcttgcttgttagtatatttggttctttagacaacgttgatagggctcgacagagatttatcgattcccttctggcgctacatgaaaataaacaacttgaggtgcatcttcgtggaggacatttgcctcatgacctgatgaaaagagttgttcagacatttggaccagaccttagtgcgcttaaagaaaaggtgcctggggcagagttctctctgaacacaaagcgccattgcatctatatgaatggtacaaaagatatgaagcaaaatgttgaggacataatctctgaaattgctcaaagaagttttccaactcaaacgacaggagatgatgctgactgtcctgtttgcttgtgtggactggaggatccttataaacttgaagcttgctgccatctattctgtcggacatgcttgctagagcagtgcgagtctgcaatcaaaagccgggaaggtttccccatatgctgtcttcatcaaggttgtgcggaacccatattgcttgctgatttgaagtctttattgtcaattgagaagttggaagaacttttcagggcttctttgggggcttttgtggcagccaatgggagtacctaccgcttttgcccctcaccagactgcccttcagtttatcgcattgcagatcccgatatggttggtgcaccttttgcctgtggtgcatgctatgtggagacatgtacgagttgccacatggagtatcatccttacctctcatgtgagatgtaccagaaagttaaaaacgacccagattgctctctagaggaatggtccaaggggaaagagaacgtaaagaaatgtcccgtttgcagatgtacaattgagaaggtggatggctgcaatcatatcgagtgtaagtgtgggaatcatgtttgctgggtttgcttgcgcttctttgacaccagtgataattgctatgatcatttgag

SEQ ID NO: 202 - DNA, 1907 bp, Arabidopsis thaliana
tttgaagcaacataacaaacgcgccgcgaatccatttttaagggtttagagacttttagggtttacttgagaacagagagatggggaagagcgaaaagacgtcgttggggcgatcactcgtgaagcaccacaaccatatgatacaagaatccaaagacaaaggcaagtactacaagaatctacagaagaaagttctcgaatctgtgactgaggtcagtgacatcgacgccatcattgagcaagctgaggaggcagagcgtctttacaccattaatcacagctcctccacacctttgtctatcaatctagacacaaattctagctcaagtgttatagcagctgaagaatggagagagcaacagaagatagaggaggctttacacgccagtagtcttcaagtacctcgaagacctccgtggacacctgaaatgtcagtggaagaacttgatgctaatgaaaaacaagcttttctaaattggcgccggatgcttgtgagccttgaggaaaatgaaaagctagtgttgactccattcgaaaagaaccttgacatctggagacagctttggagagtgcttgaacgcagtgatttgattgttatggtagttgatgctagagatccactgttttaccgctgccctgatcttgaggcatatgctcaagaaattgatgagcataaaaaaataatgcttctagtgaacaaggcggatcttttacctactgatgtcagggagaaatgggcagaatatttccgccttaacaacattctgtttgttttctggtcagccatagctgctacagctaccctagaaggtaaagtcttgaaagagcaatggagacaacccgataacttgcagaagacagatgatccagacattatgatatatggcagagacgagctgttgagtcgtttgcaatttgaggctcaagagattgtcaaagtaaggaattctagagcagcatccgtatcatcacagtcatggactggtgaatatcaacgtgatcaagccgtggttggatttgttgggtacccaaatgttggaaagagttctacaatcaatgcattggtgggtcagaagcgaacaggtgtcacctctaccccaggaaaaacaaagcatttccagactttgatcatctctgatgagcttatgctatgcgattgccctggtttagtcttcccttcgttctcaagctcaagatatgaaatgattgcttctggtgtacttccgattgaccggatgacggagcaccgtgaagctattcaggtggtggctgacaaggtccctcgccgtgtaattgagagtgtgtacaacatttctcttcctaaacccaaaacctatgagcgtcagtcccgcccgcctcatgctgcagagctcttaaaaagttactgtgcttctcgtggctatgttgcctcgagtggactaccggatgaaacgaaagctgcaaggctgattctgaaagattacattggaggtaagctgccacattatgcaatgccacctggaatgccccaagctgatgaaccggacatagaagacactcaagaactggaggatattctcgaaggttcagagtccgatgactctgcagtaggagatgagacagaaaacgagcaagttcctggtattgatgatgtgctagatgatctgagctcgtttgatcttgccaatgggcttaagtcttcaaagaaagtgacagcaaagaagcaaaccgcgtcacataaacagcacaaaaagccacagaggaaaaaggatcggacttggagggttcaaaacacagaagatggagatggaatgccttctgttaaagttttccagaaaccagctaacacaggtcctcttacgatgcggtgattatcaaattgtagtccatccaagcaaagatggcaaccgaagctacttaaagtttag

SEQ ID NO: 203 - DNA, 2380 bp, Arabidopsis thaliana
attcaatttcaacgtctcgtccttcaattttcgttttccgagaaaatttaggaaagaaagagaaagagagggcagagacaaaaatttcttcgccgtctgagtgggaaagatggcggaggatttcgctagagcggtagacgatgggcttaaactcgcgaaacggatttatttcggcaaagaccgagccgttgcggcgccgagaccacctgctccgatggacagatcttccactacgcagccttaccttcctacagcacctatggtttacgccgttatacccgacccgggaattgtggataacccggatttgcctagctatcagcctcacgtgcacggcaggtgcgacccaccggctttgattcctctgcagatgaattcgattgagctggatgttgattgttatctcgacacggctcttgttactgtcaccggatcgtggcgggttcattgtgttatgggaagcaagagatgtgattgccgaattgctattcccatgggagaacagggatcaatactaggtgttgaggttgagattcctagaaaatcgtacacaacgcagttgatcacagcagaagatggaaacgaatttgagaaaacggcactacctgaaactggtggctttttgaaacctaacattttcactcttactataccacaggttgatggaggtaccaatctctctatcaagatgacttggtctcagaagttgacgtataaccaagggcagttttttcttgatattcctttcaactttcctgagtatgtgactcctgcggtaaagaaaatctcaaaaagagaaaagatttacttgagtgttaatgctggtactggaacagaagttctctgcaaaggatgcagtcatcaactaaaggagaaattgcggagtgcagggaagttgaggtttgcatatgaagcagatgttttgaagtggtcgaacactgactttagcttttcttatacggcctcctcaagtaatatagttggtggacttttccttcaatctgcgcctgttcacgatgttgatcagagggacatattttctttctatctttttccaggaaagcagcaaaaaactaaggcattcaagcgggaggtagtatttgttgttgacataagtaaaagtatgactggaaaacctctcgaggatgtaaaaaatgcgatatctacagctctatctaagcttgatcctggagattctttcaatattatcactttcagcaatgatactgctctattttcgacatcaatggagtcagtcacttctgatgctgttgaaagaggcattgagtggatgaacaagaactttgtcgtcgcagatggtacaaacatgctccctcccctagagaaggctgtggaaatgctttcaaatactcgtggctctattcctatgatcttcttcgtaacagatgggtctgttgaagatgagagacacatttgtgatgtaatgaagaaacatctagctagtgctggatcagtgtttcctcggatacacacttttgggttaggtgtattctgtaatcactacttcctgcaaatgcttgcaaatatatcctgtggccagcacgaatcagtttataatacagatcacattgaggaaagaatggacaaactgtttacaaaggctttatccaccattcttgttaatatagcaattgagccccttcagagtctagatgaagttgaggtatacccttcaaatattccggatctgacgtctgcaagtccattgatgatatatggaagataccgaggaaagttccccgagaatgtgatagccaaaggtctgctaggagatttgagcagcttttcgacagacttgactgtacagagtgcaaaagacatgcctcttgataaagtatttgcaaagaatgttattgacttgcttactgctgaggcatggttttctgaagataaacagctaaaagagaagattgctaaactaagcatccaaaccggcgtactatccgagtatactcgaatgatccaattagagaacacagaagaattgaaacccagcgaaactggcggaaagaaaaagacaacaagcaacggcgagaaacagaagatgatatcaagaacgatcccgctacaaagccttgggataggatttggggataaaacagccaccagagagaatgttccgccaggatttggcgagcagaaagctcctgatgctgctgagaagttcgtcaaggctgcttcgagctgttgtgtctccttgtgcaacaaatgttgctgcatgtgttgtgtccaatgctgctctaagctcaatgatcaatgtgtccttgtcttcacacagctcttcacagcgattgcttgcatcgcctgctttgaatgttgctcaactgtttgctgttctggagacgatgggtagttataa

SEQ ID NO: 204 - DNA, 1598 bp, Arabidopsis thaliana
gcttctgagacataaacatcaattcaaatcgacgcaagcaaagaaagcaaaatggaaaatggaagcgggaaggtgttgaagccgatggactcagagcaattgagagagtacggacatctgatggttgatttcattgctgattactacaaaaccatcgaagatttccctgttcttagccaagttcagcctggttatcttcataagcttttgcctgattctgcacctgaccaccctgaaactctggaccaagttcttgatgatgttcgagcaaagatattgcctggagtaacgcattggcaaagcccgagtttctttgcttattatccttctaacagcagtgttgctgggttcttgggtgagatgttgagtgctggtcttggcattgttggttttagttgggttacttctccagctgccacagagctagaaatgatcgttcttgattgggttgctaaacttctcaacctacccgagcagtttatgtccaaaggaaatggaggtggagttatacaagggtcagctagtgaagctgttcttgttgttctgattgctgcacgcgacaaggttttaagaagcgttggcaaaaacgcgcttgagaagctcgttgtctactcctctgaccagactcattcagctttacagaaggcttgccagattgctggaatccatccagagaattgcagggtgctgacaacagactcttctacaaattacgctctgcgtccagaatcgcttcaagaagctgtttctagggatcttgaagctggattgattccattcttcttatgtgctaatgttgggaccacttcttcaaccgcagttgatccattagctgcactggggaagattgctaatagcaatggaatttggtttcacgtggatgcagcatatgctggaagtgcctgtatatgtccagagtatcggcaatacattgacggtgtagaaactgcagactcttttaacatgaatgctcacaaatggttcctcactaacttcgattgttcccttctttgggtaaaggatcaagattctcttacattagctctttcaacaaatccagagtttctcaaaaacaaggcctctcaggcaaacttggttgttgattacaaagattggcaaatccctctcggacgaagattcagatcattgaaactatggatggttttaaggctctatggatctgagaccttgaagagctatataagaaaccatatcaaactggctaaagaattcgaacaacttgtctctcaagatcctaacttcgagattgtcacacctcggatctttgctcttgtctgtttccgcctcgtgcctgtgaaagacgaagaaaagaagtgtaataaccgaaaccgtgaactcctagacgcagtgaactcttcagggaaactcttcatgtcgcacactgctttatcggggaaaatcgtactacgttgcgcaataggagcgccattgacggaggagaagcacgttaaggaggcgtggaagattattcaggaagaagcatcttacttgcttcacaagtaaatatgataaaacagtaaaagaataaaacggtttttgccaacaaaacgaagcacttcggtttggtttggtttaat

SEQ ID NO: 205 - DNA, 2273 bp, Arabidopsis thaliana
aagccatggcgaggtttccgacttctccggcgcctaacctcctcttgagactcttctcgtcgaacaaacgggcgtcatctcctactgccgcgcttttaaccggagattttcatctgattcgtcatttctccgccggaaccgctgctcgtgcggtcaaggatgagaaggagccatggtggaaagaatccatggacaagcttcgcaacatcgggatctcagctcatatagactctggaaagactacgttgactgagcgtgttctgttctataccggtcggatccatgagatccatgaagtcagaggtagagatggcgtcggcgctaaaatggactctatggacttggagcgagagaaaggtatcactatccagtcagccgctacttactgtacttggaaggattacaaggttaatataattgatactcctggtcacgttgacttcaccattgaagtggagagggctttacgtgtactagacggtgcgattctagtcctatgcagtgtgggtggtgtacagagtcagtctattacggtagataggcaaatgaggagatatgaagtcccgagagttgcgtttattaacaagcttgatagaatgggagcagatccatggaaagtcttgaaccaagcaagagctaagcttcgacatcatagtgcagctgtgcaagtgcccattggtctagaagaaaatttccagggtcttatagaccttattcatgtgaaagcttatttctttcatggatcaagcggtgagaatgttgtggctggtgatattcctgctgatatggagggtttggttggggataagaggagagaattgatagagacagtctctgaagttgatgatgtactcgccgagaaatttctgaatgatgaacctgtatctgctgctgagcttgaggaagctattcgtagagctaccatagcacaaaagtttgttcctgtatttatgggtagtgcattcaaaaacaagggagtacaacctctactagatggtgttgtcagttttctcccttctccaaatgaagtcaataactatgctcttgaccagaataataatgaagagagggtaaccttgactggatctccagatggacctcttgtggcgctggctttcaaattagaggagggtcgttttggtcaattgacatatttgagagtttacgaaggtgtgattaagaaaggtgattttatcataaatgtcaacactgggaagagaattaaggttccacgcttggtccgtatgcattcgaatgatatggaggatattcaagaggcacacgctggacaaattgtagctgtgtttggtattgagtgtgcatcaggtgatacatttacggatggatcagtcaagtacacaatgacatcgatgaacgttcctgaacctgttatgtccttagctgttcaaccagtttcaaaagattctggaggacagttctcgaaagcattgaatcgattccagaaagaggatcctactttccgtgtgggtttggatcccgagagtggccagacgattatttctggtatgggggaattgcatttggacatctatgttgaacgcatgcgaagagaatataaggttgatgcgactgtgggcaaaccccgtgtcaattttagggagactattactcagcgggcagagtttgattatttacataagaagcaaagtggaggagcaggtcaatacggtagagttacagggtacgtggaaccgctaccaccaggctctaaagagaagtttgaatttgaaaacatgattgttggacaagcaattccgtctggttttattccagcaattgagaaaggtttcaaagaagctgcaaactcgggctcactaattggtcaccctgtagagaatcttagaatagtattgacagatggagcttcacacgcggtagattccagtgaacttgcgtttaaaatggctgcaatatacgcattcagactgtgttatacagcagctagaccggtgattctagaacctgttatgctggtcgagttgaaagtaccaacagagtttcagggcactgttgctggtgacatcaacaagaggaaaggtataatcgttggaaacgatcaagagggtgatgattcagtaatcactgctaatgtgcctttgaacaacatgtttggctactccacttctctccggtccatgacacaaggaaaaggagaattcacgatggaatacaaagaacattctgctgtgtccaatgaagtccaggctcagctcgtcaatgcttatagcgccagcaaagctactgaataataa

SEQ ID NO: 206 - DNA, 1456 bp, Arabidopsis thaliana
agtctcttcttgtttcgatggaactcaataaggatcagacagtcatgtcggaggataaaaagcctcaagatccaaatcccagatttgcttgcgaaggttgcagcgttctgctcgacatcaacgatggtgaccgtctcgtcttcgctcgtttatctagtggcgctatattaaaaattgggaataagaattattctttaaagccattgatcggagctccgtttggatctctgttccaagtcgaaaccggagaagatggttctttcctctctcgcattcttcccattaaacaagaaagtaacagtaataatgttatggacgattcgagagataatcgagaaatcgtcgacaataatgaagctcagaatcttactggtgaagaaattgaagctatgcggagagagggtgcaaaaggggatgaaattattgaagctctaattgcaaacagcaaaacttttgataagaagtttcagttgtctcaggaaaaatataagcttaaaaagcagaagaaatatgcaccaaagctgcttcttcgacggccttttgctcgaagtatatgtgaagcttatttcaagaaatacccagccagaattggattcttacgagtagatgcgttatctcttctgttaacgatggctaatgtcactgcatactcggatgtgcttgtggtggatatggttggtggccttgtcactggtgcagtggctgaaagattaggaggcactggttatgtttgcaatacatataagggaagttctccttatcctgtggagatggtaaggatgttcaactttagtgacaaggttttaaagaggatcgtgcagtcatcgataaacgagctctcgtcagccaaaactgcgtctactgaaggaaacaatcaacaagaaggagtttgcaaagctgagaacaatattaatgaaacagctacatctgatgttatggttgaagaaatatctgtgacaactgaggctggagtagtagatattgttgtaccagagagcaaaattatcaaagccgcaaaagctggagccaaagcttcaaaagaaacaatagagatgtggcaagaaaacggtttttcgagtctaatcatggctgcgcaagaccaagacccatggatcgtagctaaggatgtattgccactactgtcctactctgctccttttgcaatatatcatcagtatttacagccgctggcgacatgtatgcacaagcttcaacagggtaaaatggcgatcaatctgcaaataacagaaccatggctacgcgaatatcaggtgcttccttcaagatctcaccctcacatgcagatgagttcttttggaggctatgttctgagtggcatcagaatctctaccacttgactgttgttttcataaccagaaactgtggtttgatgtttggtcttttctttcacaacgtctttctggttgttttgttgttgtaacattaagggcttaga

SEQ ID NO: 207 - DNA, 857 bp, Arabidopsis thaliana
tcatttctctctagtctatatcgctctcagaatacaattggaaaaaagaacaagggaagagaacacaaaaagaaatggttagagaagaggagaaatcgagatggtggtggttcgagagccacaagagctccaaacattctcaatggcttcaatcaacactcgctgagattgatgcaaagacaaaggcaatgttgaagttgttagacggaaacgcagactctttcgctcagcgtgctgagacttactacaagaaacgtcctgagcttatcagctttgtcgaagacttttatcgagctcaccgttccttagccgtgaacttcgaccacctcaagtcttccgaccactatggatctcgctccgctaaggttccccaacaatccatggagtccgtttgtgacagcaattctcactttgaagatgccgattctgagattgaagacccccttcaagatgatgcctccgcagctgattgcaaagaagatgagacttggcaattggaacaagaaaggttgaagctgatcgaagagactgatgctctgaggaaacagctcttagacaaggacgaagagaagagagaggtcatcagacagctttctctaacccttgagaccctcaaagacgagaacttgagcctcaagagacgccttgcccaccattctctcaagcaacgcaccgttttggagttcaagccactaaacaagttctttgggaagctgttttacattatgtgcgatggcaacaaggtcctttaggttggctcatctacctcatgagcttagcttcgatattttctgtggttcatttcactgtttatcaagatatatcctgtcctttccgtgctgtattataaccggtaa

SEQ ID NO: 208 - DNA, 1030 bp, Arabidopsis thaliana
cctccaaatttgctctataaatacacatttcccctcccttaccttctcttatattttccattggtatttcaaacttttaactactatatcacaacaaagtctctaaattgtggtgaaaaaagatcattgaacaacaacaatgagctattctcgtcaaagcatgggttctggtagtagaagtacaaggggctatgagtttggaaggacttatgttgtgaggcctaaaggaaagcaccaagctactattgtttggttgcacggtcttggagacaatggctccagctcgtctcagctattggaaagcctacctcttccaaacatcaaatggatttgtccaactgctccttcgcgtcctgtttcgcttctcggtggatttccttgcactgcctggtttgacgtgggagaaatttctgaggatcttcatgatgatatagaaggcttagatgcttcagctgcacatattgctaacctattatctgctgagccaacagatgtcaaagttgggataggaggtttcagtatgggtgcagcaatagctctctactccacgacgtgctacgctcttggacgttatggaaccggacatgcttatactataaacctacgagctactgtaggacttagcggttggcttcctggttggaggagcttaaggagcaaaatagaaagttcgaatgaggttgcaaggcgcgctgcatcgataccgatcttacttgcacatggaacttcggacgatgtagttccttatagatttggagaaaaatctgctcattcacttgccatggctggattccgacaaactatgttcaaaccatatgaagggcttggtcactatacggttcctaaagaaatggatgaggtggttcactggctcgtctcaaggcttggtctcgagggttcgcgttaaactttacaagcatcttctcagcatctctatagctattatacgatggtgtagaatatttatattatatatataaggggtggggggtttcttggggtatacggtgttctctcatgtttctactgt

SEQ ID NO: 209 - DNA, 1557 bp, Arabidopsis thaliana
ttcttagagcctcttgatccacactgactaatctcgtgtcagtgggttctggtggagtactccgatcccatcgccagaaaattcaacagaggatgcttgcttgcttcataggttctcatgtcgatactgtgttgtgttcctgtacttgaatgtgtgtactgcttgggttgtacccattggttgtggaagaaatgtttatactcagcaggtcacgagagtgagaattggggattagctacatctgatgagtttgagcctatccctaggatctgccgcttgatcttagccgtctatgaggagaatcttcatgaccctatgtgggcacctcctgatggttatgggattgatccaaatcatgttattctgaagaaagactatgaccagactgagggtcgtgtgacgccttacatgatctacttggatcatgagaatggtgatgtggtcttggctattagagggctgaatttagctaaggagtgtgattatgctgttcttcttgataacaaacttgggcagactaagtttgatggaggttatgtacataacgggttgttaaaggcggccatgtgggtttttgaagaggagcatgtggttctaagggaattactcgaggcaaacccgagctattccttgacgtttgttggacattcgttaggagcaggggttgtttctttgcttgtcttattcgtgattcagaaccgggttaggttggggaacattgagagaaagaggattagatgctttgctattgctcctccaagatgtatgtctctccatctagcagtgacatatgcagatgtcatcaactctgttgttctacaggatgatttcttacctcggactaccacagctctggagaatgtcttcaagtcaattatctgcttgccatgcttgttgtgtctcacatgtttgaaagatacattcacattcgaggagaggaagctcaaagatgcaaggcgtctatatgctcctggtaggttataccatatcgtcgtgcgcaagcccttgagattaggaagatatccacctgttgtgagaacagctgtcccagttgatgggagatttgagcagattgttctctcctgtaatgcaacagcggatcatgccatcatctggattgaaagggaatcacagagagctctcgatttaatggtggaagaggaccaagttatgcagattccggtggagcagaaaattgtacgccagaaatcaattgttgaggatcatgacgaagaatacagagcggctataatgaaagcagcttctctgaacatccccatgtctccatcgccgtcttatggaacattccatgatacagaagaaggagaaagctctgcaggatcaggcatggaaggatccccttccgggtggtccttcaaaggaatgagaagaaaatgggatcaattcatagattgccattttcctgtaaatgacaacagtgaacatatgatcttcaaaaatcaggaatctcaagctttgttgtgtggtcaagaaacatgaaaatcttgttataggtgtaaatgtagaaaataggatatagaatcagagaagcaaagt

SEQ ID NO: 210 - DNA, 1079 bp, Arabidopsis thaliana
gtcgactcttcatggatcatcaacatagctccgattcacctatgcatgaatccacaacttcttcttcttcttcttcatggagtttcggcaatctaatcaaaaccctatcgacaaaatccgaatctgtaatcggatcctaccgtcgcgatttggtcgaattcggatccgaattgaagaaagaaacctcaataatccgacgagtagcttcaagattacctgattctctcgaaattggcgcctccgtcgcttcggaatctctcgaatcggtaggtcaagttatcgacgatatcggcgccaccgtgtggaaatcaacggctaagattatttctcgtggtaaggaatctttagaaccgaatcgtgaccgtacaaatcaggttttgtcgttgaaaccttatcgtcgttttgagatgatgttacttgcgttacaatctgataaaggcacgtttgttagagaacctgatgatttaagtgattttgagaattggagtttagggttgaagttagaggagaaaaggaatgagattgttgagttgattaatgggaacaaaggtgttaaagagatctatgaggagattgttcctgttgaagttgatgctgagactttttggagaaggtattattataaagtttataagcttgagcaagtagaggaagctagggttaagcttgtgaagagagctatttctggtgaagaagatgaggatttaagctgggatcttgatgatgagaaggagaaggtagagagcagagatgtttcgtctaaggatagtgattattcggtgatttcgacacagccatcgttacttggtagtgaagatcttgggtgggataagatggaagaagatatcagaagcaatgaggagagattggattggcgaagacgggccggtgtagcggtggaggaagaagaggatttatcttgggatattgaagatgaagatgatgactctgttcaacaatagatagagtatacttgtgttacagaaaaggcaaagatttagtgtgatcatagttattaagtgtgatctatacctatacaacaattcttcgatttgtatagtactctgctttggaggggg

SEQ ID NO: 211 - DNA, 418 bp, Arabidopsis thaliana
cgtctctgaacctcttctctaagaacgaagaagaaaattgacaagtgcaaaaatggcgacggattgcaatagagtcaacgatttcttgttttctcagcagcaagagtctacttctggtgcaaataaatacggaggacttgtgccaaagaaaaagcctctcatctctaaggattccaaacgtgctttctttgattcagcagattgggctttactcaagcaagaagcaagtatagatcagagaacaatagcggcaatagaaaaactaagacccaaattgcagagaacgcctcgcaagcaactttctcctaggagacccacatgtgcgacgggaaatgagaatctgacagagtcgagcttttagggtacaatgaaaagggtttgacgtggaaatggaacgtgattggtttggtagcctact

SEQ ID NO: 212 - DNA, 2725 bp, Arabidopsis thaliana
aactgagccacaatgatgatacgatgatgatcctaaccgttggcgaggaatgagagactttgttattgtctttggctcctcctccgccataaccaatcctcaccatcaccaccgtcgctgttacgccacagcaccagagtccaaccggaaaactaaatccaattcttctttcaccaagctacttccgtcactaccgcagcaacattcaccttctcctgcttcagtctccgcgactcattctctctctagccacttctccaatgtcgtaagatggattccagatggctcgcttgagtattacgctgattttgcctcgaagctagctgaggatggtcgaattgaggacgtcgctctcatcgccgagactttggctgcagagtccggagctaatgtggctcgtttcgcttccatggttgattatgatctcttatcgaaagggatttcgtcgaatcttcgacaaggtaagattgagagcgtcgtttacactttgaagagaattgagaaggtaggaattgcgccattggaccttgtcgatgattcgtctgtgaaattaatgaggaaacagtttcgagcaatggctaactctgtgcaagtggagaaagctattgatctaatggagatacttgccggtctcggattcaaaatcaaagagttggtggatccttttgatgttgtaaagagttgtgttgacatttccgatcctcaattagctattagatacgcatgtcttttgccgcatacagagttattgctttgtagaattattcatggtttcggaaagaaaggagatatggtctctgttatgacagcatatgaagcctgcaaacagattttggatactcctaacatgtatatatgccgaacgatgatagatgtttgtggcctgtgtggtgattacgttaaatcgaggttcatatatgaggatcttctcaaagaaaacattaagccaaatatttatgttatgaacagtctaatgaatgttaattcccatgatcttgggtacacactaaaagtatacaagaatatgcagatacttgatgttacagctgacatgacatcctacaacatactactgaaaacatgttgcctggctggacgggttgatcttgcccaggatatatacaaagaagcaaaacgaatggaatcttccggattgttgaagttggacgcctttacatattgtactattataaaggtttttgcagatgcaaagatgtggaaatgggcactcaaagtcaaagatgatatgaaatctgttggtgtaaccccaaatactcatacatggtcatcattaatcagtgcatgtgccaatgcaggtttagtagagcaggcaaatcacctatttgaagaaatgcttgcatctggctgcgagcctaattctcaatgtttcaacatcctactgcatgcttgcgttgaagcttgccagtatgacagagcttttcgtctttttcaatcttggaaaggaagctccgttaatgaatccttatatgcagatgacatagttagtaaaggtcgcacttccagcccaaatatattgaaaaataatggtcctgggtctttggtgaatcgcaattctagttcaccttatatccaagcttcaaagagattttgcttcaagccaacaactgctacatataatatactcttgaaagcctgtggtactgattactatcgaggaaaagaattgatggatgagatgaagagcctaggtctttcacctaatcaaataacatggtcgactttgattgatatgtgtggaggttcaggcgatgtagaaggtgctgtacggattttgagaactatgcattcggctggaaccagacctgatgttgttgcatacacaacagcaatcaagatttgtgcggaaaataaatgtttgaagttggcattttctttgtttgaggagatgaggagatatcagattaagccaaactgggtgacatataatacacttcttaaagcacgaagcaaatatggttctttacttgaagtgcggcaatgcttggctatatatcaggacatgcgaaatgcagggtacaaacctaacgatcactttctcaaggaacttattgaggagtggtgcgaaggagtcatacaggaaaacggtcagagccaagataaaataagcgaccaagaaggagataacgcagggagacctgtaagcctactcattgaaaaagtagctacacacatgcaagagagaacagctggaaaccttgcaattgaccttcaaggacttaccaagattgaggcccgacttgttgttctagcagttttgcgaatgatcaaggaagactatatgcgaggtgacgttgtaatagatgatgtgttgattatcataggaaccgatgaagcaaataccgtttcaggaaagcaagagattactgtgcaagaagcgctagtgaagcttctacgagatgaattgtctcttgtggttcttcctgctggacaaagaaatatcatacaggatgcacattgtgtagatgatgcagaccaagagaacactaagtcatttgttagtatatcctcaacgaggagacctgcgattctggagaggttgatggttacaaaggcgtctctgtatcagtggttgcagcgcagaaagtagctgcctctgactgttacattactaatcagtcatcattgtattttatgctaattcaaaccatatgcagaaaagaatggggaaagattgcatatcatctcaatgcccatcatattgtat

SEQ ID NO: 213 - DNA, 1893 bp, Arabidopsis thaliana
tactagtgaccatccacctctccgtctatggcgtcagacgccgttaagtatatgccaatccacggcggaggaacaacagcaacaaccgccgccgacatcaagagcttcttctccgctctaaaacccaaaaaaacctcaactttcgcttacgctttcgtcataacctttgtctcattcactctcttctttgcttttagtccttctccaaactcatcttctccttggttctctaacatcttcacttcctcctccacaaccacaacttcagacaacacttccggatctcagttctcttcaattttctcatatattcttcccaatgtcacttcaaccaaacccaccaatagatccagtgacgccacagattctctctctgttaacgccacttctccacctctcaattcgaattccaaaaacggaactttacaaacaccggcgccggaaactcacactccggttgctaaaaacacaacctttgagtctccgatcgtaaacggaaccaacccagatgcaaagaacaacacttcatctcatcctctgctttcagacaaatcttcaacgacgggatcgaataatcagtcacggaccaccgccgatactgaaaccgtgaatagaaaccaaacaacatctccggcgccgtcgaaagcacccgtgtcggtagatctgaagaccaattccagttccaattcatcaactgcttcgtctacaccgaaaaagcagactaaaaccgttgatttggtttcgtcggtgaagcaagagatcgagaaatggagtgaatctttgaagaattgtgagttcttcgacggtgaatggatcaaagatgattcgtatccgctttataaacctggttcgtgtaatcttatcgatgaacagttcaattgtattaccaacggaagaccagacaaagatttccagaaattgaagtggaaacctaagaaatgtagtttaccaaggttaaatggagctatattgttggagatgcttagaggaagaagacttgtctttgtgggtgattcactaaataggaacatgtgggaatctctggtttgtattctcaaaggatcagtgaaagatgagactaaagtctatgaggctagaggaagacatcatttccgtggggaggctgagtactcattcgtcttccaagattataactgcacggtggagttctttgtttcacccttcttggttcaagagtgggaaattgtagacaagaaaggaacaaagaaggagactttaaggttggatttggttgggaagtcctctgagcagtacaaaggagctgatgttattgtctttaataccggacattggtggactcatgagaaaacatccaaaggggaggattattatcaagaaggaagtaatgtttatcatgaactcgctgttcttgaagcttttcgtaaagctttgactacatggggtcgatgggttgagaagaatgtgaatccggcaaagtccctcgttttctttcggggctattccgcatcccatttcagtggtgggcaatggaactcaggaggagcatgcgatagcgaaacagaaccgatcaagaacgatacatacctaaccccgtacccgtctaaaatgaaagtgcttgagaaagtgttaagaggtatgaaaacacctgtcacttatctaaacatcacgagattaacggactacaggaaggacggtcacccgtcagtataccggaaacagagcttatcggaaaaagagaaaaagtcgccattgctgtaccaagactgcagccattggtgcctccccggggttccagactcttggaatgaaatcctctacgctgagctgatcgtcaaactcaatcagctcagccaaacacaacgaaaaacttaaggttcttccacccccaatacttgtttgatctcaacatag

SEQ ID NO: 214 - DNA, 445 bp, Arabidopsis thaliana
gggtttcttctcccttcctacatcctctctcttctctttctctacactttcatctaatggccggcctgagatggagagagtggtggaacacgatggccttccccacccggcgtatctggaatcgtttcaccgttcgcgtcgggtttcgacacagcggacttttgaggttagaacatgacgtgagttcttgcgagtatgaagacatacacataatgtggaatttgttacacaagaatgaagatcttacacgcgtaccaatccaacaacaacaacaacagaggaagaaaccttgttggaatcttcttggttcgtatctttgccaaagattctgatccgttttatgatataaaccaaaccattgttgtatttgagagagccttgacgggtcccttgcagtgtggtgtggttttattgacaaatttcgcaaataatgaatccgaggttg

SEQ ID NO: 215 - DNA, 841 bp, Arabidopsis thaliana
tatcaatggcgaattcagagtcctcctcctcaccagtaaacgaagaagagaacagccagagaatctcaacactccatcaccaaaccatgccttccgatttaactcaagacgaattcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaaccggaacaacaacaacaacaactcttctcaggttaggtaatgatgaaatttgggggaaagaaaaatgtttctaaattgggggagttttaatttttattttgatttgtaaaacgttttttttcttctcttgaattgtaatttccttgtttgattttatggttatgttttattttttaaaaaaaatcagtctcctggataattggaatggtc

SEQ ID NO: 216 - DNA, 1396 bp, Arabidopsis thaliana
taagacagagacacaaaggcgagagctatgtcgtcgtcggtggatttcgtgacggaacaggggagatgcggcgacgatggtaacggcgccggagagacagtaaagaatggcgaaattgatcatttgctttccgaaccgtcggctccgactatttctctccctacggaatctttcctcagagcagcgacgttactcaagaaccaggttgtggaggccacgtggaaaggtggtgtcgaagctcttgcctctggttcgggtccagtgctggatccgactgtgtacacaggactactcggcacagcgttcacctgcttgaagtcgtacgaggtaacgcggaaccatcaagatctgctaacttgcgcagagataatcgacacgtgtgccaacgttgcgcgtgccacaaccaggcacgtgacatttttatgtggaagaggaggagtttgtacgcttggtgcaattgtagccaattacagaggggaccaatcaaagcgtgacttcttcctcggtctttttcttgagcttgcagaagagagagagttaccagcaggaccagaggaaggaggatttgggatgtcatatgaccttctctatggaagagcgggtttcctttgggctgctctgttcctaaaccgatatctcggccaaggaactgttcctgaccatctcttatcacccattgttgcagccatcttagccggtgggcgagttggagctgcagatcatgaagcttgtcctctgttatacaggtttcacggaacgcgattttggggtgctgcgaatggattagctggaatcttgtatgtattgctgcattttccactatcggaagaggatgttaaagatgttcaagggacattgaggtatatgatgagtaataggtttccgaacagcggaaactacccgtgcagcgaagggaatccgagggataagctagtccaatgggctcatggagcaaccggcatggccattactttggctaaagcatctcaggtgtttcccaaggaaagggatttccgcgaagcagccattgaagcaggagaagtagtgtggaagagtggcttggtgaagaaggtaggtttagctgatggagttgctggtaatgcctacgctttcttatccctttatcgcttaaccggagatgttgtatatgaagagagagcaaaagcgtttgcgagttacttgtgccgtgatgcgatagagctcgtgaatatgacaagccaagaaacagaacatgattattcgctattccggggactagctggaccagtatgcctctggttcgatcttgtgtcgccggtagattctaagtttcctggttatgagatataatttaaaaccaggtaaccgtaggttcttttatgactatctctttgtgaaaggatcttaggttctccgg

SEQ ID NO: 217 - DNA, 734 bp, Brassica juncea
agttacaattttctgtgttctttctgaagatgacaacaatagcaggaggatcatttggagctaccagctctcgtatctctatactcaccccaactctttcatcctcttctttgtttccaccactaacattgcatcagtcaggtaataaaaaggatagtcagttgcgttgtgccgtgcaagagtcttccacttctgctgttgctactgagaagaaagaaaaagaaaaagaaaaagaagactcaacattggaagttccagcaaagaaaccaaaaccggcagctgcgaaggcagccgtggcaaaacctctgagagaaatgatggaagaagacgtgattcctccgttaaaagccattcttgaagctcaagatgatatatctgagattgatttatctttccaagacgataagctcgaggggtttttcttcaagaaaggtattcagtattccttctgggccttcttccccacaggaaacctcacaggagcaaagggcttttcaatctcctcatacgggtcaggtccaagcacagtggagccatttctagtcgacgagaggaaaccaacagcaaaccacgttgtgttttgggtcgagaaacgccttgctgcacaagggattattcccgtttggaaccaataatgtaaaggatatggtgttttaattcacttatttataataaaacaattacatttgtatatcagaactgaagaaaatcgaagtccttcgtatctctcatag

SEQ ID NO: 218 - DNA, 713 bp, Brassica juncea
ctgcaatggcgtctcttcagcaaaccatgctctctctgcagtccaaacttcctccatcatctttccacatcgggggatctcttcccatgcgaaagacagccttaccgctccgaaccagaggcggaaacgccgcgggagcgagaatgtcagccacggcggcgggaagctacgcgatggctctcgcggacgtggcgaagaggaacgacacactcgaactgacgagcgcagacgtcgagaagctcgagaaggtcttctccgatccgcaggtgctcaacttcttcgcgaatccaaccgtcgagctcgagaagaagcgtctcgtgatcgacgagatcgtgaaatcgtccgctctccagagccacacctccaacttcctcaacatccttgtcgacgcgaatcgtatcaacatagtgagggacatcgtgaaggagttcgagatggtgtacaacaagataacggacacgcagctggcggaggttagatcggtggtgaagctggagccgccgcagcttgctcagatcgccaaacaggttcagaagctgaccggggcgaagaacgtgagggtgaagacggtgcttgatccgagcctcgtcgctgggtttacgattaggtacggtgattctgggtcgaagcttattgatatgagtgtgaagaagcagcttgaggatatcgctgctcagctagaactcggcgagattcagttagctgcatgataa

SEQ ID NO: 219 - DNA, 1550 bp, Brassica juncea
tctcgttaagtcctaggggaagcaagaagcatcatccaaaacatggaagaagtaacgtccacactactctttatcgttctaattactctcatcttcttcatcggaagaagcagaaccaagctaaagctcaaacttcctcctagtccacctttcgcgcttcctatcatcggtcacctccgcttactcaagccacctctccatcgtgttttccttgccctgtctcaatccctaggcggtgctcccatcttctccctccgtctcggcaaccgcctcgtgttcgttgtctcttcacactcaatcgcagaggaatgtttcacgaagaacgacgtcgtactagcgaaccggccacacaccgtcgcttccaaacacgtctcatacgactacacaaccatggtcacagctccgtacggcgaacactggagaaacctccgccgcatcggcgccgtcgaaatattctcggctcaccggctcagtaaatttctgtctatccgacaggacgaggtccggcggcttatagctcgtcttgcacggaactcttcacacgagtttgtcaaggtggagataaactcaatgttttctgacttaacattcaacaatatcatgcgaatggtggccggaaaacgttactacggagatgcttcagaggaaaactcggaggccaaactcgtaaggaagcttatcgcggacctgatgagtacttttggtgcaggaaatgtggctgattatgtacctgtcctgcgttgggtcacgggtttcgagaaacgggttaaagaactcgctggtaggtttgatgagttcttgcaaggattggttgatgaaagacgagcagctaaggagaaagggaacacgatgatcgatcacttgctttctctgcaagaaacacaacctgagtactacactgaccgcaccattaaaggaaccatactctcttcgattttggcggggactgatacatcagcggtaacattagaatgggcattgtcgagtctgctaaaccatccagaggaattgagcaaggcgagagaagaaatcgacagtaaagttggtttcaacaggcttgtagaggaatcagacatctccagccttccctgtcttcagaacattgtgtcagaaacatttcgtctataccctgcggcgcctttgatggtgcctcacgtcgcatcggaagactgtaaagtaggagtgtatgatatgccacgtggcacgacactattggtgaatctgtggcctatgcacagggatccccggctatgggatgatcccgaggctttcaagccagataggttcgagaaagaaggcgtggctcataaattaatgacgttcgggttaggaagaagggcgtgtcctggatccggattggctcaacggctggtgagcttgactctggcgtctttgattcaatgttttgaatgggacaggattggagaagaaggggtggatatgactgaagctggaggagtcacaatgcataaagctaagcctctggtagccatgtgtagagcacgtacctttgttggtaaaatccttcaccagaacgcttgataaatgta

SEQ ID NO: 220 - DNA, 2723 bp, Brassica rapa
aaaaaatgttttgtaaagagtcgtcgtcgggtctccagaccctgagcatagcaaagagcctcagctctccgttccataaaccatcaccactcatcaaccccatttggacaggacgtcgagacaagctgtgtcgtccccgaaacctcggtggacgatgtaaggtcacggcatcacagtcaaatagtgaaccgaaaggtaacataatgaaagaaaaagttaaaaaaatcaaagtaaagggatatatacaggccgaagaagggacggtgctggagggcctacgttggtcgagaggtctcgatgacatttcagatattgccggcagatcactgctcgttgagcttatttccgccgagactgacaaccggacgctgatggagaaggatccggtagaagactatgcacaacgtgtatggttcgatggcgaatcccctgatgagaagtacgagtgcgagtttaacatgcctgaagactttggaaccgtgggagctataaggatacaaaaccagcaccatcgagacatattcatcaaggagagggagcttgagttacccagcgggtccgttacgttttcatgccactcatgggtggcccccaagtccgttgacccagccaagaggatattcttctccagcaagtcctacataccttccgcaaccccagagccccttaagaagctgcggaaggaggagctggagaccttgcaaggcaacaaccgcaagaaggttggtgaattcgagaaacacgaacgcgtttatgactatgacgtgtacaacgatgtgggtgaccctgacaaaaatgacgaactcgcccgtcctgtcattggaggcctctctcatccgtacccgagacggtgcaagactggtcgcaaatccagcaaaaaagacccctccacggagaaacgcgaaggggacttctatgtccctagagacgaggagttctccacaaccaagggaacggcattcacaggcaaggccatcttggcagctcttccatccgtgttcacacagctcgagtctattctgctggatcccaaatctcccttcccacacttcaagtcaatagaagatctctttgacgttggcatcaatcttcccaaggatgctggccttttacctatgctccccaaacttattaaagttctttctgaagctcaagatgatcttctccagtttgatccccctattcttcttaacaaggatagattttcatggatccgagacgacgaatttgctcgccagacacttgcaggccttaacccctattgcattcagctagttacggagtggccgttgcaaagcaaactagaccctgcggtttatggtgatcccaactcactcattacttgggaaattgtggaaaaggaaattagaggagtcatgtcagttgatgaggctctaaagaataagagattgttcatgttggattatcacgacttgctactaccgtatgtgaacaaagtgagggagttggatgacaccatgttatatgcttctcgaacactattcttcctcagcgatgatagcacactaagacctgttgccattgagttgactcgtcccccagatgtcaacaggccccaatggaagcaggtcttcacgccaggttatgatgctacctcctgctggctatggaaacttgctaagactcacgttgttgctcatgacgccggttatcatcagcttatttcccactggctgaggactcattgctgtatggagccatacataatagcggcaaacagacaattaagtgccatgcatcctatctataggcttttgcatccccacttccgctacaccatggagatcaaagcaagtgcacgccaaagtctcgtcaacgcaggtggaatcattgagacttgtttctggccaggcaagtattccttagagctaagttcagatgtctatggtaaactatggaggttcgacaaggaaggtttacctgcagacctcatcaacagggggctggctgtggaagatgagaaggcggaacatggggtgcgactgacgataccagactacccattcgcgaatgacggtctaatgctgtgggatgcactaaaggaatggatcacagactatgtgaatcactattatccagatgcaggactgatcacgtcggatgaggaactccaagcatggtggagtgaagtgaagaacatagggcatggagacaaaaaagacgaaccatggtggcctgagctcaaaacacaagatgacttgattggcgtggcgactacgattgcgtgggtggcttcaggtcaccatgcagctgtaaactttggacagtacgggtacggagggtacttccccaaccgaccaaccacaacaaggagaagaatgccagtggaagagcctacagaggaagagctaaaagagttctacgaggagccagagaaggtgttgctgaagacattcccgtcgcagaagcaggcgacgcaagtgatggtgactctggatctactatcgacccattcaccagacgaagagtacttgggagaagagccagaagcatcttggatcgatgaacctgtcatctttgctgcatatgaacgattcaagggcaggctccaatatctagaaggagtgatagatgagaggaacgtgaatgtttctctaaagaacagagctggcgcaggtgttgtcaagtacgagcttttgaagcccatctctgagcccggttgtaccggaatgggtgttccctacagtgtctctatctaataa

SEQ ID NO: 221 - DNA, 1402 bp, Brachypodium distachyon
aacccatctccccttcctcatcctccgcgctccgccacgacgatgctcgccaccgcctccccgcacctccaagcggcggcgcgccgcctctcgctggcagcgctccccgcgcgcctgccccgctccgtgcgcctcccgcgcagcagcacgcggcaccccatccgccacgcgtcgctgcgcgcgtcgtcgtcggcggcggaggctaccccgtcggcgaaggacggggctgctggcgccgaggagctagggttcgaggagatgctgtccaggacgacgcggaggtactacatgctcggcgggaagggcggcgtcgggaagacgagctgcgcggcgtcgctcgccgtgcgcttcgccaacagcggccaccccaccctcgtcgtctccaccgaccccgcacactccctcagcgattcctttgcgcaggatttgactggcggggcgctcgcgcctgttgaaggcaccgattcgccactgtttgcgctcgagataaatcctgagaagtcccgtgaggagtttcggacactaaatcaaaagaatggaggaacgggggtaaaagatttcatggacggcatgggcctagggattcttgctgagcagcttggggaattaaaactgggggagttattggacacgccgccaccaggattggatgaagcaatagcaatttcaaaggttatacaatttctcgaagcaccggagtatagcatgtttagccgcattgtatttgacactgctcctacgggccatacgcttcggttattatccttaccagacttcttggatgcatccattgggaaaatcttgaagcttaggaacaagattgcttctgcaacatcagctattaaatcagtctttggacaagaagttcaacagcaggatgcagcaaacaaattggagcaactcagagaaaggatggtgaaggtgcgggagctctttcgtgacactgaatcgactgaatttataatcgttacaattccaacggtcatggcaatcagtgaatcctcaagattacattcttccttgcaaaaggaaagtgttcctgtaaggagactggttgttaaccaagttcttccaccttcgtcatcagactgtaaattttgtgctataaaaagaaaggatcaaacacgtgctttggatatgataaggagtgacccagagttgatggggttgaacataatgcaagcacctcttgtggacatggaaattagaggtgttcctgctctcaagtttctgggtgatatagtgtggaagtgaccttagtttagggaaaataggataactccaggcacctactggctagattatcactgttggcctgctatgctgttaaacctttaatccaatcgaagtgtcagcctgagcagatcttgagagctactgggtggaatgcaacttagcagat

SEQ ID NO: 222 - DNA, 509 bp, Brachypodium distachyon
aatccagacttgactcctcagctcactcaacaaggcaatggcaaacaacggcggcgctcgcaggcaggcgaccttcaccaagatcgacgagctccggccctccacccacggccacaatctcatcgtcaaggtgctcaactccaagcccatcaccttccagaggccgcagcccaggcagatgagggtcgccgagtgcctcgtcggtgacgaaaccggcgtcgtcgtcttcaccgcaaggaacgaacaagtggacgtaatgaaggcgggggcaattgttgaggtgaggaatgcaaaggtggacatgtacaaggggtcgatgcgcctggcggtggacaagtggggcatcgtgaaggctgcggaaagcccgtcggagctgacggtgaaggaggataacaacctgtctttgatcgagtttgagatgattaccctgatggtgtaatagtttttgtgtaggggaggagtcggcagcagaagcaattcgtgtcgagcaaagcaataagccaatcatt

SEQ ID NO: 223 - DNA, 1865 bp, Brachypodium distachyon
accttcctttgggttagggttccggctctgacggcggtgaagatgtctactcatgcgggggccgtggcgcgggagcagcgtaggtgaggcgtcgtcgcgcgtgctggattggaggaagagagcacggatggatccggacttctcgagggccagcggaggcccgagctacgaattcgccttcaactcggtcaacttctccgaccgggtcctgcggatcgagatcgtcgccggggacgacacagcgggggccaaaggtgccaccggcgagggatgctcgtccatcgccgactgggcacggcaccgcaagcgccgcagggaggagctacggcgagagaaagaatctggaaagcatatgttggacctaacaaacgtcaaagtcaaagcagaagaacctgatacctatgaggaaatcaacgaggagcctgtagctatgattgaagaatctccacctgatattggacaagatggtgaggatggaggaagcagtgactcatcctggaatatggagtgtaatagtgttttaagagtaaaatctatttatatcagctctgcaattctagctgcaaaaagtccttttttttacaagcttttttcaaatggcatgaaagaatctgatcagaggcacgcaacccttagaataactgcttcagaggaaaatgcccttatggagcttttaagctttatgtacagtggaaagttgacgacaaatcagccaacccttctgcttgacatcttgatgatttctgacaaatttgaagttgtttcttgcatgagacactgcagtcagttgctaagaagcttgcctatgaccacagaatctgcacttctctatcttgatctgccttccagcatttcaatggctgcagcagttcagccactcactgatgctgccaaggaattcctctccaacaagtacaaggatttaaccaagtttcaggatgaagccatgaacatcccccttgctgggatcgaagccattctgtggagtaatgaccttcaggtggcatcagaggatgcaatttatgactttgtgatcaaatgggctcgcgctcaatacccaaaattggaggaaaggcgtgaaatcttgggtacccgcttgctgccacttgttcggttctgtcatatgacctgcaggaagttgcggaaggtccttgcatgcaatgatctggatcatgagcaagcaactaaaagtgtgaccgatgcacttctgtacaaagctgatgcaccacatagacagcgcacgcttgctgcagatgtgttgacctgtaggaaatattgtgaacgagcttataaataccgtccacttaaggtggtggagtttgatcgaccatatccgcagtgcatagcgtacttggatctgaagcgtgaggagtgtacacggcttttcccgtctgggcggatatattcacaagcatttcatcttgctggacagggattcttcctctcagcacactgcaacatggatcagcaaagcgctttccactgctttggtctcttcttagggatgcaagagaaaggctcaacgagtgttaccgtggactatgagtttgctgcaaggacaaggccatcaggcgagttcgtcagcaagtacaaaggctactataccttcaccggtggaaaggcagttggttaccgaaatctatttgccatcccatggccatcatttatggctgatgacagcctctttttcatcaatggagtactgcacctgagagcagagttgaccataaagcaaccctaggtaatgcgtggtgtgctactaacttcgcatgtatgcttgctcatctccgaatttgtgcaatgatggggcttagggttgaatcttctgttgttcaaagcttgacgatgtctttacttgagcacca

SEQ ID NO: 224 - DNA, 1950 bp, Brachypodium distachyon
acctcgatgggccactgggccgaacccaccgcaattggccggatccctttacccccacgcagctccatggccagcggtgacccgttcgccgccgccggggacgtcaccggcgactcatcctcctccagtccaaccaccgcgcgtctgctggaagcactcgccgctctctcccaagtgttcgagtccggcgatcctgcctcctccggcgcagccaccgccgccgttgtagaaatattcggcggaagcgccgatgccgacgcgggaggcgatgccgcgcggcccgacacggctaacatggtctcagagcagctgctccgcgaggttcacgcgttcctctcgtgcccgtcctcgaaccagatggccatagacgccctctctctagagcttccgaaacctgtggcgaagttgggtgctaggatggggaattgccgggacattgccaagactatcattgagctcctcgtgtcaaattgcaacccaagagacatgctctccatcctctgtgaggcattagatacaccactagcatttaatgggtcagcatacttcgtccttatacttgatatgcttgcgagagtgcttattatgattcagaggagacatatcgagcaagtaaaggttgtacttcctgctgtccttcgagttatgcatgctattatatcagagtgtgatgaggaacatggaacaactgcggttgatctgttcaatgcagcactccaaatcggcaatgccattcaagaaatgtgcaaaacaatggttaaccacaagaaagaagagctatgtttgatacttggtctatactcccttcagaacatagcccttatatcagaaagcaaacatcagcatattctctctgcttgtggttcacttgttcttcagcatttcaaaattgttacattttgtggattcacctatttgggtcttttaactggtaatgaggtgacctcagccaccaacaaactctctaaagaagaagatgctgattttctgggctgcttctctttcaccgtggaaggcgcaagtcttctagctgtctggacctatatgcatgatgacatgtcaaaatatgctggggcagagttggaatctgcaattaaggaagttcaggacaactatatcaggaaatgggaagcaattaacatgtttagatatgtcttgtcctcagttaattacccatgggtaatcaaatcttatagtatagacttattgttgactctagttgatgaaaattgtattgaggaaaccaaggatcatgaagatttcctatattctactcaattttttgccacactcaaggccattgaaagcgtcatgatagctgccccagatccattgatgcggaagaaagcttttgctactttgaaaaaggttatttccgtggtgccatcctctcagagatttgatatcttacagtccctcataaagaatagtatgtttccctccttgactgcaattcacttggatctggtgaaaaacgaagttgtgagagagagtagtcgagctaaggacttgattgaatctgatcaatcacaagatgctggggattcaccacattgggcttctcaatcgcttgaattagtggagctgatcttgaggcctcctgaaggtggtcctccttgtcttcctgatcacagtgaacaggtattatctgctctgaaccttctcagattgatcctgataatagattcaagaggatccagatcactaaaactgttccgacaagagacgacacgaaaagtgtactcagagtggttgatcccactaagaccagttgttgcaggggttcagtcggaaatggagaaggacgacagcgagggtgcaaatcagatgatgtgcatgttaaatcctgttcaactggtgcttcaccgctgcattgagttggtggaggaaaagatgaaaggttcctaatgttttgaggtttcgctcatgttggtagtgttgagtcaatga

SEQ ID NO: 225 - DNA, 712 bp, Brassica napus
tgtgctaatggcttcttcagacgtagctcttctctcttctaggattcaatttcgttcatcctcgtccatccgttatgctcttccaacaatcttcaatctctcttcaccagctgcgagttcgtgcgcaaccaaatcgacccagtttcttaaacggcgtttgagagccaaatcgacgaacttttctctttcttcgttgcctcggagacggttcgtatgcagagctgcggagtacaagttcccggatccaatacccgaattcgccgaagctgagactaagaagttcagggaccatatggcaaagaaactatcaaagagggatctttttgaagactctgttgatgagattgtcggagtctgcactgagatcttcgagacgttcttgcggagcgagtatggaggacctggaacactcttggtcgtacccttcatcgacatggctgatactctcaatgaacgggaactgcctggaggtccacaagccgctcgtgcagctatcaaatgggctcaggatcatgtagacaaagattggaaggaatggaccggcactgattagtagcacctgaacctcaaatcatcaaaatatagttcagtactcatgtattgtctttgtaaaactgaattttgcagatttcagaattttattagttctcttcttatataaaatccttggtctcatcatttgtttcccaaggtgatcagtgtgtggttgagt

SEQ ID NO: 226 - DNA, 1134 bp, Brassica napus
catcatcttatcatctcccgtaacaaaaccaaaatgttcctcttaaagacatggagatcaaccgctttcgggatttatggctatatgaatttcaccaagactggtttcctagaccattcaaagaagttcaaacctgaagatatgcagatacaaatccaaggaaagaactgtgtggtcactggagctaactctggtattggttacgccgttgctgaaggtcttgcttcacgtggagcaactgtttacatggtgtgtcggaacaaggaaagaggagaggaggctctttctaagattcaaaactctacaggaaaccagaatgtctaccttgaagtttgtgatttgtcttctgttaatgatataaagtcatttgcttcgagttttgcttcaaaggatgttccggttcatgtgctggttaataacgccggtttgcttgagaacaaacgaacgactacacctgaaggattcgagttgaactacgcggtgaatgtacttgggacatacacaatgacagagctgatgcttccgctgttggagaaagcgtcgcctgactccaaagtcatcaccgtctcctctggtggaatgtacacgtcgccacttacaacagatcttcagtttagtggtgaaaagttcgatggagtgttacaatacgcacggaataaaagaatccaggtggctctgacagaaaaatgggctgataagtacaagaacaaaggcataggtttctactcaatgcaccctggctgggctgagacacctggtgtcgccaggagtttgcccagtttcaaagaatcgttctctggtaagcttagaacgagcgaagaaggagcagacacagttgtttggctagcacttcagcctaaagagaagctggtctctggtgcattctatttcgatagagcagaagcaccaaaacatctgacgcttgcaggtacaagcaagtctcatgaccttatagactctgtcattgacacactgcattccatggcagctcttgatccttaaaaactatatcttctacatgggttttttctcgagaataaatgtgatcgatctctggtaaatatcacaatggaataagattcaaatattaaactttcctattctttccttggaaagtattattgtgctggatga

SEQ ID NO: 227 - DNA, 2048 bp, Brassica napus
aaactcgagatccatcaaacaaacaccaccacatggctgcgcgtacactccactcgctatccacctcccctttgtttctccttcttcttctctccgccttgtctccaccgaccaaagctcagcaaccgtacgtcaacaaccaccagctagcctgtgagaaccgtgacttcgacaacataaccaacggcttcacctgtaacggcccacgctcatgccgctcctacctcactttctggtctctcccaccgtacaacactcccaactccatcgccacactcctcaacgcctccgccgccgagatccagaccctcaacaacctcacctccctaaccaccgtaatccccacccgtcgactcgtcgtcatcccgaccacctgctcctgctccggcggcggtggcttttaccagcacaacgctacttacagactctccggcgaaagacaggagacttacttctccatagccaacgacacctaccaagctctctccacgtgtcaagccatgatgtcgcagaacccttacggcgagaggaacctaaccgccgggctaaacctcctcgtccctctccgctgcgcttgccccaccgcgaaccaaaccgccgcggggttcagataccttcttacctacttggtcgcgcagggagacagcgtctccgccatcgccgagatgttcagaagctcaacacccgccgtgagctccggcaacgagctcacgtccgacaacatctacttcttcactccgcttctcgttcctctcaggacggaacctacaagaatcgtgattactccgccgtcgccgacgccgccggttgctactccgccgcagtcgccgccggtggatcctccgggggggtcttcttcttcacacaaatggatttacatcggagttggaatcggagccggtttgctcctcttgatctcaatcttatctctctacttctgttactacaaacgaagatccaaaacgtcgtcgttgatagaacagaacaagcttacggactcctcgaccaaacagtctcttccgacaacgtcaactaaccaatggtcgatcgccttatcaaactcctcagacacaacatcaggtctcaaatcagctatagagtcgttaactctctacagattcagcgatcttcagtcagcgacttcgaacttcagcgaggaaaacaagatcaaaggctcggtgtataaggcaacgatcaacggagatgacgcggcggtgaaggtgatcaaaggagacgtgtcttcctcagagatcagcctcttgaagaagctgaaccattccaacatcatccgtctctctggcttctgcatccgcgaaggagcctcgtaccttgtctacgagtactcggagaacggttcggttagcgattggcttcactcgtctaacaagaagaagtctttgacatggagacagcgagttgagatctgtcgggacatagctgaggcgttggactacttgcacaactacgtgacaccgcctcatatccacaagaacttggaatccaacaacgtgcttcttgactccaacttcaaagccaagatttcgaatttcggcgtagcgaggattcttgatgaaggtgatctcgatcttcagttgacaagacatgttgaaggaacacaaggctacttagctccggagtacgtcgagaacggagtcataactccgaagctggacgtgtttgcctttggagttgtggttcttgagcttctttcggggaaagaagcggtgacgacggtggataaggaggagaaggaagagatgttgttgtgtagagagataaacaatgtgcttggaggagagaatgtgagagagaagctgaaggagtttatggattcatctctaggggatgagtatcctttggagctggctttcaccatggctcagcttgctaagagctgtgtggcacctgatattaactcgcgaccgtctattgctcaggttctaaccacgctcttgatgatcgtctcgtcatctattgattgggagccttctcatgacctccttcatgattcgggatctcttggcaactagttattctaagaattcaaa

SEQ ID NO: 228 - DNA, 2677 bp, Brassica napus
cacttcgtctttcgaagctcacctccacattaatcaaataacaccatggcttaccgtttccctctacattcatcatctccacactctcgattcctctctccctcaaaccacccaaaaaccccgagatcccccagaaaacaccacacctcaatctcatgccaaaacacaaacgatcctcaagacgaagaaaaatccaaaatcaatctcctcgcaataccaatcacactcactctaatctccgcctcactaccccaaccctccctcgccgccgcaacgaagaagagaagccagaagaagaagcctcaagaagccttaacacccgaacagctcaaatcctggtccaaagacctccccgtagtctccaaacgcatcccctacacagaccttttaaccctaaagtcccaaggcaagctcaaacacgtcatcaagcctccatccttaaccctgcgcctaaaagcagagcccgtgctagtcgtcttagaagactcccacgtgctgaggaccgtgctgccgtcaatagacggtaacaaacggttttgggaacaatgggacgagttaaagctcgattcagtttgtgtaaacgcttactctcctcccgttaagaagccacctgtcccatctccttacttagggttcctatggagagtcccgtcttacatgctgacgctggccaagcccaagaaggagtctaaacgggccgcggagctgaaacggatgagagaggatttcaagaggcagaggaaggaggagatggagaggatgaacgaggagagcgaggcgatggagaaggcgatcaaggcgcagaagaagatgcaagagaggaagaagaggaaggcggttaggaagaagaagtacgaagagtctttactcgaggcgaggaggaactaccgcgacatgggccttatgtgggccagactggccgaggattcgaacgtcgcgactgctctcggactggtcttcttctacatcttctaccgcgtggtggtgctgaactacaggaagcagaagaaggattacgacgataggttgaagatcgagaaggcggaggcggaggagaggaagaagatgagggagttggagagggagatggaagggattgagttggatgatgaggaggaggagagtggcgagaagaatccttacctgcagatggcgaagcagttcatgaagtcaggggcgcgcgtgaggagagcgtcttcgaataggaggatgcctgagtatcttgagaggggtgttgatgtgaagttcacggacgttgcggggcttgggaagattcgtcttgagttggaggagattgttaagtttttcactcatggtgagatgtatcggaggagaggtgtcaagatcccaggtggtattctattatgtgggccacctggggtgggaaagacattactggctaaagctgtagctggggaagctggagtgaacttcttctctatatctgcttctcagtttgttgagatatacgttggtgttggtgcgtctcgtgtacgagctttgtatcaggaagctagagacaatgctccatctgtggttttcattgatgagttggatgctgttggaagagagcgtggtttgataaagggatctggaggacaagaaagggatgccactcttaatcagctccttgtgtctttagatggttttgaaggaagaggagaggtgattaccatcgcttccacgaatagaccggacattctagatcctgcgcttgtgaggcctggaaggttcgaccgcaaaatcttcattcctaagcctggtcttatcggacggatggagattctacaggttcatgctcgtaagaagccgatggctgaagatttggactatatggcagttgctagcatgacagatggcatggttggagcagagcttgctaatatcgttgagatcgcggctatcaatatgatgcgtgatggaagaactgagttaacaacagatgatttgcttcaagctgcacaaatagaagaaagaggaatgttagatagaaaagataggagctctgagacgtggagacaagttgctataaacgaagctgctatggctgttgtcgcagtgaacttccctgatctcaagaatatcgaatttctgacaatcaaccctagagctggtagagaattgggttatgtccgtgtgaagatggatcacatcaaattcaaagaaggcatgcttagccgacaatctctcttggatcacataactgttcagctagcacctcgtgctgcagatgaagtatggtacggtgaggatcagttaagtaccatatgggctgaaacatcggataacgcaaggtcagctgctagatcacttgttcttggtggtctctctgagaagcatcatggcttgaataacttctggatggctgatcgaattaacgatattgacgtggaggcgttgcggataatgaacatgtgttacgaccgtgctaaagagattctccaaaagaaccggacgctcatggacgaagtggtagataaactggttcagaagaaaagtctttcgaaacaagagttcttcactcttgttgagctctatggctctattaaaccaatgccaccaagcattcttgaactcaggaaaatcaaacggctccagctccaagaggccgtgatgaaacaggacatgactagtgcaaggaacagttgataagatgatttgtggcaaacgtagacct

SEQ ID NO: 229 - DNA, 782 bp, Brassica napus
ctagtaatggctatcgcacgtctaactctagctcctctcctcctcatcgccgccgtgattctctcaacggagacatcagctcagccggcagcacccgctccaggccctgctggtcctataaacctcacggcaatcctcgaaaaaggcggtcaattcactaccttcatccatcttttgaaaatcactcaagttggggaacaagtgaacattcaagtcaacagttcatccgaaggcatgaccgtgttcgcgccaacggacaatgctttccaaaacctcaaggccggaactctaaacaagttgagcgcagacgaacaagtcaaactcattctctaccacgttagccctaaattctacactttggacgatctcctctccgtaagtaacccggttaggactcaagcttccggccgtgacaacggtgtttacggtcttaacttcaccggtgaagctaaccaagtcaatgtctcaacgggttacgtggagacacgtgtcagcaacgcgttgagatcacaacgtcctctcgcggtatatgttgtggacatggttttgttgcctggtgagatgttcggagagcacaagctttccccgattgctcctgccccgaaatctccgaccactggggtttccgatgatgacaccaagtctaactcaagtaaaaaggctgcagcgccggcagataagtcagcatctggtgagaggagagttggacttgggtttggttttggacttgttgtcttatgtttgaagtttctcttttgaatattgtgatcgttgccttgtat

SEQ ID NO: 230 - DNA, 801 bp, Brassica napus
aaagtcgacgcatcatttgaagttggtagtccaatggcggcagcaaaggcaggtctagtcccgtggattatcccatcatcctcggcggcgacttcttctccgctgttttcagctgctgttaagttgcccctgagagggaggaaagcagagaaggatgtatctgtctctgtcgccttcaatccttctggcaatttcgacatctcagccttcgactctcacgacgatacagataaagtggaacctccgatgcctccaacgagcggcagatacgaagtagtcatagacaacgactcaattcagcggcttgacttatcgccctttcagaccgccaccggcattacctcgccttcctcagctgatccaagagagtatctggatcggagcatcggattcacgatcaattacaggagagaagacgcaggggatccgcgtgagctttcggagtatccggacataaggctgtggttcgtgaggctggatgccacgtacccttggcttcctctccttctagactggagagccggagagcttgctcgttacgccgccatgctggtccctcaccagatgagcttgagaatgggtgttgttttcaatcccgaggccttggagctgttcgtcatgagcaaagtgtttgtcgtttatccatggctcaaacgtcacgctgtccccaagccccggctcaagacctccgacatggccaggatgctcggcttcggtatcggcgaccagctcttcgacttgatcgatcaatacgatcattatcaaacaaccaccgattctctttaggcctaggaattcaaa

SEQ ID NO: 231 - DNA, 1330 bp, Brassica napus
tccttccgagtttgctttcttcaatatggctcctctacccatttcttcgattagagttgggaaaatagatgatgttcaagaattaataaaatcaaaaccaaacaaagttccagagaggttcataagagaagccaatgagagaggtgtcttagtgtctcataagactcaccttcatcatcatattcctgttgttgatctctctaaactgtcgaaacctcacactgatgatgattttctctttgagattcttaagctctcacaagcttgtgaagactggggatttttccaggttataaatcatgggattgaagtgggtgtggtggaagatatagagaaggtggcgaaggagttcttcgagatgccactggaggagaagaagaagtatccaatggagccagggaccgtacaaggttacggtcaagctttcatcttctctgaagatcagaagcttgattggtgcaacatgtttgctcttggtgttcatcctccttctattcgtaaccccaaactatggccttctaaaccggcccggttcagtgaaaatcttgaaggttactcaaaagagataaggaaattatgcaagaggttgttgaagtacatagcaataagcttggatctaaaggaagagagatttgaagaaatgtttggggaagcagtgcaagcagtaaggatgaactattacccaccatgttcacgtcctgatcttgtcatgggactcagcccacattctgatggaagtgctctcactgttcttcaacagagcaagaacagctgtgttgggcttcagatcctcaaggacaacacttgggtccctgtactacctcttccaaatgcccttgtcattaacattggtgatacagttgaggtgctaactaatgggaagtacaagagtgtagagcatagagcagtgacaaatagagaaagggagaggcttacaatagtgacattctatgcacccaactacgaggttaaaatagaaccaatgggtgaattggttgatgatgaaaccaacccatgcaagtatagaagctacaatcatggtgactatagttatcactatgtctccaacaagctccaaggcaagaagtcacttgattttgccaagattctcaattaactatattactttcacacccctttcaccttccattaactaccacttaatttgttttatttttaagaatttagttgtgggactcttgtgtgtatgatgtacaggaatgtttcccacttaggggttttagtgtcatgattaaattccccagtgtaactacaacttgtaatatattatgtgtgtgtgtgggtggagttgggtgtgtttatgtatcca

SEQ ID NO: 232 - DNA, 1020 bp, Gossypium hirsutum
ctccaattcaagataacccatccctcccttctttttcactaatccaaaaccctttttctttctccagtttcctcattcatttccatttctcaacacaaattttcatcacccatcaagcttttcatcaatggcttcccttcaacaagcttcaatctctcttcaacccaagcttctttcatcttctcaacaccccagatcccttccctctctcaacctctctttttcagccactttcccttccctcaaactctgcaccactcgccctcttcatggcggtgccaaaatgtcagcctccgccgcttccagctacgccaccgctttagccgatgtagccaagtccaacaacacccttgatgccaccagctccgacgttgaaaaggtcgagaaaatcttctccgacccacaagtcctccagttcttcaccaaccccaccattgatgtcctcaaaaaacgtcaggttttggatgagattgttagctcctccgagcttcagccgcacacggcgaattttttgaacatcctggttgatgccaagaggattgatcttatcaaagaaatcgtgaaagagttcgagttggtttacaatgagctgacggatacagagctggcggtggtgagttcagtggtgaaattggagtctcaacatttggcacagattgctaaacaggtacagaagctgactggtgctaagaatgttaggattaaaactatgattgacccaagtttggtagctgggtttactatcaggtatgggagttcagggtctaaattgattgatatgagtgttaagaagcaattggaagagattgctgctcagcttgatttgggtgatattcaacttgctgtatgagttttgaattctttttttccctttttgagaattgggtttgaaacttttttggttattattgtaattgaaataagtacttttaatgttaattgtatgaaatttgtgtatgatgagattgtttgatatgggagaaagtgatagtggtttgggatatttcattaggaagggct

SEQ ID NO: 233 - DNA, 2117 bp, Gossypium hirsutum
ccacaatggttaggttttcctgcttcaatgctcatatcggaagtcagaaaccaaagaaaactgttcagccatctgttgaagcaatgcatacaactatagaagatttttctcaagttcaagcccctaaggagttgactaaagctgcaaacatggactcattctttccagagacacaaacaactgctgagattcatgaaagtgttgaacctgttacggtttcttcttctcctaaccctagctggaaatcagaggacataaaagacggagtcattcttgatagcagttccagggtccttcagaatccgcattatcttaagaagtgtagatctctcggaagtggcctttgcctggaaggacgagttcctggacaaaatgatacagatgatcagactgatcaaggattttcatctgattcccatgaccatgggttggttgaagatggcagcaagcatatagcagtgagccaaaatgcttcattctcagaatctgttcaagtaagctctaaccatgtctataacgaaccggttttctctataggagactctctacttccagaaaaggatggccatgatatctctaatttgcctttgccttgtgagcgtgccaatgcctctggtgatcattctcccaataatgcacctgtgattgtaaaatcatgttctatgccgaatattgttgcatcagcactcctttttggaggacattctcctccaaaatgtttggcacgccgtacaagatcctctgaggatgtgcatgttctcagcatgagacaaaaggagaccttaattcatgatgttgatactgaggtgatgcgagaacaagaaagagacgatggcatgcataaaaatcataaaactaactttgaaagttcttatgagggatttgaatcttatagttgttccgcatcagcgaaagactggatagtgccagtttcagatgaggtaagttcaatgaaaatgctgcaagaagaattgcgggttctgaatcggaatgaattgactggcaaggattttaagattaagcgaattgaggattgggtaaatggtcttcaacatgtccgcccatcagaagactcaattgaattatcccatcccaatgatcaggtaaaagcggaacctgctgtctataatgatttgactgctgcaaaggtggatgttaaggtaactcctggcatggaagctgcaaaaagatatatatcttctttgagtgcctcagcaaccacagctcaactggcaaatcatggtttggttgttataccgtttcttagtgcatttgtcagcttgaaggtacttaatctatcaggaaatgcaatagcaaggattactgctggtgctcttcctcgaggacttcacatgttgaatctgtcaaggaataatatatccaccattgagggtttacgtgagcttactcgacttcgtgtgctgaatctgagctacaatcggatatttagaattggtcatggtttggcttcttgttcctctcttaaagagttatacttggctggaaacaagataagtgaggtagagggtctccatcgtctcttaaaattgactgttttggatctgcgtttcaacaaaatctctactgccaaatgtcttggccaacttgcagcaaactataattccttgcaagccattggcttggaaggtaaccctgcacagaagaatgttggagatgaaaatctgaagaagcatttgcaagggcttcttccaaatttggtttactttaaccggcaggctattaaagtcagcacagtgaaggatggtgcagaacgatcagttaggctaggcatcagtgcccatcaatttgatcgtggccttagatcagaacacagagctactaggaagaacagccatggtacttctattcaccggccatcctcttcatccactcgtggtcacaaaagccaagtggcttccccaatgcagtcaagaggcaggcatgggcgctatcctcctagtggagcgaaggcaacaaataatcgtcaaaatcatcatgtagatcttggtagcaaagttctcaactttaaatcagagctttctatgcgaaggacccaaagcgagggaactctggggcttctatgaagtagagttactttgatgagtggaatctggtaa

SEQ ID NO: 234 - DNA, 1067 bp, Lotus japonicus
tgaacatggcttcttcttcttttgtcacccttcttctgatctctagctttctttcattttcccacatcagagtgtctgaagcagccacagctcctattgtgaagggactatcatggaccttctacgattcaagttgccccaagcttgaatccatcatcagaaaagagctcaagaaggtcttcgacaaggatattgctcaagctgctggtttgcttcgtcttcacttccatgactgctttgttcagggttgtgatgcatcagtactattggatggatcagcaagtgggccaagtgagaaagatgcacctcccaacttgactttgagagcccaggcctttaagatcattgaagaccttcgcagtcaaattgagaagaagtgtggaagagtcgtgtcctgtgccgacatcaccgccatcgccgcacgagatgctgttttcctctcagggggaccagactatgaactccccttaggaaggagagatggattaaacttcgccacaaggaatgtcaccttggataacctcccagcaccccaaagcaacaccaccaccatcctcaactcactcgccaccaaaaacctcgacccgaccgacgtggtatccctctctggcggccacaccatcggcatcagccactgctcttccttcaccgaccgcctctacccatccaaagaccccgtcatggaccaaaccttcgaaaaaaatctcaagctcacctgccccgccagtaacacggacaacaccaccgtgctggaccttcgcagccccaacacgttcgacaacaagtactacgtcgacctcatgaaccgccagggtctcttcttctccgaccaggacttgtacactgacaagaggaccaaggacattgttaccagctttgcagtgaaccagagtttgtttttcgagaagtttgtggtggcgatgctaaagatggggcagctgaacgtgttgacagggagtcaaggggagattcgtgctaattgctctgtgaggaatgcggataagaagaagagtttcttgactactgtggtggaagaagtggtggaagagttgatagaaatgtaataa

SEQ ID NO: 235 - DNA, 806 bp, Medicago truncatula
ccaccatgtccgcgatcgcacggctgagagcgatttcaccgtcgctgaaaaccctcaaccgtccattcggatctgcagctgcgcttcaatacagctacgacgacgacgaagatgaagatttgaactataacgcgccacgtggcatgcttgacacggaaggttcagccccagaacgtggtattcagtgggttatgattggtgaacctggtgctaagagacatgttttcgctgaaagactctcgaagcttctagaagttcctcacatttctatggcttcgcttcttcatcaagaacttaaccctcgttcttctctttatcagcagatagcgggtgccttggatcatggaaaaattgtacctgaggaaatcatttttgctctattatcgaagaggctggaagatggatacgatagaggtgaaactggattcattcttgatggaattcctcgaacaagaatgcaagctgaaattctcaatcacgttgctcatgttgatctagtggtaaatttcaaatgtccgcaagaggaattaatgaaaaataaactaggacttcgaaaatttacttcgtgccaagaacatatttttaagaccagttcttggaccccaaccaagcaatcgcaggatgaatatgtccagaaacgtgcagaagagtccaagatgttggaagattactacaggaagcagaagaaacttctgaatttcgaagtagctggtggacagggagaaacctggcagggacttcttgctgcactgcatctccagcatattaatgctcttagttcttctcagaagttgactgcctgatga

SEQ ID NO: 236 - DNA, 1169 bp, Medicago truncatula
cacataaaaaatggcttcagcttccaccaccattacctcctccttcctctcaaccccttcttctctcacagaaaaaccctcttcattcaaccaaaccctaagcctcggttacaaaccaagacactccgtctccgtttccgcatcagctgcaccttcaccaccaccttcctatgatctcaacgccttcaaatttgctccgatcaaggagtcaattgtggcacgtgagatgactcgtaggtacatgacggacatggtgactcatgccgataccgacgtcgtcatcgttggtgctggttctgctggtttgtcatgtgcttatgagcttagcaagaatcctaacgtcaagatcgctatcattgagcaatctgtgagtccaggtggtggtgcttggctcggtggccaactcttctctgcaatggttgtgcgtaagccagcacatcatttcttggacgagcttgaaattgagtatgacgagcaggacgactatgtagtgatcaagcacgctgctctcttcacttctaccatcatgagcaagctactagcaaggccaaacgtgaagcttttcaatgctgtagctgccgaggatttgattgtgaagaatggaaaagttggtggtgttgtcactaactgggctttggtttcaatgaaccatgacactcaatcctgcatggacccaaatgttatggagtctaaagtggtggtgagttcttgtggccatgacggtccttttggagccactggtgtgaagaggctcaagagtattggtttgattgataccgtgcccggaatgaaggcccttgacatgaacactgctgaggatgctattgttaggctcactagggaggttgttcctggaatgattgttactggcatggaagttgctgagattgatggtgctccaagaatgggtccaacatttggagcaatgatgatttcaggacagaaggcagctcatttggccttgagagcactgggacttcctaatgctgtggatcatgcaggaaacattcaccctgagcttgtcctggctgctgctgattctgctgaagttgcagaagcttaattattgttaccatattaactatttagttaatagtatctaagtgctagtagccagaaataaaactttgtctttgttgtttgttagtagtgattatgggcaggttgat

SEQ ID NO: 237 - DNA, 1901 bp, Medicago truncatula
gcacgttagcaaactctcttcaatacctatactataaaaaccgcttgtaaaatttcctcatttctctctttctcttcactcctcactcttcaaaaatggcggccttaacttcctcatgctccaccgcgatctccgcctcttccaaaaccctaacaaagccaaccaccacaagcttcgccgctgctaatctctcattttcgaagctttatcctcagtcagttaaagctcgcagatgtatcgctgtcggcggtgcagtcggtgctcgtatggtgtcggctcctcctgccactcttccggcgaaacttgatttcgaaacttctattttcaagaaggagagagttaacctcgctggacacgaagagttcatcgtgaaaggtggaagggacttgtttcatttgttgcctgattctttcaaggggattaagcagattggtgtcattggatggggttcacagggacctgctcaagcacagaatctacgggactcacttgctgaagctaagtctgatattgttgttaagattggactaaggaaaggttctcgatcctttaatgaggctcgggaagctggatttactgaggagagtggaactctaggtgacatatgggaaacaatatcaggcagtgatcttgttttgttgttaatttctgactctgcacaggctgataattatgaaaaaatattttcccacatgaagccgaacagtatacttgggctgtcccatggttttcttcttgggcatttacagtctgttggacttgattttccaaaacacttcagtgtaattgccgtgtgtccaaaggggatgggtccatcagtgaggaggttgtatgtacaaggcaaagagataaatggtgctggaattaattccagttttgctgtccaccaggatgtggatggcagggctactgatgttgctttgggatggtctgttgcccttggctctcctttcacatttgccactacattagagcaggaatacaaaagtgacatctttggggagagaggcattttactcggtgctgttcatggaattgttgaatccttgtttaggaggtacactgaaaatggaatgagtgaagatctggcttataagaacactgtcgagtccattacaggagttatttctaaaaccatctcaactaagggtatgttggctgtatacaatgctttatctgaagatggaaagagggaatttgagaaagcatacagtgcttccttttatccctgcatggacattttgtatgagtgctatgaagatgtagccagtggtagtgagattcgtagtgttgttttggctggtcgtcgcttttacgagaaagagggtctgcctgcatttcccatgggcaaaattgatcagacccggatgtggaaggtcggtgaagttgttcgctccacaaggccagcaggtgatctaggtcctctatatccatttactgctggtgtctttgtggcgttgatgatggcccagattgagatcttgaggaagaaaggacattcttactctgaaatcattaatgagagtgtgatcgaatcagttgattctttgaatccattcatgcatgctcgtggtgtttctttcatggttgacaactgttcaaccacagcaaggttaggttcaaggaaatgggcccccagatttgattacatcctaactcagcaggctttggtggcagtggacaatggagctcctatcaaccaggacttaatcagcaacttcatgtcagacccagtgcacggagccattgaagtttgtgctgaactgagacccacattagacatttcagtgccagcagatgcagactttgtccgtcccgagttgcgccagtctaactagaacatgaaccaattattgcctttcttgagttgatttcctttcagtaatcgctcaaagtagcag

SEQ ID NO: 238 - DNA, 1227 bp, Medicago truncatula
atcgccaccttacccttatcttcttccgatggccaccgtcctccgaactcccacattccggccatccccaacccttctcaccaccgccgccacatcttccaatcactccagaacctcacgcgtttccgtcgcatcctccagaagaagaccttcaccacttaaatcccaccggttcagttcaattcccaccctccggttcgcgaagttagtaccatttgcttttgacggagataccgaggcaccgcaagttcaagattcacctgaggttcaggttctggactctacagatggtgctgctgatgtggaggagagtacaggcgatgatgaggtcagcgacgctggtgaaatacctgcttcacctctgatagtattacttcagtcatacaaagaagcattagctaataatgattcagtcaaagttgctgagttggaatcatcattaaaatccattgatgatgagatagtaggtcttgaagggaaaatagcttccttatccgaagagttatcaatagaaaaagatcgaaaactaaggatcggtgcagattttgacaattatcggaagagaaccgatagagaccgcctttcactggtcacaaatgctcaaggggaagttgtggagagtttgttgcctgtattggataattttgagagagctaaagctcagatcaaggtggagacagagggagaggagaaaataaacaacagctatcaaagcatatataagcagttcattgaaattctaaactcacttggagttgagccagtggatacggttggaaatccctttgatccaatgctacatgaagcaattatgcgtgaggattctgatgaatttgaagatggtatcatacttcaagaattcagaaagggttttaaacttggtgaccgcctcttacgtccatcaatggtgaaggtatcagctggtccaggacctgcaaagccggaacaagaagtaccacaggaagaagaagtcaccaatgaaacttcccaggacagtaaagataatgatggcaacacagaaacagagtctgcttgaaaggacaactttgcctggattcagttttgtacaagtatatctatcggtttaatctccaggaacgtaattatgggtgttacagttgctcaagaaatattgcttccaagtttccttttaagggggaattagtattatgggattttgaattatgatttcagatttttatgcccttgcattgctttggtagagat

SEQ ID NO: 239 - DNA, 2799 bp, Medicago truncatula
cgattcatggccctaacaaaagaattcatgggttcttcattggtagagagaccaatatttccttcttcttcaccatgttttcaacagaagaatggtagtttcttgatcagtcctgtttttgttccttatggaaacaaaagagttgtcaggttgagaaaatctgcaaagttccctgttgcagctatcagtgaagatttgatgaaaagctcttcttcatcttcttctatatcatcatcttcttcttctgttcctgctgagaaaccagtgaaatttaaggttagagctgttgtgacagtgaggaacaagatcaaagaggatttcaaagagacttttgtgaaacatcttgatgcttttactgataggattggacgaaatgttgttcttgaactttttagcactgagattgatccaaaaacaaacgctgcaaagaagaccaatgaagcagtgttgaaggattggtcaaagaagactaatattaaagctgagagagttaattacacagctgaatttacggttgattcaaattttggagaaccaggagcaattactgtgataaataatcatcaacaagagttttacttagaaaatataacaattgaaggatttgcaactggagcatttcattttccttgcaattcttgggttcaagccagaaaagatcttcctggaaagagaattttcttttctaataagccttatctacccgatgatacacctgctgggattaaacttttgagggagaaagacctgaaaaatctgagaggtgatggaaaaggagttagaaaattatctgacagaatttatgattatgacacatacaatgatcttggaaacccagatagaggaattgatcttgctagaccaactcttggcggatctgaaatgtatccataccctagacggtgtcgtactggccgtgaaccatctgatacagatattacttgtgagagtcgtgtggagaagccacttcctatgtatataccaagagatgaaagatttgaggaatcaaaaatgaacacattttcagtgaagaggctaaaaggagtgcttcataacttgcttcctggccttaaatcaagtctttctgctcaaaacaaagatttcaacgaattctcagatgttgatggcctttatagtgttggactactcattaagttaggtttgcaagatgatattttgaagaaacttccattgcctcacattgttagcaagatccaagaatccaccagccagggtatccttaagtatgacattcccaagattatatcaaaggataaatttgcttggttgagagatgatgaatttgctcgtcaagcaatagctggagttaatcctgttaccattgagagacttacagttttcccacctgttagtaaattagatcctgaaatctatggtccacaagagtctgctcttaaaaaagagcacattttaaatcaacttaatggcatgaccgtccaagaggctatagatcaaaataagttgtttataattgattatcatgatatctaccttccatttttggaaaggatcaatgccttagatggtagaaaatcatatgccacacgtaccatatactacttgacaccacttggtactctaaagcctgttgctattgaacttagcctgcctccatctggaccaaatactcgatcaaaacgtgtagttacacctgctttagatgctactactaattggatgtggatgcttgcaaaagctcatgtttgctccaatgatgctggtgtgcaccaacttgcccaccattggctacgtacacatgcttgcatggaaccatttatattgtctgctcataggcaattaagtgcaatgcatccaattttcaagttattggatccacacatgaggtacactttggagatcaatgctttagctcgacagagcttgatcaatgcagatggtgtcattgagtcttgcttcactcctggtcgatatgcaatggagattagttctgctgcttacaaaaccaactggcgttttgaccaggatagcctccctcaagatctcatccgcaggggaatggcagtacctgaccccacacaaccacatgggctaaagctaataatgaaagattacccttatgcagaagatggtcttctaatttggtcagcaatagaaaattgggttcgcacctatgtgaactattactacccaaatccaagcctaataatcaatgacagagagttacaagcttggtactccgaatcaatcaatgtaggccacgccgatatgaaagacgaatcatggtggccgagattgaacgacagtgacaatcttgtccaagtcctaacaatcttaatttggaatgcatccgcgcaacatgctgcacttaattttggacagtacccttatggaggttacgtgccaaatcgtcccccgttgatgagaagattaattccagaagagaatgaccctgaatatacaagtttcatatctgatccacaaaagtattttctcaatgcattgcctagtttgttgcaagctacaaaatatatggctgttgtggacacgctttcgactcattcgtctgacgaagagtatttaggtgagaggcaacagccttcgatttggacgggtgatgctgagattgtcgaagcattttatcaattctctgctgaaattggaaagattgagaaggtgattgatagtaggaattgtgataggaatttgaggaaccgttgcggtgccggtgttttgccttatgaattacttgctcccagttctggacctggtgttacatgcagaggggttccaaatagtgtgtccacatagtagaggcct

SEQ ID NO: 240 - DNA, 377 bp, Medicago truncatula
acatctacttccaatttccgtggttcttcaaaattccaaagcaaaatcacagaaatggcgtggcgttctggatctctctcgcggtctattttctccgccgcaagatcaataccaactcgttcctctcttcaacattcttctacttcttccattcgttctcatcttcttcaacctcgccgcccccttgttactgtccctagggctttgggtattctcggttgcacgcagtcgttgatgccgttgcataacgccgatgccgctgcgcgcctcacttctcacgtttcagttgaattgcgcgcttgctgcgagctgtctcagggtacttgaattgattttacatttatcagcactggttgtgcctacatctatggttgtag

SEQ ID NO: 241 - DNA, 733 bp, Medicago truncatula
atagaccgaagcaaattctctcttcgccattcgattccccacccaaatcctcaaaccaaaaccctaaccctaattcttcaaatccgcaacaatggtgtgcatacgcaaagcaaccgtaaacgacctactcgcgatgcaagcgtgcaatctcttctgcttaccagagaattaccagatgaagtattatctctaccatatcctttcatggccgcagcttctttacgttgcggaagattacaacggacgtattgttgggtatgttcttgcgaagatggaagaggagacgaatgagtgtcatggtcatattacttctcttgctgtgctcaggactcataggaagttggggattgctactaagcttatgactgctgcgcagaatgctatggaacaggtgtttggtgctgagtacgtgtcgctgcacgtcaggaagagtaaccgtgcagcttttaatctgtacacagagaccttggggtacaagattcatgatgtagaggctaagtattatgctgatggtgaggatgcttacgacatgaggaagcaactcaaggggaagacgatacatccaccacagcatcatcatcaccaccaccaccatggtggtggttgttgttctggggagacaaaggggaatgctaaagcctgattatgagagcaatatcccctcatatttttgctggtttattgaatgtgtttgttgaatagtttgatattgacgagatggtaatatgttgcc

SEQ ID NO: 242 - DNA, 1947 bp, Medicago truncatula
cgaataatgggtagacgccatggatgggaactcccttttcacacttttcaggtcgtggctattacggtttttttcttgctatgcattgcatattatgccttctttgctccttttcttggaaaggacatctttgaattcgtcgcttttggtgtttactctctactggcactttctgtattctttctatatgttcgatgcactgccattgaccccgctgatctaggagtaatgattgattgcgataaaacatccaagaatagatcaaaacttgatgaagagttggcagaacccagcaagacaaggctaaaggatgatggaatatctgatcagcatgattcaaatgggtgctcgaaacttggatgttgcctgtgtagtttccttgctagagaagattgccgtagcgatgaagattttattcttcagcaacaatctggagaggaggatgctttgttctgtactttatgcaatgctgaggttcggaagttcagtaagcattgtagaagttgtgacaaatgtgttgatggatttgatcaccattgccggtggttgaacaattgcgtcggaaggaagaactacatctcatttgtgtgcctaatggctgtgagcctggtttggcttttagttgaatgcggagtcgggattgctgtgcttgtcagatgctttgttgataagaaggatacagaaaatctgatagctgtaaagcttggagctggattctctcgagccccatttgctacaatagtggccatatgcacagcagtttctttccttgcgattatacctctgggagaattattcttttttcatatgatcctgatccgaaagggtattacaacgtacgaatatgtcgttgctatgagaactttgactgaaccacctggtccttcagttgatgcgggtgagcagcagagtctaccttcatctcctactggttcatctgtcactgcaataagcggaagaagctctgttggaatgagtttgcaaatcaaaggtgcctggtgtacacctccaagaatctttatggatcaacaggatgaaattatacatcatttggagcctggccgcttaccatctactgtggatccagatgcaatacaaccacctgacaaggggaaaaaattgaaccagcgccctgtgcgaataagcgcatggaaacttgcaaaattagattccaatgaagcagctaaggcattagctaaagctcgagcatcgtcgtctgtgcttcgtccaattagttctcgatctcatgcatatgatgtcgatcatttatcaagtagcaatttgagtggaagaagcagccctattagtaaccgaggatttcataacaaatatgatcaagcagggacatcaaggttatctccttccaagagttcataccctcccagtcaagcaagcagggaagatttagatgcgtgccaccacagtatgagtaacttgagcagtccacaagtgtccaacatatctccttcgccaatgcagaggccaggtttgaacagagaccatttcaaccccatgtatcagcaaccatctataaatcagtctccttcatcagttagaggaagtgaagggagtgtaaatccagttcatgaaaatggtgcacgtgtggcaatgaggaataacagcttagctgttttagaggatagaaggtcgtcagtgttttgggatcaagcagctggtcgctttgtcccgaacccatctagagctcaaggcagttctcagattcctggaacagagttaacatacagcggccgttctatattttttggcagtcctgctgtgagtgaacagtcaaatgcaggaacaagaaatagtagctcagtagctggtgtttcggacagagataatactataagggattttcagcaaggtagatcacatagaggtgcccagcttcctgtgttcgttcccagttattcccagcaaaacaagttctcttagtagaggcct

SEQ ID NO: 243 - DNA, 1192 bp, Medicago truncatula
gttcttgtcttcctatattgcgtgtgtctgggtgtagataaaaatggcagctactcatgggaaaatagtcttgttcatgtctcttgcagcctttatgttgtttaatacccaaaatgcattcgtgagttgtgctttaacatcagagttacaaaacaaaattgctaaaatcaacgaagagggtccttatttgggtttaatcataccaaattcttttgaacttaaccctcttcttcaaaatccaggctatactgctagtgacaacatcatagattttgcaggaaggagatttcgttttggatccattggcgacaaaccagttatattggtcatgacgggattgagtgtgataaacgcagctataacaacacagcttctgttaagctttttcacagtagatggagttgttcattacgggattgctggaaatgcaaacccttctttgcatattggagatgttgctattccacattattgggctcatttggcactttggagctggcagaggtatgggcaaggtgctgatgatacgttaccactagaaaacaatggtgactacacaagggacgtagggttcttgaaattttcagattttacctcaaacataagtgctgctgacagtgttacagttgacaatcatctcaacaatctttggtaccaaccagaagagatttttcccgttgatggcattcctgaacaaaggcaacatgctctttgggtccccgttgattccaagtactaccgtattgccaaaaaactagaggaaatgaagctagatgcgtgcatagactcagacacatgcttgacaacgacaccaaaggttgtgcttgtagagagaggaacaagtgcagggttctatctagacaatgcagcatatagaaccttcatctacaataagtttaacgtgagtccagtggacatggaaagtgcatcagtggctcttatatgcttgcaacaaaggattcccttcattgctattagggctctctctgatttggctggtggcggcactgcggagtcgaacgaggctgataccttctcaccactcgccgccactaactctgttgctgttgtcattgagtttgtgaagctattgtcatcacaccactctaagtggtgaactatgttatgatgatgatgttttcaataatccgtaattagtgcaattatatgcacatgtaaacaacaactttgt

SEQ ID NO: 244 - DNA, 651 bp, Medicago truncatula
gggacatcaattctagtgaagaagataacagctacattaaaaaccaatataaatttgttctttgcttttgtttctgaaaatatgtctagctgtggttgtggaagcagttgcaactgtggtgatagctgcaaatgcaacaagaggtctagtggattgaactatgccgaaggcgaaaccacagaaaccgtgattttgggcgttggtccggccaagatccaatttgaaggtgctgaaatgggtgttgcagctgaggatggtggctgcaagtgtggggatagctgcacatgtgacccttgcaactgcaaatgaagtgcatcatatgcctcttgaagcagagatatattggaaccaatatgtgtaattgtgtgtatattagtacacatttaatatataagaagcatgtgtttccttttttagaataatatgaggtggtcatggatctaaccttcatcaaattcaaatgttcttagattttgttgaaggtgttatgagagctatgatcgctttgtgtttggttgtcttgtataatgtataactaaaggctaatatgatcataaatctctgcgtattataaatgaaatgcattattgtgtgttgtttgaatagaatttttttttattcatcaacatcgagttggcatatatcgacata

SEQ ID NO: 245 - DNA, 644 bp, Medicago truncatula
agcaaagttcataatccaagaagttgtgaagattgtaaattaatggagacagtgatggaagatgtagaagaatacaactacagagaagtgaagcttccatctctgataccaatagtgcctgagccagagcttgagagggaaacaggggaaagaagaagaggaagggatatagtattagccatagatcatggtccaaacagtaaacatgcttttgattgggctcttattcatctatgcagacttgctgataccatccaccttgttcatgctgtttctgatgtgaagaaccaaactgtgtatgacttgactcaggggctgatggagaaattagcggttgaggcttttcaagtttcaatggtgaaaacagtagctcggatagtgcaaggtgatgcaggaaaagtaatttgtaaggaagcagagaggattaaacctgcagctgtggttctggggaccagaggcagaagcttgtttcaaagtgtgatacaaggaagcgtcggtgagtattgctttcaccactgtaaagcagcacctgttgttatcgttcctggaaaagatgctggtgatgcatcaatcgtctaatggatttaggttgtgttctgtataaattggcattgttttcgacccactttcttgtttggaaattc

SEQ ID NO: 246 - DNA, 677 bp, Medicago truncatula
cattcattcactctttgattgtgatatttgttaacaatcataacatcactctgcaaaatacactcttgtagtaataggattgtgtttaagttattgcattttgctgacaagttctgatggcattggtaactggaagaagttcagctctgaatccaaatgcacctctcttcatacctgctgcatttcggcaagtggaggatttttcacctcaatggtgggagcttgtgaaatcttcgacatggtttcataactattggttgagccagcataaggaggaagattttgttgaaagtggcggaaatgatgctacaaatgatgatgatatagaacatatgctgtcagaaacttttgatcttggcattgaagaagatttcaactttctagataatgagtttgagaaattggtgatgtccgacgaagctcaagagtgtccagttttggatgaacctgttgaggaaaaaaagcctgttcatggtgttaacaaggatgctgcagctcttatcaagatcttgtcaccaaaggaaaggggttcaaagtcccctattgggtctccaaagcactttgagaagccagcacaatatgttaacctcaagtgtgcacctcagagaattcaccaacctcgttaggaaaaacttgaagctcacagtgtagtagcttgtttgaactgcaagttttag

SEQ ID NO: 247 - DNA, 1328 bp, Medicago truncatula
atcattccagcttcattgcaatttgcacgcacgccactctctcagtcgatactctctctatggcatcatctgattccaacgctaccaacatgcttcaagcaattcgctacaaccgtgggtctcttcagcttctcgatcagacaaagcttcctttagaaagcgtttatttggaaattcgtgattctaatgatggctggaatgctatacgagatatggtggtccggggagcacctgctattgctattgcagcggcactttcgctggctgtggaggtgtccaatttagatgattttaatggttctactgatgatgctgtttacttcctgcagaagaagttggactatcttgtctcgagtcggccaaccgcggtgaacttatcagacgctgcaaccaaactcaaagaaatcatatctaaggctgctgctacgacttcagaggccaagggtgtgtttcaggcatatctagaggctgctgaaataatgcttgaggatgatgttgcatcaaacagagcaattggaacttatggagctagttttattcaaaaccaaacagaaaaactgaagctttcggttttgacccattgcaatactggaagtttagctacagctggatatggtactgctcttggtgtaattcgtgcactttacagcgggggagttttagaaagggcttactgcacagaaacacgccccttcaatcaaggatccagacttactgcctatgagttggtacatgacaaaataccagcaactcttattgcagattctgctgcagctgcattaatgcaagcagggcgtgtggatgctgttgttgttggcgcagatcgtgtcgcatcaaatggtgacacagcaaacaaaattggaacctatagtgttgccttatgcgccaagtttcataatgtacctttttttgtggctgcccccttgacttccatcgatctatcactttcttctggacaacaaattgtcattgaagagagatctcccaaggagttgttgaacacgcgtggaggacttggagagcaggttgctgcctcaggaatatctgtgtggaatccggcttttgatgttacacctgctaatctaatatctgggatcatcactgagaagggtgtcattacaaagacgcctgctggcgatgcttttgacataaaagcttttgtacagaaaacaggttaagggtggaatgtattcagtactaatgctctatggtgtgatatgaaatgctatgtttcacccattgtagatttgagttgaatgttttaaaggggtcttgtagatctactcattcaatataactatccccggagaataaatggtgacctggtt

SEQ ID NO: 248 - DNA, 876 bp, Medicago truncatula
cacatactcaaagtgacaagtccatgtcccatgaaaccaaaagcaaacaactagttctcatttttcagtaactgagctaagcaaaaatggaaggcattgtaaaatctctctaccttccaaaaattccaaagtctcaaacatgttctggttctcttctgaattcaccacttttattacactccaatgccacttcagtaactttcaattcagcaacacatcatttgcacaagtgctttctttttcagcaaccaggtggtgttatacattccaaagcacaggaaaaggtgaacctaggagctatacatgcatcaaaagctacaactccaacaacaactgctacacaaagatggattcttgaaccagttggagatggtgattcaaggcatataggcttcaaggttgagaggccaggtgcatatgaaattacttctaatgaagtcactgtaggacgtgttccagagaaagctgatttagtgatcccggttgcaacagtgtcaggtgtgcatgcacgcattcggataaaacaagacaatcttcttgttatagatttggatagcaccaatggaacattcattggtgacaaaaggctgaaacctggagtagttaccactgtatcttctgggagttatattacttttggggacactaatttggctatgttccgtgtgtcgaaaatagaagagaaggctgcagatacagttggagaaccagaaggtgaattagagaatgatggcaaatctgatagtactgaaacaagttcaacttctagttgaaaaacatactactttgttttgtatagtgaaactattcagctttgttttgcaatgccattttgatacaaagcatattctactgttgatagctgatattctgctc

SEQ ID NO: 249 - DNA, 854 bp, Medicago truncatula
tcaagatggaaaacgggcataaattccaggaagtttccaacccaaaatatgattgtctcttgtttgatattgatgacacactttatcctttgagttctggaatttcagcgcaaacagcaaaaaatattgaagagtatatgcttcaaaagcttggaatggaggctgctacggttcctgaattgtgctattcattatacaagacttatgggacaacaatggctggtcttagggcaattggctacgactttgactacaacgactttcatagttttgttcatgggagattgccatataatctacttaaaccagaccctgttctcaagggcattttgcaaagcttgccttttaggaaagtgctttttaccaatgcagacatgggacatgcgagtagagtgcttaaaagacttggactcgaggactgttttgaaagaattattagctttgataccctgaattcctctgacagcatcatcccttctaatgaaaaagttggcagtgaaatttttgatttctgtgagtacacacgccgtcctgattctgatacggtgcttccaaagacaccagttgtctgcaaaccttttgaagatgcatttgaaaaggcattcaagttggctgacattgaccctcaaagaacattgttcttcgatgacagtatccgcaatttacagacagctaatcgtttgggcctccatacagttgcggttggtacatccgtgcgcagtacaggagtggatcatgcattagagagtattcataatatcagagaggcatttccagagctatgggaagtcgacgagaagcatgaaatcgtcaactacaaggttgcaattgaaacaacagtaaaagcatagtag

SEQ ID NO: 250 - DNA, 1241 bp, Medicago truncatula
gactgatgggtaattgtcttgattcttctgctaaggttgatgctgctcaaagctctagatccacttctggaacctcaaaaactactccttctagtttaacaattccatcatacagtgacaaaagcaattcctcaagtcttcttccaacaccaagatctgagggtgaaatcttatcttctcccaatcttaaagcattctcattcaatgagctgaaaaatgccacgaggaattttcgtcccgatagtcttcttggtgaaggcggatttggtcatgtttataagggatggattgatgaacacacatttacagctgcaaaacccggatcaggaatggttgttgctgtaaaaagacttaagcctgaaggttatcaaggacataaggagtggttgactgaggttaactaccttggacaacttcaccatcctaatctagtaaaattaatcggttactgcttggaaggagagaacaggcttttggtatatgaatttatgcctaaagggagcttagagaatcatctttttagacgaggaccacaaccactgtcttggtcaataaggatgaaagtagctatcggtgctgctagaggactttcttttcttcacaatgcaaaatctcaagtcatataccgtgatttcaaagcttcaaacatccttttagacgcggagtttaattctaaactctctgattttggcttggctaaagcgggtcctaccggcgatagaactcatgtgtctactcaagtcgtgggtactcaaggatatgcagcacctgaatatgttgcaactggtcggctgacggccaagagtgatgtatacagctttggagttgttatgcttgaacttttatccggaagacgtgccgttgataaaacaatagctggcgtggaccagaatttagtagactgggcaaaaccatatttaggcgataaaagaagactatttcggatcatggattcaaaattagaaggccaatatccacaaaaaggagcattcatggctgctacacttgcactacaatgccttaacagagaagctaaggcaaggccttcaatgacagaggttttagcaactctagaacagatagaagctcctaaacatgcatcccggaattccttatcggaacatcatagagttcatgctccggtcagaaggtctcctgcacgaaaccgaacgccttcatatgttactcctactgcatcgccattgccatctgtccggcaatctcctcgtgcgcactagtag

SEQ ID NO: 251 - DNA, 2221 bp, Medicago truncatula
aatcacgtttgtggagctaaagaagcaaacaacacacttttctaccgcacttttttcactcaacttaaagagtaatcaaaatttgaaaccaatgaaagaagctgagaaaagcttagatccacaactatggcacgcatgtgcaggaggaatggttcaaatgccatccgtgaacacaaaagtgttttactttccacaagggcatgcagaacatgcacaatccaacgttgattttggagattctttcagaattccaccactcatcctctgtagagtggtttctgtgaaattcttagctgaccctgaaacagatgaagtcttttcaaagataactttgattcccttaagaaattcagagcttgaaaatgatgattctgatggtgatggttcggagaattcagaaaagcctgcatcttttgcaaagactttgacacaatctgatgcaaacaatggtggagggttctctgttcctagatactgtgcagaaacgatttttcctcggcttgattactcggctgagccaccggttcagaccgtgattgcaaaggatgttcacggcgaggtttggaagtttaggcatatctatagaggaacaccaaggaggcatttgttaacaactggttggagtagttttgtgaaccagaaaaagcttgttgctggcgattctattgtgtttttgagaggtgaaagtggagaactttttgttggtattcgtcgtgcgaagcgagggattgttaatggattggaaacaccttctggatggagttctggtaatggaagttgtggtcttggaccttatggtggtgctttttctgcctttttgagagaggagaataagttggggggtgttggtggtaatttggggggtggaagagtgaaagtgagtggtgaatcagtgaaggaagctatgagacttgctgctagtaatcaaacatttgaggttgtttattatcctagagcaagtactcctgagttttgtattaagacttcagctgttaaagctgctatgagaattcaatggtgttctgggatgagatttaagatgccattcgaaaccgaagattcttcaaggattagttggttcatggggacaatttcttctgttcaggttgttgatcctattcgctggcctaattccccttggagacttcttcaggtcacttgggacgaaccagatttactacacaatgtgaagcgagtaagtccatggttggttgaattggtatcaaacatgtcgatgattcatctcacacctttctcaccaccaaggaagaaactccgttttccacaacatccagatttcccactcgatgttgtccagtttcaaataccaacattttcaggcaacccttttaaccctttgtgttgtctatcttcttcggataattataacgctcctgccgtaggcatacagggagccaggcatgctcaaattggaatatctttatcggatcttcaccttaacaacaacaaatttcagttaggtgtgtttccaaataatcgcgagacgatttctaacgttagcaacataactacgaaccatgataataagagcaaagaaagtatatcatgtctgttgactataggaaattctcacaagagaagtttggagatcaaatctgataataatgataagagacaccaatttttgctttttggtcaaccaattctcactgagcaacaaatctctagaaaatcttctagtgatgatgtgttgttgtccaagaaaaaggacaaagagaagtggtttttcagtgatactactaaatcttctatttctgaacagttttcaccagcaaaatcttctaccactagtgctagtgctgacttttgttggcaacttggattagatactggtcattgtaaggttttcttggagtcagaggatgttggaagaaccttagacttgtcttgtgttggttcttatgaagaactgtatagaaaactggctaagatgtttggaatagaaagatctgagatgttgagtcatgtactctatcgcgatgtaacaggtgctgttaaacaaactggtgaagaacccttcagtgacttcatgaagaaagcaaaaagattgacaattctgatggattcaggcagcaaagatactagaagggtttgtatcacaggaactaggaatgctgaacgtggattagatgcatcaaataagacaggacctatgagcatctttgtttaagatgtgttgcattgcatttcagttatttag

SEQ ID NO: 252 - DNA, 965 bp, Medicago truncatula
aacacatgattatatcacacccttttacaccttttccttcttgcattaccattacatgctccaaacctttttcccataataatcattttatcaaatcctatatacctccttttctgctcttgagaaatgctagatcatcgacattgttatgtagtgctagaagtggacgaaatgaaaattcaaacagtttggactttgatatagacatcaatgaggaagatcaagtgcttgagaatgatgattatggtgggttttcagctcaagggatggaaacaaatgatattattgatgtagatgaaggacaagatgatggtgatggcagaagatattcaggtggaggaccgtataaaggcagggatgagaaggattttgatagaaatccagaatttgctgaaatacttggtgattatctagatgatcctgagaaggcacagtccagaatggaagagagactaagaaaaaacaggaacaaaatactccacacaaagaccggatcaggagtaccaatgaaagtgtcattcaataaatttgatttttcaaactcatatatatggtttgaattttacaatgctccattggcaaaagacatcaacttaatttgtgatgctattcgagcatggcacattgtaggacgacttggaggatgcaatgccatgaacatgcaactgtcacagtctgagatagaaaaacgaccaagttacgattatattcagggagcgaatgtaacaccaacgacattttacaacattggggatcttgaggttcaagacaacttggctcgaatatggatagatattgggactaatgaaccattgattctagatgttttgataaatgcattgacacagataagttctgactttgttgggatcaagcaagtagtgtttggtggagaagaatttgagaattggaaagaggatttaacatcagaggattcaggttatggtgttcataagatctagtag

SEQ ID NO: 253 - DNA, 2971 bp, Medicago truncatula
aggtcatagaacgagaacgaaccagcagcgccgcgtctcctcgaactcaggtcatcacttccacttcgaagctcaatttcaacaactaaggtatctcgtttgaattcaccgtcaaaatgcttcacaacaagtccttcgttaagaaaaccaaaggtggcaaagtcataaggcaagtaagggaacactacttgcgtgatgatatatattgcggagctccgtcttgcactgtctgtgacacttctgctgctagactcagtgcttctccttccactattcttgttctcgacactaatgttgttcttaatcagattgatttgctggagaatcccgctattgatgatgttgttgtactgtctattgtgttggacgaggttaagaacaagaatttgtcggtttataatcggttaagagctatttgtagtaatccaatgaggaaattctttgttttttcaaatgagtaccacagggatacatatgttaaggaaatgagtggggaaactaaaaatgacaggaatgatagagctattcgagtggcttcacagtggtatcagaaacatctaggtgatgcaataaaggttttgcttgtaactaatgataaagagaacaaacggaaggcgagtgaagagggcatttgtgcagaaacagttgagtcatatgtcaagtctttggaccgacctgatttacttgacctgcttgtgcggccttcatctgaagacgtggagatggaagatgttgaagatcatagaccatccaagaggaaaataatttacgcagagcataaaccaatgtcagaaatcacatctggtttgcatcgtggaatatatcatcaagggaaacttcgtgtaaaccgttacaatccattcgaagcatatgtcgggagtgagagcattggcgatgagataattatttatgggcgatctaacatgaaccgagctttcgatggtgatattgtggcagttgaacttctgcctcaggaccaatggcaaggggagaagtctatgtctatagctggtgaagaagatgaggatgatgatgatgttcatctagccccgaacagcgctgatgttgcaccccgaactattcctcagcaaagttctactggagaaataaatgctggatccggccgcccttctggttgtatcgttggtattataaagagaaactggcaatcgtattgtggatctttggagccaatgcctatacctggagggagtcgtggtgtggcctatgccttatttgtctccaaagatcgtagatttcccaagattcgtatccaaacccgccaacttgagaaccttttggacaaaaggattattgtatcagttgattcttgggatcgtcaatctcgatatccatctggccattatgtgcggactgtaggaaagataggtgataaagatactgaaactgaggtggtcttgatagaaaatgatataaattcaaggccattctctgcacaagtgctagcatgcctgccaccattgccatggtcagtctcttctgaagatttgtccattccatttaggcaagatttgcgtcacttgcgtgtcttcagtgtggaccctccaggctgcaaggatattgatgatgcactccactgcattgctcttccaaatggaaactttgatgttggagttcatattgctgatgtgacaaattttgtgtttcctggcactcctctcgatgatgaggcttctcaaaggggtacatcagtttaccttgttgagaagcgaatagacatgcttccaaaacctttaacagaggacgtatgttctcttcggtctgatgtggagaggctagcattttctgtcatatgggaaatgacacctgaagcagatatcatttccaccagatacacaaaaagtgtcataaaatctgctgcagcattgtcttatgttgaagcacaagcgaggatggatgatagtcgattgatggacccagtaactactgacttgagaaacatgaatagtttagccaagaaaatgagattaaggcgtattgagaacggagctttgactcttgcatctgcagaagtcaaatttcaaattgacacagagactcacaatccccttgatattggtatataccagataaaggaagccaatcaaatggtggaggagtttatgcttgctgctaatgtttctgttgcgcaacaaattcttaaaagttttcctttgtgctcattattgaggcgacatccaactccaactaaagagatgcttgaacccttgctacgtgtttctgctgcgattggtctaaacttggatgtctcatcatcaaaagcattggctgactctcttgaccatgctgtgggtgatgatccatatttcaacaagttgatccgcattctgacaactaggtgcatgagtcaggcagtttatttctgtagtggggatcttagccctccagaatatcatcattacgggcttgcaacacctttatatacccatttcacatcacctataagaagatatgctgatgtcattgtacacaggctacttgctgcttctataggaatatccaagttaccgtctgtatttcaagacagactgcagctcaccagtattgcagacaatttaaattataggcacaggaatgctcagatggcagggcgggcctctgtagagctgaatactctcatttatttccgaactaggccaaccgataccgaggctagggtagtcaagataagatctaatggtttttttgtgtttgttcccaaattcggcatagaaggacctgtatatttgacaacaagagctgaaaagggtagcggagaatggtatgtagatgaacaagagcagaagattaaaaagatggatggtagcttttcatacagcattttgcagactgtacaaattcacttggaggttgtggagcctcaacctaaccggccaaagcttcagcttactctcatctagaggtatacgaggcatcatgagcattgaacaagaagcaagctaggaaatgt

SEQ ID NO: 254 - DNA, 1926 bp, Medicago truncatula
cacattcttcatcttcctatatacacccccactttttctcttcaacccctctcttcactttcacatatacaacaacttcaattgaattcaattcattttgaagttattaccaatcttcaaatggcgaagatgaatccattattcatcctcgccttcttctccatttcttctctcttcttctctaccgtcagatctgattcatcagataaacgttacaaagaaggagatcccgttcctctcttcgctaacaaagttggtccttttcataatccaagcgagacgtatcggtattttgatctgccattttgtataccagatcatttgaaagagaagaaagaagcattgggtgaagtgttgaatggggataggttggtcagtgctccttatcagctcgagttccaaaaggacaaggactctatgtcggtttgcaagaagacacttacaaaagaagaagtggcgaattttcggtccgctgttcgtaaagactactactttcagatgtattatgatgatttgcctatttggggtttcatagggaaggttgataaggaagggaaagaccctagtgattatagatactacctttacaagcacatccattttgatatattttataacaaggatcgtgttattgagatcaatgtgcgaacggatccaaatgcccttgtggatgttacagaggataatgaagttgatgtggagtttttctatactgtgaaatggaaggagactaacactccctttgagaagcggtttgacaagtactctcattcgtcttcattaccccatcatttggaaatccactggttttctattatcaattcgtgcgtcacagtcctcctcttgactggttttcttgcaactattttgatgcgtgtgcttaagaatgattttgtcaagtatgcacatgatgaggagaccgcagaggatcaggaagagactggctggaaatacatccacggtgatgtttttaggtttccaaagttcaaatctgtatttgcagctgctctcggatctggtacccaactgtttacccttacggtgttcatattcatattggcacttgttggtgtattttatccatacaaccgaggggctctattcactgcacttgttgttatatatgcactcacttcaggaattgctggctatactgctacctcattctattgtcaactggaaggaacaaactgggttcggaatctactattgaccggatgccttttctgcggacctctatttcttacattttgctttctgaacactgttgcaattgtctacaatgctactgccgctctcccattcggcacaattgtcgttatagttctcatatggacacttgttacgtctcctctacttgtattgggagggattgctgggaagaacagcaaggctgaattccaagctccagtccgcacaactaaatatccaagggagattcctcctttgccatggtatcggggagcaattcctcagatggcaatggcaggatttttgcctttcagtgctatttacatcgaactttattatatatttgccagtgtttggggtcacagaatttacacaatctacagcattctgtttattgtcttcatcattctcttgattgttactgctttcattactgtggcattgacatacttccagcttgctgctgaagatcatgaatggtggtggagatcattcctatgcggtggttcaactggattatttatctatgcctattgtctgtattactactatgcccgctccgatatgtctggtttcatgcagacctcatttttctttggatacatggcctgcatatgctatggtttcttcttgatgcttggaactgttggattccgtgcatcattgttctttgtccgtcacatataccgatccatcaagtgcgagtaggcattttgtcatctcttattgtcttaa

SEQ ID NO: 255 - DNA, 1006 bp, Medicago truncatula
accaaaatggcattctcatcatccatgtggtcttctctctttgttccaaacccaaacaaaactaaccgtttcgctacattctctccctccagccacagcaaactcttaacaaccacattcgccatccctccactctcaaccgcaacagccgccgacgttaccggcgccatagacggcacaacagtcgccgtcatcagcggcggcttcgtcgctggcctcaccgcacttctctccctttcagacccggaaagacgacgacgcgaacaggcggaggaagtaggcggtgatgacaaagaagttgtgagggagtatttcaacaacaacgggtttcaacgatggaagaagatttacggtgatactgatgatgttaatagagttcaacgggatattaggttggggcattccaagactgttgagaatgctttgcagatgttgaaagatgaagggccacttcagggtgttactatctgtgatgctggttgtggtaccggttctctttcaattccgttggcgaaggaaggtgccgttgtttgtgctagtgatatatcagctgccatggttgctgaagctgagaaactggcaaaagaacaacttgtgtccagtgaaaatggagtgtcacctgcgatgccaaagtttgtggtgagtgatttagagagtttggatggattgtacgatacagtggtgtgcctcgatgttatgattcattaccctcagagtaaagcagatgggatgattgctcaccttgcttctttggcagaaaagcgattgattctgagctttgcacctaagacattttattatgatgcactgaagagggttggagagttgttccctgggccttccaaggcaaccagggcatatcttcattctgaagcagatgttgaaagggcgttgcgcaaggttgggtggacgataaagaagaaaggcttaatcgctactcaattttactttgccaagcttattgaggctgttcctatgtagtgagtccagaggattcagaggtaag

SEQ ID NO: 256 - DNA, 1534 bp, Medicago truncatula
ggctaagatcctttgctgacttttttgttgcaaaagtagatagaaacagaaaagagagacacaaacatggctactttgaatgttttctctcaaccattgcaccctacaactatttcatcttctttatgttcttcttcttcttcttgttctaattctactttttcatgtcacttttctcttctttcttctcactcttcccccacactttctaagctctctaatcatgttcacacccacttctctaagtcaggaaatggaagttcatggctgcaaagtagttccaccgttgacagcattgcgcacaagaagggtcctgtatattcagtatttccttcatcacctgcccaagtttcatctgtccaagatctgtatgaatttatttgctcaggacctttgctttacaaaattggtttgacgccagagaaggtggccgagtctatagataagtggttgtcttatgggcggcaactatgtcgactgtttcagcttaatgaattgttcttgacagagcctcaaaaagttaggctttatcattactatataccagtcttcctctggtgtgaaagtgagattgctcagcatcaggccaaattcaaagataaagaagatattcctcctttagtgattggatttagtgcccctcaaggctgtggaaagacgaccctcgtctttgctcttgactaccttttccaaatgattggcaggaagtctgcaacaatatctatagatgatttttatttgacagctgaaggccagaataaactaagagaggctaatccaggaaatgcacttcttgagtatcgtggaaatgctggaagccatgatcttcctttttctgttgaaactttgacagctttaaccaaaatgtctagagaaggtaccaagatgaagttaccaagatatgataaatctgcttttggtggaagaggtgatcgtgctgatccttcgacatggcctgaaattgaaggcccccttactgttgtgttgtttgaaggctggatgcttggtttcaagccccttccagttgaagctgtaaaagctgttgatccgcagctagaaattgtaaataaaaacctcaaagcgtattatgatgcgtgggacaaatatatacagtcatggatagtcattaagattaaggacccaagctgtgtctatcagtggcgcttgcaggctgaaattgctatgagggaggcaggcaatcctggaatgtccgatgatgaggtgagagattttgtttctcgctacctgccagcatacaatgcataccttcctactctttactcggagggtccgagtggatcagaccctcaacatctactaaacatcgaaatagatgaaaagaggaaccctatcctaggtgtctagtctcacaagatgatatgacatttctggcttttcaattcttttgagagaattggaatggccctttccaatcagttgcaccatcggtggagataagtaaatgtatcagcgctattttcgttgaaatgtatagaggttatttttatcagcacataacaatgccaaatgcttt

SEQ ID NO: 257 - DNA, 974 bp, Medicago truncatula
atccaatggattcaagctctaacgaagtagtccttgatctctcacccatgattaaaatctacaaagacggtcacatagaaagactcataggatccgacatcgtacctccatcttttgatccaacaacaaacgtagaatccaaagacattctcatctcaaaagaccaaaacatatcagccagaatcttcattcccaaactcaacaacgatcaatttccaaaccaaaaactccctctccttgtttacttccatggtggtggtttctgcgtagaaacacctttctcaccaccataccacaatttcctcaacaccatcgtttcaaaagctaatgttattgctgtttcagttgattacagaagagccccagaacaccctcttcctatagcatacgaagattcatggacttccctcaaatgggtcgtttctcatttgcatggaaatggttctgatgaatggatcaaccgttatgcagattttggaaaaatgttctttgcaggagacagtgctggtgcaaacattgcaaatcacatggctattcgtgttggaactcaagggcttcaagggattaaccttgaagggattgttttggttcatacattcttttggggtgttgaaagggttggatctgaggctactgagaaatctgaacacttatctttggctgataatttatggaggtttgtttgtccaacaagttcgggatccgatgacccgtttttgaatccgggtaaggataagaatttggggaggttgggttgtaagagagttttggtttgtgttgctgagaatgattcgttgaaggatagaggttggtattataaggagttgcttgagaaaattggttatggtggtgttgtggaagtgattgagacaaaaggtgaaggacatgtttttcatctctttaatccaaattgcgataacgctatttctttgctcaatcaaattgcttcctttattaatcatagtggttaataa

SEQ ID NO: 258 - DNA, 795 bp, Medicago truncatula
cactttgctatggaaatggaaggttatgatatatttggagatgctactgagagaattagtaaaaatggttttgaagtaaacaatgaggtaattggaagtgggtatggttcaagtttctctctggttttggatagggagagaggggagcttgtagaggcacctgttaaaatggaaggaaagggtgtgtccactacagagagaagtgttgaagctttgaagaatcatagtgaggccgaaaggaggagaagagctaggattaatgcacatcttgatactcttcgttgtgtcattccaggtgctttgaagatggacaaagcatcattacttggtgaagtagttagacacttgaaagagctaaaaaggaatgaaacacaagcatgtgaaggtttaatgataccaaaggacaatgatgaaataagtgttgaagaacaagagggaggttggaacggttttcctttttcaattaaagcatcactatgttgtgaatatcaaccaggtttattgtctaatataagacaagccctagatgctcttcatctcatcatcatgaaagcagatattgcaacttttggagacagaatgaagaatgtctttgttgtaataagctgtgaagaacaaaactttgatgctgctgaatacagacagtttcttgctggttctgttcaccaagctcttaagtctgtccttagtagattttctgtttcacaggatatgctaagagcaagaaaaagaaggagggtttctatattcagttcttcatctttagaaaatttcttataagttcctttgtcatag

SEQ ID NO: 259 - DNA, 2142 bp, Medicago truncatula
ccctaaaccctagcaaattacctgaacaaaacacaaatcctgcaatctctcttctccaatctgcaatggcgccagcaactaagaaaaaaccttcaaagccagtcaaacctcagaaagcccccaaaaaagttcaaattgttccaatcaaagacgattccacttctgaatccgaagaagaagaagcaccacctctacaacatctcgaactcgatggttctgattccgacttatcttctgatggtgatgatcaactagctgatgattttctccaaggaagcgatgatgaagacgacgacaacgacgatgaaggttcggatttggaatctgggtcgggttcggatgaggatgaggattcggaatcgggtgaggaagatattgctaggaagtctaaacttattgatagaaaaagggagagagatagccaggcagctgcagatgaattgcagacaaatattcaaactaatattcaagatgagtctgatgagtttacattaccaactaaacaggaacttgaggaagaggctctgcgtcccccagatctttccaatctgcagaggaggattaaagagattgtccgtgttctttccaattttaaggcgttgagacaagatggggcgacgaggaaggattatgttgatcagcttaagactgatatacgttcatactatggctacaatgagtttctaatcggtgctttagtggagatgtttccagttgttgaactgatggaactgattgaagcctttgaaaagcctcgccctatatgtctgaggacgaacactttaaagacacgaagacgggatttggcagatgtcttgataaacagaggagtaaatctggatcctctcagcaaatggtcaaaagttggacttgttgtgtatgattctcaagtacctattggtgccactccggagtacatggctggtttttacatgcttcaaagtgctagttcttttctgcctgtgatggccttggctcctcaagaaaaggagcggattgttgatatggcggctgcacctggtggtaaaacaacttacatagctgctctaatgaagaactcaggaataatttttgcaaatgaaatgaaggtgccacgactaaaatctctgactgcaaatctgcataggatgggtgtatcgaacactgttgtctccaactatgatgggaaagagcttccaaaggttttgggtttcaattcggttgatagggtattattggatgccccttgcagtggaaccggggttatatccaaagatgagtcagtcaaaacttcaaagaacttggaagatataaagaaatgtgctcatctacagaaggagctccttcttgctgcaattgacatggttgattcttattcaaaatctgggggatacgttgtatattctacatgctcaatcatggttgctgagaatgaagcagttattgattatgtgctcaaaaggagggatgtaaagctggttccttgtggacttgactttggacgtccagggtttacaaagtttagggaacagcgttttcacccttcattagataagacaagacgtttctatccacacgtacacaatatggatgggttttttgttgcaaagttgaaaaaaatgagccacccaaaacctgctagaacatcagaaacatttgagaaggatgaaaaagaaaccgagcttgtgattgacgacgataaacctagtaatggcgttgaagaaaatggcaaacattcttttgaacttgaatccaagaagaggaagaaagataaattcccatcaaaaccaagtaatgatgtaaaagccaatgtcaaagaagcttctgaacctgaatccaagaagaggaagaaagataaattcccctcaaaaccaagtaatgatgtaaaagctaatgtcacagaaacttctgaacctaaacccaagagggtgaaaaggaaacctccatctagagaggagatttcaaaagccagagaggagaagagacttgctttaatagaaaagaagagaaaaagtggtaagcaacagagaggaaaaaatgatgaatgaccagtggcagtgcaagtagttttgatgaccaactgtgcaattatagcgcagaattgacgcaaaactccatcaatatgggagtactgaggtgttgcatgtcgaaagaatgtaccct

SEQ ID NO: 260 - DNA, 689 bp, Medicago truncatula
agaaaatggttccaaaaatgttgaagttctctcgcatgcttcattcatcttccaggaatcatctattggaagttctttacgctagggatttctctactgccacaaataacaactattctgctaaagggtatacttcagatcgtatctttgctccttattctgtttacaagggcaaagctgcgttctcactcagtccttgtcttcctacttttactaagttggattctggggctcttgtggttgatcgtcacggttccataatgatgagtttcatgcctgctattggcgagcgcaaatatgactgggagaagagacaaatatttgccctatcagctactgaagtcggttctttgatagccattggtccccaagattcatgtgaattctttcatgacccctcaatgaaatcaagtaatgctggtcaagtaaggaaaagtttgtcaattaagcctcatagcaatggctactttgtctctctgtctgttgttaactccgtgttaaataccaaagacaattttagtgttcctgttacaactgctgagtttgctgtgatgaagacagcttgcagttttgcattgccacacattatgggttgggatcgtctaactaatcagcagtccagtgggacagtcagctttcaaccaaagatgaactcacaaattttagacttggagtgggaaaagtgatga

SEQ ID NO: 261 - DNA, 812 bp, Medicago truncatula
ccaaagggtggtagtagtagtattgtagtggtgccggccagccgacaattacgggagccaatgtgggtcccttcacttttataaactcaaatcacttctcacttcacttcgcaaaccctttcttttctctcttcttgtgttgtttttctttgttttcatggcttcttcttcaacttcttcagcgaatcgtgaaggacactacagaggtgttaggaagcgaccatggggacgctacgccgctgagattcgcgatccgtggaagaaaacgcgtgtttggttgggtacatttgacactcctgaagaagctgctcttgcttacgacggcgccgctcgttctcttcgtggagctaaagcaaaaaccaacttcccaccggcgccggtcgccggaggactttgtttggatctcaacgctccttcttctgatctccgatggccatctgtcccttcacgtggccgtgtgcttactgagtttcttcaaactggtgttctcaaggatttcaaccctcctccacctccacccatcggcggggtggttggacagaggcataatgaagttactcttgctgtcgccggcagaactatggtggctgagaactctccgacggcggcttacttgggacttgttcgtcgtgggattccgattgacttgaatgaacctccaccgttgtggctttgaaaaaccctagacaaataagtagcgtaaaatgagatgctttattgtagttttttaacggcgtcattttaggatcttatctaattaatcttgtctttttctcccttattagcggcatagttatcatgagggagtatct

SEQ ID NO: 262 - DNA, 2320 bp, Medicago truncatula
gttctctgcattcattccattccattatctcttcttcttctgccaaattccaatggcgggaattcctatcacctcctctaactacaactatgcttcttccatccattcacttcctctcttctttgctcgcactaacttcaccaccaccatcaacgtttctccaacctcttcttttcgcgtcttttgccatactcaatctaagacaaagaaaacggagataagaaggttttcccctttattagaaagttctggtaatggtgctgtggctctagatgagtggaaagctgttcctgatatttggagaacttctgctgagaagtatggtgataaagtagctttggtagatcaatatcatgatcctccttcaactatgacatacaaacagttggaggatgcaatattaaactttgctgagggcttgagagttattggagtaaaacctgatgagaaaattgctctttttgccgataactcgtgtcgctggcttgtagcagatcaaggcatgatggcaattggagcaatcaatgtggttaggggttcaagatcatcaattgaagaactgctgcaaatatacaaccactctgaaagtgttgcactagctgtggacaatcctgaaatgtataatcagattgcaaaaccattttatttaaagacctcaatcagatttattattatgctttggggagaaaaatcaagccttgtcaatgaagcaaacaaggaggtgccaatctatacattcatggaagtcgtaaattttgggcgacaaagtcgccgggcattgcatgcctcccatgatggacaacactatatgtttgaaacaataaaattggacgacattgctactcttgtgtacacaagtggtactactggaaatcctaaaggcgttatgctaacccatcagaatcttttgcatcagatcaaacacttatcggacgttgtacctactgaagctggagatagatttctaagtatgttgcctccttggcatgcatatgaaagagcttgcgagtatttcattttctcacatggtcttgaacacatatacactaccgtaagaaacttgaaggatgatttaggacgttataagccacatttaatggtttctgttcctttagtttttgaaactttgtacagtgggatcatgaagcagatatctacaagctcgcttgttagaaagcttgtcgctctcacattcataagggtcagcttagcatacatggagtgtaagcgaatttatgagggtaaatgtttaaccaagaatcagaaatcaccttcctatctctatgcaatgttggattggctaggggcaagaattatggctgcaatattatatccagttcatatgctggcaaataaactggtttacagtaaaatccgttcaactattggaatatcaacggctgcaataagcggtggtggtagcttaccttctcatgttgataagttttttgaggctattggtttgaatttgcagaatggatatggtttaacagaaacttcaccggttattgctgctcggcgacatggttgcgacgtaattggatctgtggggtatccacttaagcatacagaattcaaagttgtagattctgaaactggagaagttcttccacctggttcaaagggaattttgaaagtcaggggcccacaattgatgaaggggtactacaagaatccttcagctacaaaccgggtcattgatagggatggctggctgaatactggtgacataggttggattgctgcccaccattcaactgggaggagtcgtaattctggtggtgtgattgttgttgaaggccgtgctaaagacaccattgtgctttcatcaggtgaaaatgttgaaccgggagagcttgaagaagctgccacgaggagtaacctcatacaacaaattgttgtcattggtcaggataaacgacgtctaggagctgtaattgttcctaacaaagaagaagtcttaaaggcagcaaaggaattgtcaattatagattccaatagttcagatgtcagtcaggaaaaagtgaccagtctaatatataatgaattaaggacctggacgtcagggtttccatttcaaattgggccaatccttctcgtaaatgatcccttcacgattgataatgggctaatgacacccacaatgaaagttcgaagggatagagttatggctcaatacagggaccagatagagaatctatacaagtaaacttacctaatgtcaatggtatgttacaaatagttatagctcaacataggatcaaatggagaacctatacaagtaaaattacctaatgtcagtggcacaatagactcgtac

SEQ ID NO: 263 - DNA, 1551 bp, Medicago truncatula
gtagacatgtcttttgcagtaacaacaacaatatttgctttccttctcatcactttcacatactttctattcaaactcttcttacatccaaaacaaaaaaccattatccataaaaagccaccaggtccaccaacactaccaataataggaaacctacacatgttaggcacccttccacacagaacacttcaatcactctccaaaaaatatggtccaatcatgtccttacaacttggtcaagtcccagctatcgtcatttcatcttcaaaagcagcagaatcatttctcaaaacccatgacatcgttttcgcaagccggccaaagattcaaggatctgagctcatgtcttatggttctaaagggatggctttttgtgagtatggtccttattggcgtagtgtgaggaaattttgcactttgaaacttcttagtgcttcgaaagttgagatgtctggtcctattagaaaagaggagttggatgttttggttaaatctttggagaaagctgctttacagggtgaggttgtgaatgttagtgaggttgtagagaatcttatagaagatattgtgtataagatgatgtttggtcggagcaagtatgagcaatttgacttgaagagtttggttcaagaaggattggctttgattggagcttttaatctggctgattatgttccttggctaggaatttttgaccttcagggattaacacgatcgtgcaagaaagtcagtaaagcaattgatgaggtgttagaggtgatcttaacagaacatgaacaagctgctaatgtaaacaaaactcatcataaagattttgtagacatacttctttcaattatgcaccaaaccattaatgtggagggtgaacaaaatctcgtcattgatcgaactaacatcaaggctattttgctcgacatgatagtggcagcaattgatacatctgctacctcgattgaatgggctttatctgaacttttaagacatccaagagtgatgaaaaagcttcaagatgagatacaaaatgaagtaggaaataaaagaatggttgaagagaaggatctgaacaagttgaattacttagatatggtggtagacgagagcttaagactttaccctgttgcaccgttactagtccctcgtgaatctagggagagcacaacaattgatagttattttataaaggaaaagacgcgacttatagtaaatgcatgggcaatagggagagatccgaatgtttggtcagataatgctgaagaattttacccagagagatttattgagaaaaaaatgaattatctcggacaagagtttgaatctataccatttggttctggtcgtaggcgttgtcctggaattcaactgggtttaattactgttaagttggttatagctcaattcgtgcattgctttaactgggaacttccacataatatcagtccttccaatatgaatatggaggagaaatttggactcactataccaagagctcaacatttgcacgcaataccaagttatcgtttggatgatgctaagcttgaatagtttcaatga

SEQ ID NO: 264 - DNA, 881 bp, Medicago truncatula
cggtagtgggaaaaatgtcgcggcggacgatggagtgggcggcgaggtccgagcacctccacggcataccacgcaaagtggtaatagcagcagtgggttccttcgcgaaaacagtctcatctctcatcaacacaacctccgttcacaacgccgacactctcctccatctcgttcgttccagacccaaaggcatccccctcatcaccgtcagcaatcacatgtccactttggatgatccagcaatgtggggatttaagggttttcctatctttgatactaagttagctagatgggttcttgctgctgaagatatttgttttagaaatccactttattcatacgtttttcgcactgggaaatgcatacctattacaagaggtggggggatttatcaagagcacatgaatgaagcgcttgggcgcttaaatgatggagaatggctgcatacttttccagaaggaaaggttcatcaagacgatgcacctataaggcgattgaaatggggaactgctagtctaattgttcgtgcacctataactccgattgtattgccaattgttcatcatggttttcatgaggtgatgccagagaaatatatgtttggaagacggcctcctttaccattatgcaataagaagattaacataattattggcgatccaattgaatttgaccttccagcaatgagtgaaatggctattgcccagtctcggaatgattcattccctactatcgggtggcccagaacttccgatggcttggatgaggcagcacaacgatatctgtacactacactttcagagaaaattcgtgttgccatggagaaattaaggtgttatggtaaaagttttctgaagtcttaagttaaaccccacctatga

SEQ ID NO: 265 - DNA, 1542 bp, Medicago truncatula
ccaaaaatgacttcttcctcttcttccaaatctcctcctttaatcccttcacgccattctccacaattcacaccaattcaagaagaacatgaatttgatgaatacagaagccaaagtagaagaacaacaccaacaagtgcttcaactccaaagcatcatcatcatcatccaccaacaccaatcaatatcaacaaaaacacaaaaccaaatcacaagaaaaaacgttctgaaactgaactagaagatggttctgtttcatgcaacaaatgcagaccacattctcgtgacaaaatctttatccttccctttgatcattccaacaacagcaacagtaacagcaagtattcatctttgttgcaaagtccaaatgggattttcaaatccattgtttcaaagctaacaagaaaaagtccaatgtcaacatcaacaacaaacaacaatgaagaacaatggaaaatggcagtggcagaactttctcacaaacttgttcatgccacaagaaaaagagatgaagctcttcaagaagcttcaaggctcatgaattcaatgtcagagttagagaaaaagttgaacaagcttgaaatttattgtcacactttgaaatctggtcttgaagaatgtaacattggttcttctaatgtcgttgctcagaagaattttcatcatcatgttcaagacaatgacaacgttgtacaacatttcttggtggctgtttctgaagcaagatcttcagtgagacttctaagtcgttcattaacaatgcaacttagacacacaggaagcaaagtgtatgaaaaagtttctttacttttacaaccttatgatataaaaatatctttttcaaagaatccaagaagtttgcttttttacttggaagcacttttgaacaagacattttttgaggattttgagtcaatagggtttcaaaagaatgcttgtaataggatattgaaccctatggaaaggtgtgaatcaagttttgcttcattcaacatgatacatgggttgacttgggatgaagttttgagcaaagggacaagacattttagtgaagattttagtagattttgtgatagaaaaatgagtgaaattgttgctatgttgggttggaatagggcttggtctgaaccactattgcaagctttctttgttgcttcaaagagtgtttggatggttcatttgttggctaattcagttcatccaagtttacaaatatttagagttgataaaggagtcaactttgattctgtttacatggaagatatgggtggggacaagtcttcaaggttggtaccaaacatggttaggattatggttgcacctggtttttatgtctatggtagtgctgttaaatgtaaggttctttgcagatacttgaccaataacctcagcaacaacaaacaagaaaaaggtttaaacccatcaccttaaataaacccattttattttttatttttaatgtggaattggaaagtgtactctatttggtttggaatttagaatttggatcaggttctattgttgttatgattcatggcttgg

SEQ ID NO: 266 - DNA, 1913 bp, Medicago truncatula
catcaatggcggttcctccctccgccactcctgcttctctttacgtcggcgatctccatcccgacctctccgactctcatcttcacgatgctttctccgatttcaaaactctttcttctgttcgcatttgcagagactcttcctctggtaaatctctctgttatggctacgtcaacttcctctcccctcacgacgcaattcgtgctattgaggtcaagaatcattctacattgaatggaaaagctattagggtgatgtggtcgcgacgtgatcctgatgcaaggaaaagttgtatagggaacgtgtttgttaagaatttagctgaatcaatagataattctggattagaggatattttcaacaagtttgggaatattttgtcaagtaaagttgtaatgtctgaggatgggaagagtaaaggatatggctttgttcaatttgaaacagaggaatctgcaaatgctgctattgacaagttgaatggatatcttgttggtgataagcaaatatatgttggaaagtttgtcaagaaaagtgaccgcgtatcatctggcccggatactagatatacaaacttgtacatgaagaatttggacttagatattacagaaacatttctgtatgaaaagttttcgtcttttgggaaaatcattagtttggctattgcaaaggacagcaatggtatgtcaaagggttttggcttcgtgaacttcaatagcccagaagatgctaaaagagcaatggaaacaatgaatggattgcaactaggttcaaagattctgtatgtagccagggcacagaagaaggctgagcgtgagcagatcttgcaccagcaattcgaagagaaacgaaaggaacaagtcttgaaatataaggggtcaaacatttatgtgaagaatattgatgacaatgttagtgatgaaggactgagagatcactttagtgtatgtggcactataacttctgcaaagattatgcgagatgacaaagggataagcaaaggatttggttttgtgtgcttctccactcctgaggaggctaataaagctgtgaactcttttcatggattcatgttccatggtaaaccactatatgttgctcttgctcagcgaaaagaggacagacaggcacagttgcagctccaatatgcccagcaaattgcaggactcgcggggccttcaactgccattgtccctggtggatatcctcctttctactacacagctactggtgttgtttcacacgcgcctcctcgtgctgggctcgtgtatcagcctatggcattgaggcctggatggagggctaatggctctgcacctcctgccagatcattccaacagtcacctacgcctgttgtttctaacaataatactaggcagcataggcaaaataggggcaggatgaatggccatgcagtatcacagggaaatactcactctggtacatatatgccacaagcccagcaggcttctcagtcagcgatctcttcaagagagtcaagtactcagcagagaactgggcaagctaagtatgtacctagtgggcgccaccgtgagatggaaaaaggatctggtttatcatctactggaggatctctgggaccagaagtgctgcatagcatgcttgctaatgctactccagagcagcagaaggagatacttggcgagcatctatacatgcttgtccagaaaatcaagcctaacctagcagcaaagattactgggatgcttttggagatggacaatgctgaattgctggttctcattgaatcaccagagtctctttctgccaaggtggaagaagctttccaagtgctgaagaactctaaagctaaagtttctggtcaggatgtacttcattcaaatttcctttcagctgaggttgctgtgaactaatgacaattctttaagggc

SEQ ID NO: 267 - DNA, 1121 bp, Medicago truncatula
ttaatcacacttggccactcaactagcttctatagaatccagtgattatcataagcaccacccaccatcatggctgtggactttagttccatccccataattgatattagtcctcttttagccaagtcagatgatccaaaaatggctgaggatcctggtgtacttgatgttgttgcacaattggataaggcttgtacagaagcagggttcttttatgtgaaaggccatggcattcctgatagtcttcttaaaggggttcgagatataacgcgtagattcttcgaacttccatatgaagaaaaggcgaagatcaaaatgactccggctaatggtttcagaggatatgagaagattggagaaaatataactgaaggtgcgcctgatatgcacgaagctattgattgctatagggaagtgactaagggcatgtatggagatcttggcaaagttatggaaggattcaaccagtggccacaaaatcctccaaagttcaaatttcttatggaggaatatattagcctctgcaaagatcttgccaagaaaatcatgcgcggaattgctttagcattaggtggatcaccatacgaatttgaaggtgatcgagctggtgatccattttgggtgatgcgtataattggttaccctggtgtatccagtgatgacattggatgtggagctcacacagattatggtttattgactttgttgaaccaggatgatgatataaatgcacttcaggtaagaaacctatctggcgagtggatatccgcacctccagttcctgggacatttgtgtgcaacattggcgacatgcttaagatatactccaacggtttgtacgagtcaactttgcatcgggtgataaacaactcctcaaaatatagagtcagcgtagtatatttttacgagacaaactttgatgctgcggtagagccgttgaatacatacaaaacaaggataaatggtgacaagaagtttgaaagagccatctacggagagcatctagtcaagaaggtcctcacaaattttgttgatgagtgactgtttttctctttcttgtgaataataagttaagcatcttgtatgttgataagctcctgcttgcatgtccaaatctacta

SEQ ID NO: 268 - DNA, 477 bp, Medicago truncatula
aatcaatcgaacatgaacatgaacatgactagcatcacttcttcaattgcaacattggtgactccgttaccgttgttcatgaatacgaagaacaagattcagagcagaagcagcaaaatgactcggataagatgtgacgtcggagaagaagattcatcatcatcatcatcatcaacagcgaagattggatcgcgtgttagggttaaggttcctctcaaagtctatcacgttcccaaagttcctgaagttgatctaactggtagagaaggagaaatcaaacagaacgtgactttctggaaagataataagcgaatctctgctaatcttccttataaggttgagtttgttgctgatgatattcaaggtcctcgtggtcctctcaagttcgttgctcatctcaaagatgatgaattcgaatttctagaatagagtatttcataaataattacgcatatcaattactacattagagagagg

SEQ ID NO: 269 - DNA, 1566 bp, Oryza sativa
taatcttcttctcctcacacattcacacacacacaccccgcagaccccggcaccttaccgagcggcggctcagcacgctgctgctacgcacatggacaagagccagggagtcctactgtccagcaacgtcggggccggctcccggccgtggccggagctgctcggctccgcccactgggacggcctcctcgacccgctcgacctcacgctgcgccgcctcatcctgctctgcggcgacctctgccaggtcacctacgactccttcaactccgactcccactccaagtactgcggcacctgccgcttctccaggtccacgctcctcgaccgcacgcagttcccggccgccggcgacctctccgtcgccgcctacctctacgccacctccgacgccacggcgttcccggggagcatggtgtactcgatgtcgcgcgaggcgtggagcaaggagtccaactggatcggctacgtcgccgtgtccaacgacgccgcagcggccgcctcgggccagcgcgtcatctacgtcgcgtggcgcggcaccatccggtcgctggagtgggtcgacgtgctcaagccggacctggtcgaccacgacgacatcctccccgaggggcacccggggcgcggccggtcgcgcgtcatgaaggggtggtacctcatctacagctccaccgacgagcgctcccctttctccaagtacagcgcccgcgaccagatgctcgccgccgtgcgcgagctggtggcgaggtacaggaacgagagcctcggcgtcgtctgcacggggcacagcctcggcgcgtcgctcgccacgctctgcgcgttcgatatcgtcgtcaacggcgtgtccaaggtcggcgacggcgcgcacatcccggtgaccgccgtggtgttcgggagcccgcagatcgggaacccggagttcaagaagcagttcgaggagcagcccaacctgcgggcgctgcacgtcaggaacatgcccgacctcatcccgctctacccgagcggcctcctcggctacgccaacgtcggcaaaaccctccaggtcgactccaagaagtcgccctacgtgaagcgagacaccagcccaggcgactaccacaacctgcaggggatcctacacacggtggccggctggaacgggaaggacggcgagttcaagctccaggtgaagcgcagcgtcgcgctggtgaacaagtcgagcggcttcctcaaggacagcaaccttgtgccggagtcatggtgggtggagaggaacaaaggcatggtgctcggccagaacggggaatggcagctcgaggggcccgcagaggagaacctgcccgtgccaccggtggtgaccgggaagatcatcgacgacgacgtcgctgccgtggccacctccagcagtgccaaggaggataagaagacgggcaaagggtctaagcttctgtctggattgattgatcaactgctttgtgtgcctgatacatgtaaagccggagctgcgtgagttgttgaagaccacatcagaaaaagactcgagagcggtggcgtcgaactgatatgcttgtgaagtagctggagctt

SEQ ID NO: 270 - DNA, 1109 bp, Oryza sativa
ttggcatggattctggtgctgctgccgtctgcgcggagaaggcgagtgagatcatcaagatcggtcaggttgatgacgtgcaggagctgcagcgacgactgtgctccgccaccaccgtgccggagcggtacatcagggacggcgacgaccggccggatcacgccgtcgtcgacgacgagcgcgcgcaggagcggattccggtgatcgacgtcggcgagctgcagcgcggcagcgaggacgagctcgacaacctcaggctcgcctgcgagcagtggggcttcttccaggttgtgaaccatggagtggaggaggagacgatggaggagatggagaaggcggcgagggagttcttcatgctgccgctggaggagaaggagaagtaccccatggagcccggcggcatccagggctacggccacgccttcgtcttctccgacgaccagaagctcgactggtgcaacatgctcgccctcggcgtcgagcccgccttcatccgccgccccaacctctggccgacaactccggccaactttagtaagacgctggagaagtactcggtggagatcagggagctgtgcgtgcggctgctggagcacatcgcggcggcgctggggctggcgccggcgaggctgaacgggatgttcggggaggcggtgcaggcggtgaggatgaacttctacccgccgtgcccgcggccggagctggtgctggggctgagcccgcactccgacggcagcgcggtcaccgtgctccagcaggacgcggcgttcgccgggctgcaggtgctccggggcggcggcggctgggtggccgtccatcccgtccccggcgccctcgtcgtcaacgtcggcgacacgctcgaggtgctcaccaatggcaggtacaagagcgtggagcaccgggcggtggccagcggcgagcacgaccgcatgtccgtcgtcaccttctacgcgccggcgtacgacgtcgagctcggcccgctgccggagctcgtcgccgacggggagccgcgcaggtaccggacgtacaaccacggcgagtacagccggcactacgtcaccagccggctccagggcaagaagacgcttgaatttgcaaagatttaatga

SEQ ID NO: 271 - DNA, 1386 bp, Oryza sativa
acctttcccatccctagctgctgcccttccatcggatccacggatcgagacctggcacggcggcggaggacgggccggcggagatggaggtggaccacgcggaccgcgacggcgcgcggcgccggtgccgcgagtacctgctcgcgctcgaggaggagcgccgcaagatccaggtgttccagcgggagctccctctctgcttcgacctcgtcacccagactatcgaggggatgaggagccagatggacgccgccggcagcgaggagacggtcagcgaccagggcccgccgccggtgctcgaggagttcatcccgctcaagcccagcctctcgctgtcctcctccgaggaggagagcacccacgccgacgccgccaagtcaggcaagaaggaggaggccgagacgtcggagaggcattcgtcgccgccgccgccgccgccggaggccaagaaggtgacgccggattggctccagtccgtgcagctctggagccaagaagaaccccagcagccatcgtctcctagcccaactcctaccaaggatttaccgtgcaagccggtggcgctgaacgccaggaaggccggcggagcgttccagccgttcgagaaggagaagcgcgccgagctgccggcgtcgtcgaccacggccgcggcgagctcgaccgtggtcggagacagcggcgacaagcccaccgatgatgacacggagaaacacatggagacggacaaggacaacgacaaggacgccaaggacaaggacaaggaaggccagtcgcagcctcaccggaagcctcgccggtgctgggcgccggagctccaccgccgcttcctgcaagcgctgcagcagctgggcgggtcccatgtagcgacgcccaagcagatccgggagctgatgaaggtggatggcctcaccaacgacgaggtcaagagccatttgcagaagtatcgtctacacacgaggaggccgagctcgacggggcagagcagcgccgcagccggcgtccccgccccgcctgcgccgcagttcgtcgtcgtcgggagcatctgggtacccccgccggaatacgctgccgcggccgccgcacagcagcacgtgcagcttgccgccgccggcaataatgcgtccgggagcgccaaccccgtgtacgctccggtggcgatgctgccggcaggcttgcagccgcattcgcatcggaagcagcaccagcagcagcagcaaggacagagacattccgggtcggaaggccggcggagcggggacgccggcgatggcagctcgtcctccccggccgtctcgtcgtcgtcgcagaccacctccgcttgattagtgtagattcgtcgattacatcattatatgtacgtagtacgagagtgcatcacatcaaagt

SEQ ID NO: 272 - DNA, 1376 bp, Oryza sativa
caaatccttctcgagcaacagctaggggggagtggttcgcttcgtaagaagccggctacctctgctcgatcccgcctttgcctgcggattcccaccctgattttcgccgtttgtttgtttagtttcttggggcaaattcgagacgaggggaggagagtttttttgggggggagttgttgcggccttgcgggcggggtatgcggctgcacggggaggtttccttcgatgaggacgaggaggaagtggtgatggttccggcggcggcgctgtcgtcgtcgccgctcaacggcggggccgttccggtgacgaggctcgtggtggggtacgccctcaccaagaagaaggtgaagagcttccttcagcccaatctgctgttgctggcgaggaagaagggaattaatcttgtagcaattgatgacactcgcccgcttgcagaacaaggcccatttgatgttatcttgcacaagattactagcaaggaatggcaacaggttctggaggattatcatgaggaacatccagaggttactgtccttgacccaccaaatgccatcaatcatctgaataatcggcaatctatgcttgcagaagtatctgatttgaacttatccagtttctatggagaagtttgcactccacgccaactggtcattatgagagatccatcctctataccaaccgcagttgccatggctggactaaccttgcccttggttgcgaagccattggttgttgatggaacatctaaatcccacgaactatctcttgcatatgatgaggcatccttatcaatgcttgatcctcctctggtcctccaggaatttgtgaaccatggtgggatcctctttaaggtgtacatcattggtgaaactatacaagttgtacggaggttttctcttcctgatgttaacacttatgacttattaaacaatgttggcgtctatcgatttccaagagtttcatgtgctgcagctagtgcagaccatgcagacctcgatcctcatatctcagaacttcctccaagaccactcctagagaaactgggaaaagagcttcgtggaagactgggtttaagattgttcaacatagatatgatcagagaacttggaaccaaagatcggtactatataattgacatcaactacttcccagggttcgggaaaatgccaggttatgagcacatattcaccgatttcttgctgaatcttgcgcaaagcaagtacaagaagtgcttaagcggcggctgaagtgcaaagagtcctgctgaacattaacaaaatggaatgtaacggtctagcagtcagtgtacatatctcggagaaataagtttaatcccaaggctttgaggaagagagatttagggtgtcttcccagaa

SEQ ID NO: 273 - DNA, 2005 bp, Oryza sativa
gtggagtggactggttatcgtccacgcaagacgacgacgacgacgacgacggccggagctcgccggagcatcggtgtcagagatgagggtcatgaagctcggaaataggccggacaccttcttctcgtcaggccccgtcaggtcggtctccacggatttggccactgacatgcagattcttgtggatggttgcctgtttcgtctccacaagtttcctttgctttccaagtgcatgtggctgcaagcgctgtgcgtggagtccggcgacggcggcggcgccgtcgagctgccggctttcccgggcggcgcggaggcgttcgaggcgtgcgccaagttctgctacggcgtggccgtcacgatcgggccgcacaacgtcgtcgccgtccgctgcgccgccgcgcggctcggcatgtccgaggccgccgaccgcggcaacctcgccgcgaagctcgacgccttcctctcctcctgcctcctccgccgctggaaggacgcgctcgccgtgctccactccacgcgccgctacgccgcgctctgcgaggagctcggcgtcacgtcacgctgcgtcgacgccgtcgcggccctcgccgtcggcgatgcctccggcgccgttccggccggttcgtcttcgtcgtcgccgccgtggtgggcgcgtgacatctccgagctcggggttgacctctactggcgcgtcatggtggccgtcaaggcgaccggcaccgtgcacgcgaaggccattggcgacacgctcaaagcctacgcgcgtcggtggctgccgatcgccgccaagaaccaccacgcggcagagcgaaccgccggcggcggcggcggcggcgcggccaatgccgagcgggccaccaagaaccaccgcctcctcgtcgagaagatagtgagcttgctcccggcggagaggaacgccgtctcctgcggcttcttgctgaagcttctcaaggcggcgaacatcctaggcgcttctccggcgtcaaaggcagagctcacgaggagggtggcgtcgcagctggaagacgccaacgtgagcgacctcctgataccggcgccgccgccgtgcgcgggcggggtgctgtacgacgtggacgccgtggtgaccatactcgaggaattcgcgctgcggcaagcggcggcgtcggggagcccgaagggcagcccggcgcgcgcgggcaggcaccggcgatcgatgtcggccgagagcggtgagctcgagggggcgcgccgttcgacgtccatggcggcggtgtcgcacggcgcgatggtccgggtggggaggctggtggacgggttcttggcgatggtggccacaaaggacgcccgcacgccgctcgacaagatgatcgccgtcgccgaggccgtgccggacttcgcgcggccggagcacgacgatctataccgagccatcgacacatatctcagggcgcacccggagatggacaagagctcgaggaagaagctgtgcagggtgctcaactgcaggaagctctcggagaaggcttccatgcacgcggcgcagaacgagctgctccccctccgcgtcgtcgtgcaggtgctcttcttcgagaacgcgcgcgccgccggactctcgtccgggcacggcaaccgcgtcgccgcgcgctttcccggcgacggcggcgacgtcagtgcgctgcttggcactggcaggccaagaacgacggaggagaacggcaaggacgggcagagccccgccgccgccgggagcgtggcggcggacggcgactggagcgtggaggggctgaggcgcgcggcgtcgagggtggcgacgctgaagatgaggctggaggaggaggacggcgaggacgccggcgacgaggcgttcgtgcataggacgcgcgcggggttggcacggagcgcgtcgtcgcgtgtcacggcggcggcggggaggtccaagcggatgctgagcaggctatggccgacgagcagaaccttcacctaaggggcatcaagacacttgagcaaagctgatccgtactag

SEQ ID NO: 274 - DNA, 1025 bp, Oryza sativa
gtgcgatgtcgtcgtctccggcgcatgctcagcgcttctactgccaccagtgcgaccgcaccgtccccatcccgccgcccacctcccccgacgccgacgtcctctgcccgttctgcggtggaggcttcgtcgaggagcttggggaggacatcaaccccaaccccaaccccaaccctagccccttcctgccacaccaccccttcttccccttcgcctccccatccttcgacctccgcaaccctagcgacctcgcggccttcttcgggcccccctccccctccccctccccctccccagccgccaggcacttcgacccctccaacttcctccatgatcacttcaccggcctcctctctggcggcgccaccatccagatcgtcctcgagggctcctccgcctccctccccctcgggggcgccgccgccgggcccggggggatcagcctcggcgactacttcgtcggctctggcctcgagcagctcatccagcagctcgccgagaacgaccccaaccgctacggcacccctcctgccgccaagtccgccgtcgccgcgctccctgacgtcgccgtctccgccgacatgatggccgccgatggaggggcccagtgcgccgtctgcatggacgacttccacctcggagctgccgccaagcagctcccctgcaaacacgtcttccacaaggattgcatcctcccctggctcgaccttcacagctcctgccccgtttgccgcttcgagcttcccaccgatgaccctcaccacgcccacccaacccttggatctcaccgccccgccgcacccgcctctgcctctgcctctccctctccagctccaccacctaggctggctgagagaaggttcaggatatcgctgccatggcctctccgtgctgcgtttggcggccaggcggagagcagcaatcctaccaatcaggatcctgttggtggttctactgatgcttccggttctggcaacaacaatgcaactggaggtcatcgtggctacgatgatcttgactgatga

SEQ ID NO: 275 - DNA, 1316 bp, Oryza sativa
gaacagtgtcactctagcttcttcctctttctctctataaatcttttcccgagccaagaaaaccaccattaaacccaccaccaccgccacctcctccacctccatggcgatggcgatgcaccggttcagcctctgctgcgtcgtcctcctcgtgctcgcgccgctcgccgccgtcgcgtggcggccgtggccgccacggaatgggagcggcgaggttgaggggatcggggcgtccaagaagttcgaggggtcgtcggatttcgtcaagctgcagtaccacatgggccccgtcctcgccgccgacatcacggtccacccgatctggtacggccggtggcccgccgagcagaagcgcaccatccgcgcgttcctccggtcgctctcgccgccgggctcgggctccggcgatggcggcatcccgtcgccgtccgtggcggcgtggtggcgcaccgtgcggctgtacaccgaccagacctcggcgaacgtgtccggggtggtgaggctcgggcgggagaagtgcgacgcgcgcgcgtcgcggggcgggcggctgacgcggctcgacatccagtccgtggtgcgggacgccgtgacggcgcggacgcggccgctccccgtggactcgagcggcgtgtacctggtgctgacctcgccggaggtggtggtggagaacttctgcgggcaggtgtgcggcttccactacttcacgttcccgtcggtggtcgggtacacgctgccgtacgcgtgggtggggaactcggcggcgcggtgcccggaggtgtgcgcgtacccgttcgccatcccgtcgtacgtgggcggggggcggagggcggaggcgccgccgaacggcgacgtgggcgtggacgggatggtgagcgtcatcgcgcacgagctggccgagctggcgtcgaacccgctcgccaacgcgtggtacgccggcgaggacccgtcgttcccgacggagatcgccgacctgtgcgaggggatctacggcaccggcggcggcggcgcgtacaccggccagctgctcaccgacggccgctccggcgcgtcgtacaacgtcaacggcgtcggcggccgcaagttcttggtgcagtgggtgtggaaccccatcctcagctactgctccggccccaacgcgctcgaccagtagccgccgccgccgccacgcacgaacgcagtgttcgtccgcccatggattcggattccttttcttgggaatccatggtagctttaaattcttgtatagatcgagccggtgaagtgaacaagggtggcgatgtttggggttttgggtgactttgggtgaatggatggta

SEQ ID NO: 276 - DNA, 1630 bp, Oryza sativa
ccaaaccctaaccctaggcaccgctcgagggaggcggcggcgatggccggcgaggggagcggcggcgagggcggtgcgggcgccttcgaggacgaggcggagccgacggtcaccatcggggagtacatcgaggggatcgaggccgaggagctggaggcggatttggtgctgggcggggacgacggcaaggagtgcacctacggcggcggctacctcaagcgccaggccgtcttctcctgcctcacctgcgtgccagcgggtgtcgctggagtctgcaccgcctgcagcctcgcctgccacgacggccatgaggtcgttgaactatggacaaagcgaaagtttcgttgtgattgtggcaactcaaagtttggaagtcatgtttgcaaactttgccctgagaaagatccagagaatccagtgaattcttataaccataacttcaaagggtcctattgcacatgtggcaggccttatcctgatccagaagctgaaaagcaagttgaaatgatacaatgctgtatttgtgaggattggttccacgaggatcatattggtcttaactccattgaagagataccacgagatgaggaaggggagccactctacgaggatttcatatgccccaaatgctcacctaagtgctatttcttgaaattatatccggatactatttgggcatctaataagcagagttctgcaccacaagctgagactaccaattcaactgttatgaatggaaattcaagccttggtgacatagagaaaagtgaaaatggtgctcttataaatcatttgaattgtgaaaagacctctgacaatgagaattgcccaaaagacagtgtagctccagaaaaggccagtctggatgacagttctgatggcaaatgtaagctaggaatgaacatttgttcaaatacaccatcagctgattcagagaaaaagatgccgttttttatgtcaaaaagctggagagaggttatctgtagatgtgaaacttgcaccgacttctatgcacaacaaggtgttgcgtaccttatagacaaggaagactctattgaggagtatgagaaggttgctaagcagaagagggaaaagaagttggagcagcaggaaggagttgaagcaaactttcttaattcactcgaccatgtacagaagattgagattttgagtggcatcaatgacatgaagaatgagcttcagtcttttctggaaacttttgattcatcaaaaccggtcacatctgaagatatacgagctgtttttgagaatcttgctaagaagaaaaaacagaggttgtcatgaaactcagctgcttggggttctgtttgagactaatatatcccactgccggtcgatcgagcagtttttctggccactcccccgtgaatttatcgttcgctatgtcatggctattgtgtcctgttacctagcttgtactcgacttctaatgtagttagcagaggtagtaatgctaaatgctccgaactgagcttctggtagatgctccagggcagcagaacaaaatgtttgctcctttgtatcaaatcaaaagaactttgtgacgtggtaatttacattacccaaaaccgtgtaaccctttgtgccgctcctttaatcatctgttgcc

SEQ ID NO: 277 - DNA, 1413 bp, Oryza sativa
cttcctcaacactcaacacagcagagcagcgcaaaacagagcagaccaagagcaaggagacgacgacgacgacgacgatgcaatccctcctctcctcctcggtgctcgccaacccatgcaccaccggctccccgctcttcccgccgaccgctgctaagctcgccgccgctgcctcggtcccggtggccgcggcggcgaggagtggcgccattgctgccgtgtcgaggagatcggccagtggcggccggtgcgtggtggcggctgcgtcgtcgtcgtccccggcggtgaccacggcggaggccggcgaggtgcccgcgacgatgaaggcgtgggcgtacgacgattacggggacggcagcgtgctcaagctcaacgacgccgcggcggtgccggacatcgccgacgaccaggtgctggtgcgcgtcgccgccgccgcgctcaaccccgtcgacgccaagcgccgcgccggcaagttcaaggccaccgactcccctctcccgacggtgccggggtacgacgtggccggcgtggtggtgaaggccgggaggaaggtgaaggggctgaaggaaggggacgaggtgtacggcaacatcagcgagaaggcgctggaggggcccaagcagtcggggtcgctggcggagtacaccgccgtggaggagaagctgctggcgctcaagcccaagagcctcggcttcgcgcaggccgccgggctgccgctcgccatcgagaccgcccacgagggcctcgagcgcgccggcttctccgccggcaagtccatcctcatcctcggcggcgccggcggcgtcggctccctcgccatccagctggccaagcacgtgtacggcgcgtccaaggtggcggcgacggcgagcacgcccaagctggagctcctcaagagcctcggcgccgacgtcgccatcgactacaccaaggagaacttcgaggacctgccggacaagtacgacgtcgtcctcgacgccgtcggccagggcgagaaggccgtcaaggtggtgaaggaagggggcagcgtggtggtgctcaccggcgccgtcgtgccgccggggttccggttcgtggtcacctccgacgggtcggtgttggagaagctcaacccatacctggagtccgggaaggtgaagccgctggtggaccccaaggggccattcgccttctcacaggttgtggaggccttctcctacctcgagacagggagagccaccgggaaagttgtcatctcacccattccatgagagcttgacatcaatggcagagcttatgatggtctctcgcacctgagattctgattctgaagtgtgtcagcatagaccaaaatgaagtttatctcatattacagttcatagagttacactgttacacaagttgtatgcactgtgatgaactgctgagcaatgt

SEQ ID NO: 278 - DNA, 1120 bp, Sorghum bicolor
aaaggatccgcccgctataaacggactaggcccgtggatgcggcaccgcctgctccgccgcgcgatgccgatccctccgccgccgcaatctccccggacgccgggggtcgccggcgggcgtctcttcgcttcgctcccgctgccgccgccgctccagtctcgaagagaggtgcatgtttggtatcttttgcctgatgagttgaatgatgcctccctactgaagatgtacacggagctcctttccccttctgaaaggaagactgctttgtcaatgaacggggaaaagttgcagaaaggtgctgtgctgtcccgtgcactggtgcgcaccaccctctcgagatatacagattgtaaagttgatccaagatcatttgagtttaagaaaaacaagtttggcaaacctgagatactgtggcaatctgatgacagcaggatggaatggcctttgcatttcaatatttcacacacatcttctttgattgcctgtggcataaccatggatgctcctattggcattgatgttgaagacaagaaacgaaagacagccaagaatattctatctcttgctcgccgttatttcaccccatctgaaattgattatctagctaaaattccagatcctgatggtcagcaaaaggagttcataaaactatggactcttaaagaagcatatgtaaaagctctcggaagggggttttcaggcgctcctttcaacaaattctcgatcatcttggcagcaaataacagaatcaaaatttctgtggcaccaaaagcattcaatgattctgactctagctgtgactgtctgtccgagaattggcaatttgcagttgctgagctaaatagttctcattacatggcaatctgtacagaggatgactcaacaagttcagattctggaaacggcagactgccactaggattgaaagtatggaagaccattccattcgttgaagatatacttgtttcgggaacagaagctgtaaaacttgtcagttgagtatgtgagaggatctgctattggtctattaatgatttcaccagatgacacattgtggtgcaacgaatatatttggacaaagtatgcatggagactgaacattcttggagcggtaccttt

SEQ ID NO: 279 - DNA, 1834 bp, Sorghum bicolor
ccgccaaggatacatacgatacgatacgtcttgcagctgcgggttgccttcttctccggtggacctcgtcggggttatgcggaggagctggtcgtgcttgtcctgcttgcccatggggacggcggcgctgcccattgaggaccgattcgttcctccggctgggctaccggcggtgcccgcgtcaggttcagaagatggaggatttggcaagggcagcatagaccttggaggcctggaggtgcgccaaatcaccacatttgccaaggtctggtccaccacgcagggcggccaagacggcctcggcgccaccttcttcaagccctcgccggtccccgccggcttctccgtgctcggccactacgcgcagcccaacaaccggcctctcttcggtcatgtcctcgtcggtcgggacacgtctggcaccggtgcagtcctcgccgcgccactggactacgccctcgtctggtccagcccggacggcgccggccacttctggctccccacggcgcccgaaggctacaaggccgtcggcgtggtggtcacagccgcggcggacaagccttcgcccgacgaggtcaggtgtgtccgttccgacttcaccgacgcgtccgagatcgaggacacggtgttgaccagcgacaaggatggcttcagcgcggccaccctgaggccggcggtccgcggcatcgacgcccgcggcgtgcacgctggcacgttcctcgcccagagcagcgcgacgccggcgtgtctgaagaacaacagcgcgagctacacgtccgccatgcctgacctggcccaggtgaactcactcctggcggcctacgcgccgcacgtgtacctgcacccgaacgagtcctacctcccttcgtcggtgacgtggttcttcgagaacgacgcgctgctgtaccagaagggcagccagaccccgacgccggtggccgccgacgggtcgaacctcccgcaaggcggcggcaatgacggcgggtactggctggacctgccggtggacaacaaccagagggagaaggtcaagaagggagacctcgccggtgcgaaggtgtacgtgcaggcgaaaccgatgctcggcgggacggtgaccgacctcgcggtgtggatcttcttcccgttcaacgggccggcgcgcgccaaggtcggactcatccagtcgatcccgctcggcaagatcggcgagcacgtcggcgactgggagcacgtgacgctgcgcgtgagcaacttctccggcgagctgctccgggtgtacttctcgcagcacagcgcgggcacctgggtggacgcgtcgcggctggagtacctcgccgacggggacggcgggaacaggccggtggcgtacgcgtcgcagcacgggcacgcgttctacccgaacgccgggacggtgctgcagggcaacacgagcctgggcatcgggatccggaacgactgcgccaggggtagccggctggacaccggcgccgggcggtgcgaagtggtgtcggcggagtacctcggcgtcaaggagccggcgtgggtcgggttcgagcgcgagtgggggccgcgggaggagtacgacatcgggcgcgagatcaaccgcgccgcgaggatcctgccgcgttcggtgagggagcggctagccaagctggtggagaaggtgctcgtcggggaagggccgacggggcccaagatgcatggtaactggagaaacgacgagaaggaagcctgacagcagattaaggattgcctgcagatgcatggtaaccgtgcaattcgtgaggaatatatatacggatcagacggttcgcgattgaccgacagcagattaaggattgcatgcatgtag

SEQ ID NO: 280 - DNA, 393 bp, Sorghum bicolor
ctggtagccatggaccggtccaagtcgtacgcgggcgggcgcatgcagatcgagccgtactacggcggcggcggcgcgcggccggacttccggtcctactcgtacagcgccggcgggggcgggatggggacgtcgtcctactcctcctcctcctactcgtaccagtacgagtacggcggccctgcggcgggggcggcggcgggggaggaggtgaagcggagcaagtcgaagcggcggtggctggcgctggcggacccggacatggatcgcaagcgccgggtggcggcgtacaaggcgtacggcgtggagggcaaggtgaagggctccttccgcaagagcttcaagtggatcaaggaccgctacctcaacctcgtctacggatggtcctgatga

SEQ ID NO: 281 - DNA, 866 bp, Sorghum bicolor
ggaagatgtcgtcgctgcggaatgcgatcccgcggcgcgctcacaaggagcgctcccagccggaggcgaggaagaagtttgggcttttggagaagcacaaggactatgtcgtccgggcgcgggcttaccacatcaaggaggcaaccatcgcgaaattgaaggagaaggcagcatttaggaacccggatgagttctactttaaaatgatcaacagtaggactgttggtggaattcatagacctaagcctgaagataataagtatacagaagaggaacttcttctgttgaaaaataaagatatgggatatatccttcagagcattcaaagtgaaaaaaagaaaatcgaaaagttaagctcaacacttcatgaactggataacaagcctcaaaacaagcatgtttattttgctgaagacagagaagaagcgaaagaaatacaatcaaggataggacaaagcaacaacatgcctggtcttgacaacatcccttctcgtataaagaaaaaaacagcctcttcatacagggagttagaagagaggaagcagcggcttcaaaagcttgagaaattgtatgcagacatggcattgcaaaaagaattgaagaaacctggacgcaagaggaaactgaaactcaatgaagatgaggagacggataatcaaacatcacagcctgtttataagtggcgagcacagaggaagcgatgatatgaatgggtgacagagtaaggaaaaggcaaggcattagtagtggaagcatggtcatagtggcgtacttgctggcgattgatcagctctttttcgatccaaaaagacttacctgcaaaagtagccctccgcaagaactactatggctttgtcaaactgttg

SEQ ID NO: 282 - DNA, 1944 bp, Sorghum bicolor
tccagtctcgatctaatctaaagagcatctcaaaaggaagatagcatcgtcatgagaccggaaggcgcagcgcggttggcgtggctgctcctgctcgccgccgcggccgcggggcatggcggcgtgcagccgctgtcgcgcatcgccatccaccgcgcacgcgtcgcgctggacgcgtccgccgcggtgcgggcctcgccggagctgctgggaaccaagggcgaagatactgcctgggtgaacgttgattttattactccccatccaagtgatgatgattggatcggcgtattttctccttcaaacttcaacgcgtccacatgccctggttctcacggatctggcccaggtcctgtgatatgctcagcaccaataaagtatcagtttgcaaattactcatcagattttggaaagtctgggaaaggggcactgaagttccagctgatcaaccagcggcaagacttttcatttgcactgttcaccggtggactctcgaatccgaaacttattgcagtgtcgaatgccattgcttttgcaaacccaaagtctccagtttatccacgcctagcacaaggaaaatcctggaatgagatgactgtatcatggacaagtggctatgatataaatgaggcatatccctttgtcgaatggggaataaaatggagccccgcggtacgcactgcagctggcaccgtcacttttgatcgtgatagcatctgcggagaacctgctcgatctgttggttggagagatcctggtttcatacacacagctttcctaacagacttatggccaaataaagagtactactacaaaattggtcatatgctgccagatggaaatgttgtttggggcaagttgtcgtccttcaaggcacctccttatcctggacagaagtcgctgcagcgtgttgttattttaggagatatgggaaaggctgagagggatggaagcaatgaatacgccaactaccagcctgggtcacttaacactactgatacactaatcaaggaccttgacaacatagacatagtgttccacattggcgacattagctacgccaatgggtacatttcacaatgggatcagttcacacaacaagtggaagagatcacttcacgagtcccttacatgattgcgagtgggaatcatgaacgagattggcccaacagtgggtcatacttcaatggaacagactctggaggggagtgtggtgtgttagctgagaccatgtactatacgccaacagaaaacagagcaaactactggtactctacagattatggcatgttccggttctgcgttgcggacagcgagcacgactggcgggaaggcacggagcagtacaaattcatcgagaactgcctcgcgacggtcgaccgaaagaaacagccgtggctgatattcatcgctcatcgcgtcctcggctactcctccggttacttctacggcagagacggatcgtttgctgagccaatgtcccggcaaagcctccagaagctctggcagaagtatagggtggacttggcgttctacggccatgtccacaactacgagaggacatgccctgtctatgaggaacaatgcatgagctcagagaagttccactactcgggcaccatgaacggcaccatccacgtagtcgttgggggcggcggcagccacctgagcaacttcacaatccaggtcccggcgtggagcgtatacagggagatggactacggcttcgtcaagctcacggcgttcaattactcgtcccttctgtacgagtacaaacggtccagcgatggcgaggtgtacgatagcttcactttgcacagagagtacagggacgtgttagcgtgcgtcaaggacagctgccctccgactttaaaatcgacatgacatgcagccattcagttttctgaacgtggcgctgcttctgcgtgtaactgtgagtgatag

SEQ ID NO: 283 - DNA, 1865 bp, Sorghum bicolor
gcaccggaagctggatccgcccctgcggtggcggcatgagcggcggggcgtcgctgggggtcaggtcgtcggggagctacggatcgctgccgcagcagcagcagctaggcggctgccagtcgtcgccgtcgccgtcgccgccgctcgccgcgcggaagcccgcgaagatgtccctcggcggggccggcgccggcgccggcggcccgcgcgtcttcgcccggatctgcaagctcgccggacgccgccagcggatgctcctcctcctcctcgtcgccgtcgccgtcgccttctgcttcctcttctcatcacttgtcagtaaagacgaagatgcatcacctggcgttgagaccatgcttgtgttttctgatcatgtccggagctttgtgaaccctggttggacatcgtcgggcagaccagtagctcagagaggttcgctgactgtgaatggtttgaatacagcatcgcacatggaaaaacaatcagatagcaaacaacaagttcaggaactcatgcagagttttccaccagctgttatggatcatcatccttgtgaaaatttctcattgtctcctccacctattgatagaaaacgcactggaccacgaccctgtccagtttgttatttgccagttgagcaagcgctggcactgagaccagctaaaccatcattgtcaccagtccttcaaagcttaaattatatgtttgaagagaatttgattcccaaagagtcaaagagtggttctttgtttggaggttttccatccctggaggaacgagaaaagtcttatgacataaaagactcaatgactgtacattgtggatttataagagggaagacacctggtcttagtactgggtttgacatagatgaagctgatcgttctgagatgcagctgtgccagagcactgttgttgcctccgctatttttggtaattatgatgtaatgcaacaaccagaaaatatcagcaaattttcaaaagatacagtttgcttctttatgtttctggatgaagaaacagaagccgcaataaagaactccactactattggtcatactaaaagaatcgggctgtggcgggtagttgttgtccgcaacctaccatttacagatgctaggcgcaatggaaaggttccaaagctcttacttcatcggctttttcctaatgtgcgatattcaatttggattgatgggaaacttaagctagtgagggatccttatcaggtattagaaaggttcttgtggaggaagaatgttagctttgctatttccaggcattacagacgcttcgatgtttttgaggaagctgaggccaacaaggctggtggaaaatatgataacacatcaattgactaccagatagagttctacaaaagagagggtctaacccattattcgtcagctaagcttcctataacgagcgatgtcccggagggctgtgtgataattagggaacatgtccccataacaaacttgtttacatgcctttggttcaatgaagttgaccgcttcacgtccagagatcagctaagcttcagcacagttagggataaaataaggtcacgagttaattggactgcagacatgttcctggattgtgaaaggcgtgattttgttgttcagtcataccaccgagaactgttggaacagaggcaggctaccttacgaagttggcctccccagcggccacccattgtgcgcgtccaccctagaaagatgcttccagacaatgcagcaaaggaaccatggagggcttctgcgaccaagaagttatcagggaagcgaacacgggataagagatcaagctcaagacgaactcatcgaactaacatgaaggaagcaattcaactgtaaatcctggcatga

SEQ ID NO: 284 - DNA, 2718 bp, Sorghum bicolor
gccaccatgagggtcttgctgctgctggcgctgctgctggccgcttgcgccgcggcggcggcgcaggcggcgggaggggccaactccaactccacctccacgccgttcgtgccgcgggacgacatcctgctggactgcggcgccaaggggcagggcaacgacacggacggccgggtgtggaccggggacgcgggctccaagtacgccccgccggacaacctcgcctcggtggcctccgcctccggccaggatccctcggtcccgcaggtgccgtacctcaccgcgcgggtctcggcctcgcccttcacctactccttcccgctcggcccgggccgcaagttcctcaggctccacttctacccggccaactactccaaccgcgacgccgccgacggtctcttctccgtctccgtcgccatcccgggcggaaagctcacgctgctttccaacttcagcgcctaccagacggctgccgcgatcacctactcgtacctcgtccgggagttctccgtcaacgtctcgtcccagacgctcgacctcaccttcaccccggagaagggccaccccaacgcctacgcgttcgtcaacggcatcgaggtcgtatcctcccccgacctcttcgacctctccattcccaacatggttgctggcgacggcagcctccagcagttcgaaatcgatcctggcacggcgatgcagaccatgtaccggctcaacgtcggaggccaggcgatttcgccctccaaggacacgggcggttaccggtcctgggacgacgactcgacctacatctttggcgccagcttcggggtcagctacccgaaggataacaatgtcaccatcacatatccaagcaatgtgccggagtatgtggcgccagaggatgtctacggcacagcgcgttccatgggaccaactaaggaagtgaacatgaacttcaatctcacatggatgttgcaggtggatgctggattcctgtaccttatcaggctgcatttctgtgagatccagtacccgatcacgatgatcaatcagcgggtcttcaacatttacattaacaaccagactgcagtcaagggtgctgatgtgattgcatgggcggccgttagtggtgctaccacccgtattggctctccggtgtatcaggactatgtggtgagcacaccgggtgtaggggccatggatttatggatagctctccatccggatcctgactcaaaaccacaaatatatgatgctatcctcaatgggatggaggtgttcaagttacagcttatcaatggtagccttgcagggctcaatcctatcccaagtgttgccccggccaatgatgggacaactaagaagaagtcaactgttgggcctatcgtcggtggagtggttggaggtttggtggttcttgcacttgggtattgctgcttgtctatgatctgcaagcgtaggaggaatgctgggaaggatgcaggcatgagtgatggacattctggttggctacccctgtctctttatggcaattcacacacttccagttcggccaagtcacacactactggtagctatgcttcatctttgccatccaacctgtgccgtcatttctctttcgctgagatcaaggccgcaacaaaaaactttgatgagtcccttattcttggtgtgggtggatttggtaaagtttaccgtggtgagattgatgggggaacaactaaggtggctatcaagcgtggcaatcccttgtctgagcagggtgtgcatgagttccagactgagattgaaatgctgtccaagctccgccaccgtcatctggtgtcactgattgggtactgcgaggagaagaatgaaatgatcctggtctatgattacatggctcatggtactctccgcgaacacctgtacaagacccagaattcacctcttacctggaggcagcgtttggatatctgcattggtgcagctcgtgggcttcactaccttcacactggtgcaaagcacaccatcatccaccgtgatgtgaagacaacaaacatcctcctggacgagaaatgggttgccaaggtttcagattttggtctgtccaagactggcccatctatggaccatactcatgtgagcacagttgtcaaaggcagttttggttaccttgatcctgaatacttccgcaggcagcagctcacagagaaatctgatgtctactcttttggtgttgtgctgtttgaggtcctctgtgcacggcctgccctgaaccctactcttccaaaagaagaagttagcttggcggagtgggcgttgcactgccagaagaagggcattcttgatcagattgttgacccctacctgaagggaaagatagctccacaatgcttcaagaagtttgctgagacagctgagaagtgtgtttctgatcagggtattgaccgcccttcgatgggtgatgtgctctggaacttggagtttgcccttcagatgcaggaaagcgcagaagagagcggaagccttggttgtgggatgtcggacgagggcactccccttgtgatggtcggaaagaaggatccaaatgacccatcgatcgagtcaagcaccaccaccacaaccaccacttctataagcatgggcgatcaaagcgtcgcgagtatggactcagatgggctgacgcctagtgctgtcttctcacagatcatgaaccccaaggggcggtgaggtaaagctcatcccattcgttaa

SEQ ID NO: 285 - DNA, 712 bp, Glycine max
tttctctctccccgcgatggagaaagccgagagctccgcctccacatcggagccagactccgacgagaaccaccaccgccacccgacgaaccaccacatcaaccctccctccggcctcaccccgctcgagttcgcctccctcatcccctccgtcgccgagcaccactcctacctcgtcggctccgggcaatgctcctcactcctcgcccagcgcgtccaagcgccgcccgacgccgtctggtccgtcgtccgccgcttcgacaagccccaaacctacaagcacttcatcaagagctgcgccgtcaaagagccctttcacatggccgtcggcgtcactcgggacgtcaatgtcatctccggcctccccgccgccaccagcaccgaacgcctcgacctcctcgacgacatccgctgcgtcaccggctttagcatcatcggcggcgaacaccgcctccgcaactaccgctccgtcactaccgtccattccttcgaggacgacgccgacgacggcaagatctacaccgtcgtcctcgaatcctacgtcgtcgacgtccccgacggcaacaccgaagaggacacgcgtctcttcgccgacaccgtcgtcaagctcaacctccagaagctcgcctccgtcaccgaaggaaccaaccgcgacggtgacggtaagtcacactcgcggtgaagaagcaaatacgcctcaataaaacaataa

SEQ ID NO: 286 - DNA, 499 bp, Glycine max
agtgatcttcgttcttctgtggagatcttgttttttcatctcacttttcttctaattaaggaacaagctttccgcagttgaaaaccctagctagctagcttccaccaatttgaatcaccaatggctcgctctttctctaacgtcaaggttctctctgctcttgtggccgacggattctccaacactctcaccaggcgtgggtacgcagcagcgacacaaagcgcaacaagaggaggagctgcctccatcagcagcaagatagctcccaagtcaggggaagacaaggtaggaggaggtgctgaaaaggtttcgtgggtcccagaccctgtcactggttactacaaaccggagaacatcaaagagattgatgttgctgagctgagagccacggttttgggcaaaaaattcaaccactagctcgctagctagttaatttcaataacctttttggtcacttgaatatgttatatcatatatgactctctcgaagttcacagaa

SEQ ID NO: 287 - DNA, 988 bp, Glycine max
tctattggagagaagcaaccaccaaattaaaagatctaccatggcaaacaagtaccataagcttcgctcaataagtttgccttctagatctcatcctagcaccgttagagtagaggaggagctgagaaagatcaaaacttgggaaggaacatccacaatatccacatcaaagtctattcacacaggcctttcattgcttgaagatttgtacatttgcttggatgatcttctcaacatggcatccacccaaaaggtgatttctcaccataggggtgacaaatgtgtggaagaagtgttggatggttcggtgagaattttggatatatgtggcatcacaagggacaccatgttgcaaattaaggaaaatgtccaagcccttcattcttctcttcgaagaagaaaaggagactcatgtgttgaagcaagtgtggccgagtacaagttgttcacaaaaacgatgaagaagaatgccattaagttgatctcatctttgaagcagatggatggcaaatttggggtgtccccacttttggatcttgatcaccactttgctgctgtgattagagttcttagggaagtcattctaatcaacttgtcagtcttccaatttattttgtcattcttgaccgtgtcttcatcgaactcaaagacatccaaatggtcgttggtggcaaaattgatgcataagggggcaaaaccatgtgatggcaccaatgatgagatgcagtgtgtggaagcagctttgagctccctcctaaatgaagggactaatgatgacaagatacatgtggcacatgaaaggttggaggctttggaggatgccattgaaagttttgagaatggtttggagagtttgtttaggcatttgattaagactagagcttcccttttgaacataatatctcagtagagtattttcaatagcatcttttctccaattcctgcaatgcatccaaattttagggacctgccgaggaaaataatatag

SEQ ID NO: 288 - DNA, 1322 bp, Glycine max
tcacaatggttgatctagattggcaaacaaagatggttcactccaacatcatgcctccaatgtcccccaaactctctctcccggatcataacattccaatcccaactttgcaactcccccttcgccaaaacgacatcaccgcagcgtcgtctcctatctgcgctgcatacgacaactaccttcgtctccctgagctcagagccctctgggcctccaaggacttccccaattgggccaacgagcccatcttaaagcccgccttacacgccctcgaaatcaccttccgcttactcgcaaccgttttctccgacccgagaccgtacatcaacaaacgcgagtggacccgacgcgtcgagtctctcgccacggcccaaatccagatcatagccatgttatgcgaagacgaagaagaaaaccccgagacacgtggcaaggcacccgtgactgacattaacggctttaccggtcaaagcagaagctacagcgaggaaagcctgctcccgcgcctcgccacgtggcagaaatccaaggacgtggcgcagaggattctcaattcggtggactacgagatggggaggtgcacctacaccttaggtttaggagaggcgaatatcgcgggaaagaagatatttctcttcgacgcggtttgcaggccgagggagattcactcgttggagacgacgccgtttgatgattacgtggggaaccacgagaacaagacgctgcacgccacgcagcagatcgccgagtgttggacgcgctcggtgaagaagctgctggagagagtaacggagtcggtggagaaaaaggcgttggagaaggccgcgagtgagtgccatgcggtggagcggatctggaagttgttaacggaggttggggacatgaacctcatgatggatccagaggatttcttgaggctgaagaaggagttagggatgatgagaactgcgggcgaaacggtggcgttttgcttcaggtcgagggagcttgtggaggtggcgagggtgtgtaggaatctgagggagaaggtgccggagatattggaggtggaggtggaccccaagggtgggcccgggatgatggaggcggcgatgaaggtttactcggagaaagagaaagggaaggttcatgttttgcaggggatgcaggggattgaggtggcgatgaagaggttcttctacgcgtataagcaggttgtgacggttatgatggggagctccgaggccgataatgggttcaccaagatattccttgaacccacttatttccctagcttggatgctgccaagacctttcttggttattacaaccaaaattaataa

SEQ ID NO: 289 - DNA, 1966 bp, Glycine max
catcactaacaccagtgaggagaaaaatggagatagagaagagcactaagggcagtgcggaaataggagagaaagaagagaagaagaagaagcagcatcgacgaggaggcatcagaacattacctttcattcttgcaaatgaagtgtgtgacagatttgcaagtgctggttttcatggtaacttgataagttacttgacccaagagctgaacatgccattggtagctgcctcaaacacactgacaaactttggaggaacatctagcttcacccctctcattggggctattatagcagattcctttgctggacgtttttggaccattaccgttgcttctctcatttatgaactgggattgattagcatcactgtatcagctatactgccacaatttcgtcccccaccatgcccaacacaagctaattgccaagaagccacatcctcacaactgtggatactctacatctccctcctcctcacatctgttggatcaggtggcattagaccatgtgttgtgcccttttcagcagaccaaattgacatgaccaaaagtggtgtggcatcaagaaagtggaacatcttcaattggtactttttcagcatgggcttcgcttctcttagtgctttgaccattgtggtttacatccaagacaacatgggctggggttggggccttggaattccatgcattgccatgttgatatccatcgttgcctttgtgttgggctcaccactttataagaccgtaaaaccagaagggagccctttggttcgtttggcccaagtaaccgtggcagctataaagaaaaggaaggaggctttgccagaagatcccaagcttttgtaccataattgggaacttgatgcttcaatttctttagaagggaggcttctacactctgatcaatataaatggttggacaaagctgcaattgtcacagaggaggaggccaaagatccaactacaacaccaaaattatggaaattagccactgtccacagagttgaggagctaaaatccatcatcagaatgcttccaatttgggcatcaggaatcctgctcataacttcttcatcacatctgcacagttttgtgattcaacaagctcgcacgatggaccgtcacctctctccctcgttccaaatttccccagccagcatgtccattttcagcgtgctaaccatgatgtcaggagttgttctatatgaacgcctctttgttccctttgcgcgcagattcacagggaacccttctggaatcacatgtttgcaaagaatgggaataggcttcataatcaatatcatagccactgtgattgctggcctaatggaaatgaaaaggaaatctgttgctgctaagtaccacttattggatgatccaaaagccactattcctataagtgtgttctggttggtacctcagtattgccttcatggggtggctgaaattttcatgtctgttgggcatttggaatttctctttgagcaatcacctgaaagcatgagaagcagtgctacagcactgtactgcataaccacagccattgggaactacatgggtacattgctggtgtcattggtgcataagtacactggcaaggagaataattggcttccggataggaacctcaataggggtggattggactactattattttcttgttagtgggattcaagttgtgaatctcgtttattattttatatgtgcttggttttacacttacaagtccgtggaagaaattagtgaaaagaacaaggaagaggatttggaacaagccaacgaacatgtctcatctgatgacaagttaaatgatggtaaggaggaagaaaagagaggattaacgaaagatgaatgaattgatggggttgatattagtttttagcattgttgattgttgaactttaaggaatgttcttttcctcatcaaatggcatatgtaagcacatggtagatcgtgtctac

SEQ ID NO: 290 - DNA, 2849 bp, Glycine max
tgacctcattgttgatagttgatacttggcctcgaagatgcacttgctactatccaagtccccactattactgatacataattcttctatgctcctgcaccgcttctctcctcttctccttcctcgttttctctttcgccaaccccccttcccctcttcgaatttcaaacctctcacactcaaggtcctctccatggcatcgtctcattcctcccaccacatacacactaatcgactcgcttccgaacagagcccctatcttctccaacacgctcacaaccctgttgattggtatccctggggcgaagaagccttcgccgaagcgcgccggcgagacgcgcctatcttcttgtcaattggttacagcacttgtcactggtgtcatgttatggaggtcgagtctttcgaggatgaagcggttgccaagttgctgaacgattggttcgttagcattaaggtggatcgagaggagcgaccagatgttgataaggtgtacatgtcgtatgtgcaggctttgtatggtggaggaggttggcccctgagtgtgtttctttcacctgacttgaaacctttaatgggtggaacttacttcccccctgatgataagtatggacgaccaggatttaagactatacttagaaaggtaaaagaagcttgggatagtaagagggatatgctaattaagagtggatcatatgcaattgaacagctttctgaggcaatgtctgctagttcagattctgataaactgcctgatggggttccagctgatgcgttacgcctatgctcggagcagctctctgggagctacgattcaaagtttggtgggtttggatctgcaccaaagtttcccagaccagttgagataaacttgatgctatatcactccaaaaagttggaggatacggggaagttgggtgtagctaatggaagccagcaaatggttttctttagcttgcaatgcatggcaaaaggtgggattcatgatcatattggagggggatttcacagatacagtgtggatgagtgctggcatgttccgcattttgagaagatgctttatgatcaagggcagcttgccaatgtttatctggatgcgttttctatcacaaaagataccttttattcttatatatcacgagatatccttgattatttaaggagagatatgattggtccagaaggtgaaattttttcagcagaggatgctgacagtgcagagactgaaggagctgcaagaaaaaaggaaggagccttttacatatggacaagcaaagaggttgaagacttacttggagagcatgctgctctttttgaggagcactattacatcaagcaattgggtaactgtgacctatctggaatgagtgatcctcacgatgaattcaagggaaagaatgtcctgattgagagaaaggaaccttcagaactggcatcaaaatatggcatgtcagttgagacatatcaagaaattcttggagaatgcaggcataagttgtttgaagtaaggtcaaggcgtccaaagccacatttggatgataaggttattgtatcgtggaatggactggcaatctcatcttttgccagggcttctaagattctcaagggtgaagctgaagggaccaaattctactttcctgtcattggcactgaaccaaaggagtacatgggaattgcagaaaaagcagcatcctttattaggaagcaactttacaatgtagaaactcacaggctacaccatagtttcagacattcgccatctaaagctcctgctttcttggatgattatgcttttctgatttctggattgctggatctctatgagtttggtggtggaattagctggcttctatgggccattgaattgcaggaaacccaggatgctttgtttcttgataagacaggaggaggatatttcaataatacaggagaagatgcttccgttctcctccgtgtaaaggaagaccatgatggggcagaaccctcaggaaactcagtttctgctataaatcttataagattggcttccatggttgctggaagtaaggctgagcattataagcgaaatgcagaacatctattggcagtttttgagaaaaggttgaaagatatggctatggcagtgcctctaatgtgttgtgcagcagatatgttgcgtgtactttctcggaagcaagtggtcgtggttggtgaaaggacgtctgaggactttgaaaacatgcttgctgcagctcatgcagtatatgatcccaacagaacagttattcatatagatcccaacaacaaagacgagatggaattttgggaagtaaataacagtaatgttgctctcatggcaaaaaataactttgcagtcaacaaggttgtagctcttgtatgccaaaacttcacttgtagcccctctgtgactgaccattcgtcacttaaagctttgctctccaaaaaaccttcctcttcgttcacgtaagctattggttctgatgagtaggaaaatagttaacgtcggcgaaagctccctcttagagatccccctttcaatctacagaactagttggttctgacttctctgtcaaaataaagataggtaacattctctgttgacttgaggaattgatgcatgtccttttcgtatgcctgtgctcaacaagccatgatttttcttcaaatgtgatacagaatgatggaatcatggaagtatgtataattgtatatgcaatgtaagctatcgttgaaataattatcttttccagttggagtctgttctcatgtttatacttcatttttttctcgatgaacttgcacaagaaagtctcgatggcatggctaagaaatccttcatgtctgttcgt

SEQ ID NO: 291 - DNA, 324 bp, Glycine max
tccagcgttgatcagaatcagagcatggacgggcatgattcagaagacccaaagcaaagcactgctgatatgacagcttttgtgcaaaatcttcttcagcagatgcaacttaggttccagacaatgtctgactccatcatttctaagattgatgagatgggagaccgtataaatgagttggagcaaagcatcaatgatttaagatcagagatgggagtggagagcactccatcacctgtggcccctgctaagccaaaggaagaagagtcaaacaaagaagagggttctgcttgagtaatgttacgtgttcaactgccttgttag

SEQ ID NO: 292 - DNA, 1436 bp, Glycine max
gtcgtttgcggtgttagaagacgtagtcgggcgtgatggcgaagaagcgatcagccccgagtggcggtcgtcgggaaaaccgagccgaatcatcttcccgacggctcaactcagcttccggtcgcagaaaactcgttgcgttcttcatcgtatcgtccatcatcgctatcgtcacttatcgttatcgcttcagacaatcttctccttcgcaaggccttgtcacaactcatgctaattgccaacatatactcgccgaaaattcaaaagtatcaggaaattcgtctcagcgccattatacttatcctgtgcttggctacattactccctggaattctcgaggttatgaattggcaaaaaggttcaactctaagttcacacatttatcacccatttggtatgatctaaagagccaacagactagcttagttctagaggggagacataatgctgacagaggatggatctcagagcttaaaaaggcaggagaagctttgattttgcctagagttgttctggaagcatcaccagcagtgctgttgggaaaggaaaaacaaaggaacaaagccattaaccttatagtaacagagtgcaaggaaatgggatatgatggtattgttttggaatcttggtcaaggtgggcagcttatggtatcttgcatgatccaagcatgcggaatttggcattgcagtttgtaaaacagcttggagatgcactgcattctataagctcagagaaaattagtgggcagcagctgcagttggtctatgttataggtccaccttctgagaagttgcaagagcatgattttggtcctaaagatcttgagactttaagtgaagctgtggatggattctcgttaatgacatatgatttctctaatcctcataatcctggtcctaatgcacctttgaaatggattcaaattgttctacagctgcttctcggtacctctggcaatagagcccaaagccttgcccccaagatacttcttggtatcaacttctatggaaatgatttctccctttcaagggatgcagggggtggagctattattgggagagattacctggcacttttggagaagcactggcctgaactgcagtgggataagaatagtggggagcattttttcttttacactgacgacaaggatatcaggcatgtggtattttatccatctttgaagtcaatttctttgcggttagaggaagctcgttcatggggatgtggcatctcgatctgggaaattggccaaggtctggattatttttttgaccttctgtgatagcttgttatgtgtacttcttttgtggcccatgctaatgtttattcctacgtcgtaatgttgtgtattcagtataatcgaaacgtacttcagttaaattgggattttgtttttcagaaatctagtttgaggaaatgtgcagttagttca

SEQ ID NO: 293 - DNA, 2008 bp, Glycine max
ctcccacggaagacttcaacagaagaaaaaggaagaattaatatcactcttccatggttgccgacgaagcttcaccattcgagaccagcgatatgctggcaacgctcctggcgtcgacgccgctgttgtcagagtcatggcggctgtgcaccaccgtggccgccaccgcgccgaggagtttcatgactgagcagcacggtggcggcggtgtggtgtacgtcgctttccccggcgtagaaatggcggcgggatcggactctatctgcagaaacttggtggcgttggaaagcatcggcgacgtgccactgttctcggcgcggcgtcgcaacaaggaaggcgatgaacctgtgatggtgcatgctgggatgctgaatctcttgtccacctttttcgaaccatttcaaaaacagatgttggcactcatgggaaattccaagaccaaatcaattgtcctaactggccactccattggaggagccacagcctctctatgtgctctttggctactatcttacctccaccagacatattcctctatgtctgtgtcagtcttgtgcatcacattcggttcccccatgctagggaatggctctttctcacgtgccattctcagagaaagatggggtggtaacttctgtcacgtggtctcaaagcatgacataatgccaaggcttctctttgctcccataacaccttacactgctcaaataaacttcctgcttcagttttggcaactgtccatgactgctccaggctttgggaagcttgcagttccaatttctgaccaacagaaagagctgttcaactttgtgatgagtcacttggatgcagccacacaagatgaagaagggtctgcacctgttttgtttcacccatttgggagctacctttttgtttcatcagatggagcagtgtgtgtggattgtgcaacttctgttataaagatgttgcatttgatgtttgcatcaggttccccagcttgtagtattgaggaccatctaaagtatggagactatgttaagaatttgtcattacaattcttgaaccagaacaattccgtgcaggggaatattcctgattcaagctatgaagcaggacttgaattgtcggttcaatcttcaggtttgggtaaccaggaatcggcaatcgaacctgccaaggagtgccttaagatgacaaggaggatgggtccttcaccaaccaagaatgctgctaacttatcaattacattatcaaagtttgtgccttataggaccgaaatagaatggtacaaagcttggtgtcaccagcaagttgatcaaatgggatactacgacttattcaagaggagaaggagcacttcaaaaatggctatgaaagtcaacatgaatcgtcacaaacttgccagattttggaacaatgtgattgaaatgtgggagagaaatgagctgcctcatgatgtggcggtgcgggctaaatgggtcaatgcttcacatttctacaaactattggttgagccactagatattgcggaatattatgggaaggggatgcacacaaccaaggggcattacatacagcatggcagagagaagaggtatgagatttttgataggtggtggaaggatgcaatgggcaacaccgaagaaaataatgagaggaggagcaagtttgcaagtttgacccaagattcatgcttttgggcaagggtggaggaagcaagggactggctgaatagtgttagaagtgagagtgacacaacaaagttggctgtgctgtgggataacattgagaaatttgagaagtatgctatggaacttattgataataaggaggtgtctgaagatgttcttgctaagaactcaagttacagtatatggatggaagatttaagaggactgagggaactcaaagcaaaggtgaagacgttttcacaccactttaacccgtttctggatggagaagtaattccttagtaattttaaatgaaatcaataaataagcttgactctgtaatctgtaatatgcc

SEQ ID NO: 294 - DNA, 1994 bp, Glycine max
cctacacactttcttccaatggccgccaaaacggtaacccccgacgccgtttcgacgctcctcgcaaacccttcccccgattccacatcggatctccccgacatcgtcgttcaagtcctcgatcttaaggcgacaggcaataaatacatgtttactgctaatgatggaaaaacgaaactgaaagctatgattccttcggatatgcgctctcaggtgctctccggggctattcaaaacctaggtcttattcgcgtccttgattacactgtcaacgatatccccaataaatcggacaaataccttcttgccattaaatgtgaagctgtatctcccgcgcttgaaatggagataaagagtgaggaatctggatctgggattcttttgaagcccaaagtagagggtggagtcaagactgaaggtgctgctgctgggattcttctcaagcccaagcaagaagtggtgacaaaatctgctaaccagattctacgcgaacagcatggaaattcggctcctgctgcacgcatggcaatgacgcgtagagtgcgtcctcttgtttcgttgaacccttatcagggtaattggacaataaaggttagcgttacgagcaaagggaacatgcgtacctataagaatgctaggggtgatggttgcgtcttcaatgttgaattgacggatgaagatggtactcagattcaggcaactatgtttaataatgctgcaaggaaattttttgacaaatttgttctgggaaaggtttactacatttcaaggggaactttgaaagttgctaacaagcagttcaaaactgtgcaaaatgattatgaaatgacgctaaatgagaattccgaggtggaagaggtggtcggtgaagcaagttttgttccggaaacaaaattcaactttgtgcagattgatcaactgggtcctcatgtcaataagtctgagcttgtggatgttattggagttgttaagaatgtgtcttcaacaatgagcattcgtaggaagagtgacaatgagagtattccaaagcgtgacattactattgctgatgacacgaagaagacagtagttgtgtccttgtggaatgaacttgcaactaccacaggagaagagctactggacattgttgataaatctccagttgttgcaattaaatctctcaaggttggggacttccaaggtgtttctttgtcaactataggcagaagtgtggttctggtaaatccagacatacccgaagcaaaaaatctcagaagctggtatgattttgaaggcaaggatgctgcaatggactctgtaggctctggttcaagtccaatatctaacaatgggattagatcagtgtacactgatcgtattcatctttctgacataatctcaaacccatcattgggagatggaaagcctgcttttttcagtcttagaggacatataaccttcataaagcctgatcaggcaatgtggtatcgtgcctgtaagacatgcaataagaaagttactgaaagctttggttctggatattggtgtgatggatgtcagaaaagtgatgaacagtgtagtttaaggtatattatggttgccaaggtttctgatggaagcgctgagacttttatctctgtcttcaatcaggaagctgagaagatcgttggatgctctgctgatgatctagataatcttaaattacaagaaggagaagataatccttatcagatgacattgaaggaagctacttgggctcaacatcttttccgggttagtgttactccgaacgagtataatggcgagaagcggcaaaggataacagttcgagcagttgttcctgttgacttcgctgctgagtcaaggtttatactggaagaattatcgaagatgagagcataagatgcatatgcagattcacagtttctacatcttttggttgaaggttatttagttctagctatgtttcctgatctattgaatggtcggtcttctcctttcactagagtgcagac

SEQ ID NO: 295 - DNA, 1942 bp, Glycine max
ccaatccatcgctatctctatctcttttttgatacaaagaaaaataaaaagtttcatactttaggacacccttttctgcaactgatgatggaaggaagctgaaacagtgaaaaacaacaaccaacccctgtctttgttttttgtttgttgaattgaaacttgagagagagaaagtgaatgaatgatggaggcaaagggtgtgcggttcttagcgtaccaatcaatattttcgagcgttggatctggggactttgatggggtgaagaaactggtggagaaagtgaagaatgaagaatggtcatcgctctctgatgtgatgtctcttcagaacgatgctggagagactgcgctatacatcgctgcagagaacaatctgcaagagattttcagcttcttgctcagcatgtgtgacttcgaggtcgtcaagattcgctccaagaaggctgatatgaacgcctttcacgttgctgccaagcgtggcaatctagatattgtgagggagcttttgaatacttggcctgaggtctgcaagttatgcgactcctcaaacaccagtcctctatattctgctgcagttcaagaccacttggatgtggtggatgctatcttggatgtcgatgtcagttgcatgttcatagttaggaaaaacggcaaaacttcactgcacaatgctgctaggtatggtgtccttcgtattgtaaaaacacttattgctcgggatccaggaatagtatgcatcaaagataaaaaaggtcaaactgcccttcatatggctgtcaaaggacagtgtacttcagtggtggaggagatattactagctgatccttctatattgaatgagcgagataagaagggtaatacagctcttcacatggcaacaagaaaatgccgttcacagatagtgagccttttgctaagctattctgctatggatgttaatgccatcaacaaacagcaggaaacagccatggatttggcagataaactgccatatggagattcagctttggaaataaaggaagcccttgcagaatatggtgctaagcatgccaggtatgttggcaaagaagatgaagcaatggaactcaaaagaactgttagtgatataaagcatgaggtgcagtcgcaacttatacaaaatgaaacaacgcgccgacgggtttctggtattgccaaggagttgaagaaacttcatagggaagcagttcaaaacaccattaattcggtcacagtggttgctgtcctttttgcttcaatagcattcttggccatcttcaatttgccgggtcaatatataacggaagaaggacaagagattgggaaagctaatatagccgatcatgttagtttccaggtcttctgccttctgaactctacatctctattcatttctcttgcagttgttgtagttcaaattactttggtagcctgggacacaagggctcaaaagcagattgtgtcagtggttaacaagttgatgtgggctgcatgtgcttgcacttgtggtgcttttctagcaatagcttttgaggttgttggaaagaaaacatggatggctatcaccataacccttttgggggtacctattctagttggcactctagcgagcatgtgctacttcgtttttcgacaacattttggcattttccgcagtgattcccagaggcgcatcaagagaacaagtggaagcaaatctttctcatggtcttactctgcaaatatatcagatttggatgaatacaattctgacattgagaagatctatgccctgtgagtcaagaatcatgttaccacacaacagaagagcaatgtttcaaccgtttaactgaaactgttataccactgctaagtgataatgttagctcaccgggatttcatcattcatcttgagttttcagtttttggtttcaggctgtactactaggcaattcggttggatttg

SEQ ID NO: 296 - DNA, 984 bp, Glycine max
cacttcctcaaccgatccatttttcttagtttttcgctttcctcagatggcaagtgggtttggggaatcaacagggaggtcacccccaagcccttcctacttcaacaacaataataacagcgatgctgccaattttgaatgcaacatttgctttgaattagcgcaagacccgataattactttgtgtggtcatcttttctgctggccttgtctttacaaatggcttcactttcactcacaatcacgagaatgcccggtgtgcaaggctctcgtggaggaggagaaattggttcccttgtatgggagaggaaagtcgtccactgatccgagatcaaaatctattccgggcgttaacatcccacatcgtccggctgggcagaggcctgaaactgctcctccacctgaaacaaatcattttcatcaacatgggtttggatttatgggtggcttggggggatttgtgccaccgccgatggcaacaacaagatttgggaattttgcattgtccgcagcatttggtggttttataccatccttattcaactttcagatgcatgggtttcatgatgcggccatgtatgggggaggggctggttttccacatggatttgctaatacatttcatggtgtccatgctcatggattccctctgcgcacccatcaagggcaacaagattattatttgaagaagctgcttctatttgttgttttctgtgttgttcttgcttttatatggcaataggttgaatacattctcagattggtagcagaactagatttctgctctgatagatcttctggtgcgctctttatttcgtaactaaggagtaaggatattgttcatataataatactgtcatattactcttgtagttcttttctttgtgatagttttgtggcacctatggtatccatgtgcgaaatttaatatataaagcatgaaagcaacacacccattgttaggaataaggatctgggtatcag

SEQ ID NO: 297 - DNA, 1031 bp, Glycine max
cctccaaaggttgttatggatagatagatagatagaacgctgctttgagtttcctcaactcaagaatggctgccaacgactcgtccaccgagattgatactaagaagctttcgaattgttggggaaatgctcaaatgccctttgcactccccactctcctctcttcaccaccccaacacctccacacatcattcaccactgccgctgacaattttttcagatttctacactcccttgcttctcataactctttcctcaacaaaattctctctctcccctccgaatttcacaccctttgcgtgcagattgggaagcaaaggaacgtgaggttggtttctggtcataatttcgctgccgttttgcctggggattcggtggcagggctggtggtggcgaatggggttctgaatttcttgaacatttacaacactttgctcattgtcaggcttgttttgacatggtttcccaacactcctccttccattgttagtcctctcagcaccatatgtgacccatacctgaacatattccgtggacttattccccctctgggaggaacgctggatctctctcccatcctagcattcttggtcctaaatgccttcaccagcactgcttctgcactccctgctgagcttccagtcacagaacaatccaaacaaggccttgcagcaccattgcactccactaaccttactacttcacagaagaaatggttgacacggtttcaagggaacaggtcaaggacatctggtgctgatgctaaatagaacatgggagagtttatttgtgcctctgtgtctgtttattaatttagatacgttccatcccgattatgatagttctattctaggcaacacaatttttgagcttatgattccagagattttagagttatggagtttgctgttgaaagctcaaggctcaagcttccacagtcctattgtgttttttcttttaatcctatggtcttcttagtcaataaacttaaggtccttatttaaattggggactggattggattacagaat

SEQ ID NO: 298 - DNA, 2922 bp, Glycine max
aaccatccaactctcatgttcgaagaaaacatacacaatctcttcaaactctaattttcttttcctttcatttaatttcctcaatggcggcttccgtcgaccagcgtccgtaccccggcctccacaatggcgtcgttcggcccctcaaaccaggcccggatatcccgcgtcccaagaagctaccccagccgccgccgccactctcggattcctcaagcgacgaagaagaagacaccaccttgaacttgaaggacctgattcgcaagggaacaacggaagttgaatcctccattttcgacccgcgcgacgatggaacctctgaccactggatccaacggaactcttcccttgtccgtttaacgggaaagcacccgtttaactcggagccacccctccctcgcctcatgcaccacggcttcatcaccccggtccccctccactacgtccgcaaccacgggccagtcccccgggcccgctgggaggactggaccgtggaagtcacgggcctggtcaccaggcccacatgcttcaccatggagcaactcctccacgatttccccagtcgcgagttcccagccacactcgtctgcgctgggaaccggcggaaggaacagaacatggtgaaacagagcatcggcttcaactggggggcagccgccatctccacttcggtgtggcgcggtgtgcccttgcgcaccctgctcaagagctgcgggatctacacccgcaccaagggcgcgctccacgtgtgcttcgaaggggccgaggatctgccaggtggaggtgggtccaagtacggaaccagtatcctgagggaggttgcactggatccctcccgcgacatcattctcgcctacatgcaaaacggggagcctttgtccccggatcacggcttccccgttagaatgataatacccggtttcattggtggccgcatggtcaaatggttgaagcgcatcattgttactaccgaccaatctcaaaactattaccattataaggataacagggtactcccttctcacgttgatgccgaacttgccaatgctcaagcttggtggtacaagccggactatattatcaacgagcttaacataaactccgtgataaccacgccttgccacgaggagatcttgcccatcaactcatggactactcagatgccttatttcatcagaggctatgcgtattccggtggtgggagaaaggtgacacgtgttgaggtaaccctggacggaggtgaaacgtggcaagtgtgcacactggactgtccggagaaacccaacaaatatggaaagtactggtgttggtgtttttggtctgtggaggttgaggttttggacctgctcggagccagggagattgcggtgcgtgcttgggacgaggccctcaacacccaacctgaaaagctcatttggaatgttatgggcatgatgaacaactgctggttcagagtgaaaaccaatgtgtgcaggccccacaagggtgagataggtatagtgtttgaacaccccacccaaccaggcaaccaatccggcggatggatggcaaaagaaaaacacctagagaaatcatctgagtccaacccaaccctcaagaagagtgtctcctccccattcatgaacaccacctcaaaaacctataccatgtctgaagtcagaaggcacaacaacgccgattcggcttggatcatagtccacggtcatgtctatgattgcacccgcttcctcaaagaccatcccggtggcacagacagcatcctcatcaacgccggcaccgactgcaccgaggagttcgaagccatccactccgacaaagccaagcaaatgcttgaagactaccgaatcggcgagctcaccaccacctgctacaactctgattcttcatcgtcaaacccctccgtgcatggcagctccgacaccatccctttgacccccatcaaggaagtgattacaccaatgcgaagcgtggctcttaacccacgcgagaaaatcccatgcaagctcatctccaaaacctccatctctcacgacgttaggcttttccgctttgccctcccctccgacgacctactcatgggtttgccagttgggaagcacatattcctatgtgccaccgttgacgagaaactatgcatgcgagcctacactccaacaagcagcgttcacgaagtgggatacttcgacctcgtcgttaaggtttacttcaaaggggtgcaccctaagttccccaacggtgggatcatgtctcaacacttggactctctccccattggttctgtcttggacgtgaaaggcccacttggccacattgaatacactggcagaggaaacttcctcgttcatgggaaaccaaggtttgccacgaggctagccatgttggctggtggcacaggaatcacacccatttaccaagtggttcaagccattctaaaggatccagaggactgcaccgagatgcatgtggtttacgcgaaccgaaccgaggatgatatattgctgaaggaagagcttgatgagtgggctaagaagtatgataggttgaaggtgtggtacgtgatacaagaaagcataagagaagggtgggaatacagtgtgggattcatcactgaaagtatcctgacggagcatattccaaatgcatctcctgataccttggcattgacttgtggaccaccacctatgattcaatttgcagtccagccgaatttggagaagttgggctacgacacccagaataacttgctcgtgttttaggggactaaactagaatacattgtatgtgtatatagtagtttattgttatatataaataatggattctattagctgcttcgtttcaagatttttttatgtttcaatttttaaataaaagtgtacatgggacagctagctagctacgcaggtttacttttcctcgtca

SEQ ID NO: 299 - DNA, 2556 bp, Glycine max
aaatttgaccaattccaacctcgcttgaaaccatggctctctgcacatcttccttcttcttcaccttcttcttcaccttcttcttgttcctcttcaatcttcaaccttctgtttcccaacaacaattcacatccttcaacatctcacactctccatggctcccagcacagaacaaaacccttctctctccaaacaaaaacttcactgcaggcttctttcccctgccaaactcttcaaatgtcttcactttctccatttggtactccaaagtgcctccaagtgcaaacccttttgtttggaatgccacagtccaagtcaacacttctggctcccttgaaataaccccaaaaggtgaacttctcctcaatggttcaccctttcaaagtgctgaaaatgctactactaactccacttccaattcaacccaacttcttctccaaaacgatggaaacttggtctttggggaatggagcagcttcaagaaccccaccagcaccgttttacccaaccagaacttcagcacagggtttgagcttcactccaacaatgggaaattcaggttcatcaagtcacagaatctggttctcagctccacctcagatcaatactacaacaccccaagtcaattgctgaacatggatgataatgggaaaatgagcatgcaaggtaactctttcctcacttcagattatggtgaccccaggttcagaaaactggtccttgatgatgatgggaatctcaggatctatagcttctaccctgaacagaaaaaccaatgggttgaggtttggaaagggatatgggagatgtgcagaatcaaaggcaaatgtgggcctaatgcaatttgtgtgcccaaagaggatttgagcacttccacttattgtgtttgtccatctgggttcacaccagcaatccaaaatgatccggaaaagggttgcagaaggaaaatccctctttcccaaaacacccaatttctgaggcttgattatgtgaactgctcaagtgacggtcatttgaatgaaattaaagctgataactttgcaatgtgcgaggcaaattgctcaagagaaaaaacctgtcttgggtttggattcaagtatgatggatctggctactgtatgttggtgaatggcacaaatcttcaatatgggttttggtcaccaggcactgaggctgccttgtttgtaaaggttgacaaatccgagtcatcagtttccaacttcattggcatgactgaggtgatgcaaaccacatgtcctgtgaacataagcctcccacttccaccaaaggattcaaacgccacagcaaggaacattgccataatctgcaccctttttgctgcagaactcattgctggggtggctttcttctggtccttcctcaagaggtacatcaagtatagggacatggcaaccacattaggccttgagcttctccctgctgggggaccaaagaggttcacctactcagaaatcaaagctgccaccaaagatttctccaacttaataggcaaagggggctttggagatgtgtacaagggtgagttacctgaccatagagtggtggcagtgaagtgcctcaagaatgtcacaggtggagatgctgagttttgggcagaagtcacaatcattgccagaatgcaccacctcaacttggtgaggctgtggggattctgtgctgagaagggccaaaggatacttgtctatgaacacatccctggtggatcattggacaagtacctcttcagggtcaataagtctcataacaataaccatctcaaggagcaatcaagtagtttgaatccaaacacaccacaacaagaaaggcatgttttggattggagcatgaggtacagaatagcccttggtatggcaagggccattgcctacttacatgaggagtgtttggagtgggttttgcactgtgacatcaagccagagaacattctactaggtgatgacttttgtcccaagatatcagattttgggcttgccaagttgaggaaaaaagaggacatggtgaccatgtctaggaggaggggcacaccagggtacatggcaccagaatggatcactgcagacccaattacctcaaaggctgatgtgtatagttttggcatggtgcttttggagcttgtgagtgggattaggaactttgagatccaaggttctgtggttaggagtgaggagtggtacttccctggttgggcctttgataagatgtttaaggagatgagagtggaggagattttggatgggcaaattagggatgcttatgatagtagggcacactttgagatggttaataggatggtgaagactgcaatgtggtgtctgcaagataggcctgagttgaggcccactatggggaaggtggccaagatgttggaagggactgtggagatcactgagcccaaaaagcccactgttttcttccttggtgaagagtagattcatgataaagtttctgtgtgatgttcagcctttcttgtttaagtttctctcgttatatctcttgtaccggcatggtagcatgtatgctcaatagttggaacga

SEQ ID NO: 300 - DNA, 790 bp, Glycine max
ggaaaatggcactctcagtctcctcaccctcatgcgtacgcgttccttcatgtttttggaaaccaaatggcaagagttgcaaagagcgtactaaggtttcatgtgcagctcacaatgataataagaatccgttggttggaatcggtattggggttgtaacgtcttgtgtgatgggtttaactgcattggatgcggacgccacgagaatcgaatactacgcaacagtggcagagcctttgtgtgagtacaactatgttaagtctggcctcggctactgcgatattgctgagggcttcggtgacgaagctccactgggtgagcttatcaatgttcactatactgcgagattcgctgatgggatagtattcgatagcagctataaacgtgctagacctctcaccatgcgcattggtgtgggcaaggtaatcaagggactggatcaggggattttagggggtgaaggagtacctccaatgcggataggtgggaaacgcaaactgcagattcctccgcacttagcatatggccctgaacctgcagggtgcttctcaggtgactgcaatatacccgccaatgccactcttctgtatgatattaattttgttgaggtttattcggggaacagatcaaagtgaagtcagtcaaaactggtcagatacatatatacatatgaaccacagatggatgggtttagagcaatgaaatggacattttgctagagaatatggatcaacttgtttggcagaatcttcttcctgattacaactacctcaagttactgttcctggtt

SEQ ID NO: 301 - DNA, 1282 bp, Glycine max
aaaagggtggttgaagttgaagcagagataagtgtctcaacaagtgatatgcaaagcatgtctctctgtgcttcactctcctccacagcttcacacctcacttcccttgcctccgtctcttcttccacctctccactttcccgcaaattttctctcactttccgggaaaaaaacagaaccccaattgcaccacctcacaagctccccttcttctcagcaaggcctgcccccaccagagtagtgttggtgaagtctcaggccacagcacctgcttcttctgaggctgtgaaggtgacaccggtgccttctgagatgaaggcatgggtgtatggagaatatgggggtgtggatgttctgaagctggactccaatgttgctgtgcctgatgtgaaggaggatcaggtgttaatcaaagttgttgctgctgctcttaaccctgttgatgccaagaggaggcagggaaagtttaaagccactgattctcctcttccgactgttccgggctatgatgttgcgggtgtggtggtgaaagttggtagtcaagtgaaggactttaaagtgggtgatgaagtgtatggagatgtaaatgagaaagcacttgaaggtcctaagcagttcggatctttggctgagtacacagctgttgaggagaaattgttggcaccaaaaccgaagaatttggactttgctcaagctgcttctcttcctctagcaattgagactgcttatgagggtttggagaggactggattttctcctggtaaatctattcttgttctaaatggttctggaggagttggaagcctagtgattcagctagctaagcaagtttatggagcttcaagagttgctgccacttcaagcactagaaatttggacctactgaaaagcttgggagctgatttggccattgactacacaaaagagaactttgaagatttgcccgaaaaatttgatgtagtttatgatgccattgggcaatgtgacagggcagtgaaggctgtgaaagaagatggcagtgtggtggcactcacaggtgctgttacaccacctggcttcagatttgtagttacttccaatggagaagttctgaggaaactaaacccttacttagaaagtgggaaggtgaagccaattgttgaccccaaaggtccattcccctttgataagcttgctgaagccttctcttaccttgaaacaaaccgagcaactggaaaggttgttatacatcccatcccttgaatcaagtaaaagggataggcaattttgccgtgtctgtcta

SEQ ID NO: 302 - DNA, 1209 bp, Glycine max
ttcttcttgaatccctcaaacccttccaactttttcttcttctgtcaacgtgaactaagattctacagattcttcctttgaaagaatgaacttgaaacaatactgttgtttcctcaaagatgaaggtctaaacaaaatacaggtttccaacaagaagaacagtagggactatccatgggaaatgtacactttgaaggagttgcttcgtgcaacaaacaactttcatcaagataataagattggagagggtggatttggaagtgtttattttggtcgaacaagtaaaagcgttcagattgcagtgaagcgattgaagacaatgactgcaaaggcagagatggagtttgcagtggaagtggaagtgttaggaagagtgaggcaccagaatttgttgggattgaggggattctatgcaggaggagatgaaaggttgattgtgtatgattacatgcctaaccatagcttgttaactcatttgcatggtccacttgctaaggaatgtcagctagattggcctagaagaatgagcatagcaattggagctgctgaaggtttagcgtatctgcaccatgaatcaactcctcacatcatacacagagatataaaggcaagcaatgttcttctagaccctgaattccaagccaaggttgctgattttggttttgcaaagctggtaccggatggtgtgacccatcttaccacaaaagttaagggcaccctaggatatttggcaccagaatacgccatgtgggggaaggtttctgagagctgtgatgtttacagctttggaattttacttttggagattattagtgccaagaaaccaattgagaaattcccaggaggagtgaaaagggacattgttcaatgggtcactccatatgtcaacaaaggtctcttcaacaacattgcggatccaaagttgaaggggaaatttgatttggagcaattgaaaaatgttaccaccatagctcttagatgcaccgatagtagtgcggataagaggcctagcatgaaagaggtggtggattggctcaagaatggtgtagggagcacttggggagaagagaatattccaactttaagtatcaagaatggagacgaaggaaatgacaaagatgacaaattaaaaaataactagtgatatgtataaagtgatatcaatttgtttgttttttattttggtttatttgtgaaatgagactgacg

SEQ ID NO: 303 - DNA, 1072 bp, Glycine max
tggtggaccaagaaagacttagtaagaattaagatggctaccttgactgtacctccagttcctccttcccccagagatgatgccatgcagctttaccgtgcttttaagggatttgggtgtgatacaagtgctgttatcaatatacttgctcatcgagatgctacacagcgtgcctacatccagcaagaatacaaagcaatgtattctgaggaactttccaagcgcttagcttcggagcttagtggaaagttagagactgcagttctgctctggttgcatgaccctgcaggacgtgatgcaacaatcattaggaagtctctaacagcagacaacaaaacccttgaaggtgctactgaagttatatgttcacgcactccatcgcagctacaatatttaaaacagatctatcattctatgtttggtgtttatcttgagcatgatattcaaacaaacaccagccccggcgatcatcaaaagctcttgcttgcatatataagcacacctcgtcatgagggccccgaggttaatagagaaattgctcagaaggatgcaaagggtctttacaaagcaggggagaagaaactgggaactgatgaaaagacttttatccacatattcagtgaacggagtgcggcgcatttggctgccgtcagttcttattaccatgacatgtatggtcattcactgaagaaggcagtaaagaatgaaacatctggggcctttgaacatgcacttttgacaataatccaatgtgctgttaatccaggaaagtattttgcaaaggtgttgcataaggcgatgaaaggcttggggactgatgattccacactcattagggtcgttgtgacaaggactgaggttgatatgcagtatatcaaagctgcatatttaaagaaacacaagaagactctgaacgatgaagtacactcagaaacatccagtcactacaggacttttcttctctcacttttgggccctaatcactagccaagatgttcaatgatgtaagtggaataaattcacccttgatgtgtaaatttgactgtttttagtgctttgtgatcaatgtagc

SEQ ID NO: 304 - DNA, 1696 bp, Glycine max
aggaagtttctgaagcaatagggagtagtggacacagtttaggatcattgttattataggagaatttgatggtaatcatacacagtggctaggaaaggatataatggctactgctgcagtaattggactcagtggaggaaagaggctcttgagttcatcataccattactctgatgttatagaaaagctatcttatggcagtgattttggatccacacactatcaaattgttcctacaaagtctttaatagctgccaagaagtcatccaactacactccaacttttccagcatcgaaccagcagaatcagtccattaaggctcttaaggagcatgttgatgatgcccctaccattgcggattcatggtttcagagttgcaactctaacgacttagaggtggaaagctctgaaatgggttattctgtggaggctcttcttttgctgcagaagtcaatgctggaaaagcaatggaacctttcttttgaaagggaagtgctaaccgaacattctagtaagggaaaaaaatgtaagaaagtggcggtgacttgttctggggtgtctgcaaggcaaagaagaatgaataccaagaggaagactgcgattaaaacttgtggtgctatgcagctgaagtccaaaatcagtccagagctgcttcaacaccgtttgaagggctatgtgaaaggcatagtgagtgaggaattgctctctcatgcagaagttgtaaacctatcagagagaataaaagttgggctttccttagaggagcataaatccagacttaaggaaagactaggatgtgaaccctctgatgatcaaatggcaatttcattgaagatttctcgaactgaactacgagcaagaatgatagagtgcactctggcaagagaaaagttggctatgagcaatgttcgcttagttatgtctattgctcaaaaatatgataacctgggtgcagaaatgggcgatcttgttcagggtggcttgattggactactgcgtggtattgaaaagtttgattcttcaaaagggtttaagatttcaacttatgtttattggtggatacgtcagggagtttcaagagctttagttgagaactcaagaacattaagattgcctgctcatttgcatgagaggctatctctaatccgcaatgcaaagtttagactagaagagagaggcattactccaactattgataggattgcaaaataccttaacatgtctcaaaagaaagtcagaaatgctactgaggcaatcagcaaaactatctcgcttgatagagaagcattcccctctctgaatggtatacaaggagaaactcatcatagttatattgcggatgatcgagtggagaacatcccatggaatggagtagacgagtgggcactaaaggacgaagtgaacaaactcattaatgtgacccttgtggaacgagagagagaaattattcgactttattatggattggataaagaaggtcttacatgggaagacattagtaaacggataggtttgtcaagagaaagagtaaggcaagttggacttgttgcattggagaaactaaaacatgctgcgaggaagagacaaatggaagccatgctattgaaacattaaatttggactcatcatagaaatatgttacaatgtatatatacacagaggaagtatgtacctagaaatttgacttcctgattc

SEQ ID NO: 305 - DNA, 1120 bp, Glycine max
ctaacaccagctactactccctccccccaccccccactctctcacaaaatgtgccagggcctctccgccccatcgccgccgtgttcggcgcttctctccttcacgctcctcctcctcctcctctcggtggtgggcccggtttcggcatggcggccttggccccagagcaacaaaatgaacatcagcgattatgccttcggggactccaagaaatacgaggggtcctcggagttcgtgaagctgaggtaccacatgggaccggtcctgactaccaacatcaccgtccacaccatctggtacggcaagtgggagcggagccagaagaagatcatccgcgagttcataaattcaatctccgccgcgaactcgccgcacccctccgtggccggatggtggcgcaccgtgcagctctacacggaccaaaccggcgccaacatttcaaaatcggttcgactcggcgaggagaagaacgaccggttctattcccacggcaaatcactgacccggttatcaatacagtctgtgataaagagcgccatcacaggcaagacgagacccttgccgatcaaccctagaagcgggttatacctcttgctcacggccgatgacgtgtacgttcaggatttctgcacgtcggtgtgtgggttccactacttcacgtttccctcgttggttgggtatactcttccgtacgcttgggtgggtaactcggcaaagttctgccctggacagtgtgcttatccgttttcggtgcccgcgtatatccctaaccggaaaccgtttaagtccccaaacggcgacgttggggttgacggcatgataagtgtgattggacacgagatggctgaactggcaacgaacccgttggcgaatgcttggtatgcgggtcaggacccctctttccccgtcgagattgccgatctctgtgaggggatttacggcaccggtggcggtggatcctacaccggtcaggttttcgacgctcgagatggcgccacctataacatgaatgggatcagacggaaattccttgttcagtggctgtggagtcacgttctcaattactgtactggacctaatgcgcttgatcactgatcatctcctcagtcaatgtgctaga

SEQ ID NO: 306 - DNA, 1283 bp, Glycine max
tggacatgaacgaaatcgatgttccttcgttctttctctgccccatttcgctagatatcatgaaggatccagtgacggtctcaacgggcatcacctacgaccgtgaaagcatcgaaacctggctgttctcgaagaaaaacacgacatgccccattaccaaactgcccttgatagattacaccgatctcacaccaaaccacacccttcgtagactcatccaagcgtggtgttccatgaacgcttctcacggcatcgaaaggatcccaacccctaaaccccccgttaacaagaaccaaatttcgaagcttctcaaagacgcttctcattcccctctcacatgcctcagaagactcaaatccatctcttccggaagcgaaacaaataagcggtgcatggaggcttctggcgctgttgagtttctagcatcaattgtaatcaacaccaaccgcaacattgattcttcacatgaggctgactcaaacgacggatctggattcgagttgaaaacaagtgcatgcgatgaagcgttgagtttgcttcataatcttcatttatccgaacaagggttgaagactctcttaagcttcagaaacggcgagtttattgagtctttaacaagagtcatgcaaaaggggttctttgaatcacgcgcttatgctgtgttcttgttgaaatctatttccgaagtggctgaaccagtgcaactattgcatctaagacaagaactttttgtcgaactggtacaagtcctgaaggatcaaatttcacagaagacatcaaaggcgacccttcaaaccctgatccaattctctccttgggggaggaacaggatcagagctgtggaagcaggtgctgttcctgttttgattgagcttcttctcgattgcaaggagagaaagccttgtgagatgatgctggtgttgttggagctgctatgccagtgtgctgagggaagagcagaacttttgagccatgcagcaggtcttgccattgtgtccaaaaagattctaagggtttcgactttggcgaatgatagagctgttaagattattctgtctctttcgaggttctctgcgactccacatgttgttcaagaaatgctgaaactcggtgtggtcgcgaaattgtgcttggtgcttcaggtggatagtggaaacagggctaaggaaaaagctagagagatactcaaattgcatgctcgggcgtggaggaattctccatgcataccgaacaatttgcttaattcatacccgaattatgtgtgaaacaaaacgagaatttga

SEQ ID NO: 307 - DNA, 962 bp, Glycine max
gaaaaatgggaggaagaatgcacacgaaatcagactcggaggtgacgagcaacagcatggagcagtcgtcgccggcgcgttctcctccgcggcggccactctactacgtccagagtccttcaaaccacgacgtggagaaaatgtcctacggctcaagccccatgggttccccacaccaccatttccactactacctctcttcccccatccatcactctcgcgaatcctccacctctcgcttctccgcttccctcaaaaaccctcgcaacttctcctcctcctcctcctggaagaagctccaccctcaccccaaccgcgacgttgaccccgacgaccatgacgacgccgaccaccacctcaagcagtcctcccgcaacctccgcttgtacttgtggttcttcctcctctttcttctccttttgaccctcttctctttcatcctctgggccgccagcaagacctacaagcctcgaatcattgtcaagagtatagtgttggagaacttgtatgttcagtcaggaaacgatggaactggggtaccaactgatatgttgtcgttgaactcaacggtcagaatattgtacagaaatcctgccactttcttcggcgttcatgtcacttctacccctcttctcattagctattaccagcttgcaattgcctctggccagatgcagaagttctatcaatcgaggaagagtcggcggagtttggctgtagtggtttcaggacaccagattcctctctatggtggcgtgtcagttttagggaatactaaagagcatttggagagtgttgcattgccactgaacctgacatttgtagtgagatcaagggccttcatcttgggaagattagttaagtctaaattctttcgaagaatcagatgttctgtcactttgcatggcaacaaacttggaaaacatcttaatttaacggattcctgtgtctacaagtgataa

SEQ ID NO: 308 - DNA, 848 bp, Glycine max
aactaatgggcgtgttcagcgaagatccgaatcccaacccgaacccgatcgtgatccgagaggtttgggcctccaatctcgaatccgaattcgaactcatccgcgaactcatcgatcgctacccttttatctcaatggacacagaatttcccggtgttattttccgaccacatgtggaccccaccaaacccttcaaccaccgcaaccgtccctccgaccactaccgcctcctcaagtccaacgttgacgctctcaacctcatccaggtcggcctcaccctcaccgacgccgccggcaacctccccgacctcgccggaaaccgctccatctgggaattcaacttccgtgacttcgacgtggcgcgtgacgcctacgctcccgactccatcgatcttctccgtcgtcagggcatcgatttcgcgcgtaacaccgccgacggcgtggattccacgtgcttcgcggagctgatgatgtcttcggggctcgtgtgcaacgacgccgtgagttgggtcacgttccacagcgcgtacgatttcggttacttggtgaagatcttgacgcgccgtaacctaccgacgaggttggaggaattcttgaaaaccgtgaaggtgttcttcggagataacgtttacgacgtgaagcacatgatgaggttctgtgacacgctctacggcggattggaccgcgttgcacggacgcttaacgtggaccgcgccgtagggaagtgccaccaggccgggtcagacagcttgctgacgtggcacgccttccagaagattgttgacatttattttgtaaaggaagagcaccgaaaacatgccggtgtattgtttggactataggcataa

SEQ ID NO: 309 - DNA, 1290 bp, Glycine max
tgaatagtgatgttcctctcgagatcaattctctttgtgtttgtgttctcagcttgcttgcttctcattccagccaatggaattcgatcatttgccagaacaaatggttatgaaactgaggttgaagaagttgatccttttgcgcaattcagagaggccccagaatacagaaaccagcggaagtgcactctaattgacacaaccaatgcgcaattagtatgtgatccttcacttgttcatgttgccatgaccattgattggcactacttaagagggtctattgctgcagtgcattctgtcgtgaaacacacttcctgcccgctgaatctgttctttcatttcattgcatcggatgcaagattggatagcaaggatgtgtttgaaaggattgttcacacctccttcccttcattgagattcaaagtttatgtgtttagggaaagtcttgttgacaatctcatatctccttcaattagggaggcacttgacaaccctcttaactatgcaagaagttaccttcctgatttgcttgatcaatgcattgaaagggtcatatacttggactctgatgttatagttgttgatgatgttcaagagctttggaaggtttcattgacagggtcaagagtcattggtgctcctgaatactgtcatgcaaacttcaccagatatttctcctatgagttttggtcaagtgctgagttttctgaggtcttccaagggaaaaggccttgttatttcaacactggggtgatggtgatggatttggtgagatggagagcgggcgactacacaaggaagattgagaagtggatggagattcaaaaggagagaaggatctacaagttggggtcactccctccctttttgctggctttcggtggtaatgttgaggccattgaacatagatggaaccaacatggtcttggaggggataatgtaagaaatagttgtaggactctgcatcctggtccagttagtttgctacattggagtggtaaagggaaaccatggactaggcttgatgccaagatgccttgctcagtggattttctttgggcaccttatgatctctacataccccatcaccatacataccatcattaccaccaccatcaaagaattgctattggctcaacacattcatcattttaggacataattttatattggttgattctgattcatttgttctgaatattatttttttgtatagacagaacaattaaaagattttgtaatgtttgttgatacatcttcaatagtattgtaacagagaatgtcatgcga

SEQ ID NO: 310 - DNA, 1236 bp, Glycine max
tgtctgtgactggtgagagccaaaagccgaagaaagggaagatggcgctatggatggaaaagggttcagagccattaaccgaaaccgagaaggcagaccttgaagccattgctgcactcaaagagtctgcagcctttgaattcaaggaaaagggtaatcaatatgtgaagatgggcaagaagcattactctgatgccattgattactacacgagggcaattgatcagaaagccttgagtgactctgagacctctattctctttgcaaatagagcccatgtgaatttgcttctagggaatcttagacgtgctctaacagattctaatgaggccctcaagttgtgcccttcaaatataaaggcaatttatagagctgcgaaagcttctctttcactaaacatgttggctgaagcaagagagtattgcttgaagggtcttcagtttgaccccaataatgaggacttgaagaagcttgaccggcagatcggtctcaagatatcagagaaggaaaagcatgaggctgaagcctccaaggctgtcgcggagacaaagaaacttgtgtctgcgattgaaaatagaggcttgaagattggaaaggcaatgtatctagaacttactggactacggaaacctgtgttggataaaagtaatatccttcattggcctgttcttcttctgtatgcagaggttatgtccagtgacttcattgaggatttctgtgagactgacatgttttcggttcaccttgatatgatattttcagaagatcagccgttgtcatgggatgttgaaaacaactacaaacgtgaatttattgaattatactatgagactggttctggactttgtctatcaaaggaaaaacttcttcattgtctattagagggaactgcagctgctcacagggaaggtgttggtgatgaagagaaagacacagttgaggattataagcaacacatgggttcccctaaatggatcaaagtgaatgaaaggagaacactccacgatgttctcaaagagcctaatttcatcattcctgggatcccagtcttctatgttgtttctaagcgatccagcttttatggcaagttcaaagctgggaagtgggcacctccaagtatatgaaggaagcaacatgtagctgatgtccaaacagacatgttttgcacaaactagattcaagagttaatgtctcaactcaacttggaagtcttgaagattgctcatagttcttcca

SEQ ID NO: 311 - DNA, 1046 bp, Glycine max
gagtcatgactatggctggagctttgagtctctcccaattcccagttcgtgggtctgtttctttgcccaaaagaagaatacccagaagaagcttttgcattaggggcatgtcagaaatctcttccactttttctgtgagcacccaacaagaagaaccaacttctaatgcttcgtcagtgacaattgcacctccccccaacttcaagccccctgagcctaaacgctttgcaatcagacctgacaagaccagtgaagtatttggagctttgcttcctttgctctttcgctttgctaccggagttttcgtttctgggtattctttttcaattgtttctaaggatgaaattcctccagatgaatatgctttggaacttaatggcgttaccataaaagaaacagcaaaattaggccctcgcccagagaagcctattgagatatatgaatttgagagctgtccattttgccgaaaggttagagaaattgttgccattttggaccttgatgttcttttctatccttgtccaagaaatggcccaaatttccgtcaaaaggttctagagatgggtggcaaactgcagttcccctacatggttgacccaaacacaggcgcttcaatgtatgaatcagatgacataattcggtatttggttgacaaatatggtgatggaaacgttcctctatctttatcacttggatttttaacgaccctaactgctggtcttggtatgcttagtcgtatttcaaaggggactacttatactccagcgaagttccctccaaagccacttaaattatgggcatatgaggggtctcctttctgcaaacttgtacgtgaagtacttgtggaattggagctgccacacttgcttgtctgttgtgctaggggtagcccaaagagaaatatactatatcagaaaactggaactttccaggcaccttttttggaagatccaaacactgggatagaaatgtttgaaagtgcagaaatcatagagtatctaagagcaacatacgctcttcagtaagtgatgcctatgataggataa

SEQ ID NO: 312 - DNA, 975 bp, Glycine max
agtgttagcggttctggttctggaaattgatcgagtcgaaaagaaccctaacaataacatggattctcaggttgccgtagctcttgctctttcacttgttggtggtgtcagcacttctatcggtgcactttttgtaattgttaataaagctcccagtttgaagatgcttgggctattacagggttttgctgctggtttgatgcttagcatatcgttctttgatttggctcacaatgctttgaactcattgggcttcttgaaaggcaacctttggttttttgctggggtaatattctttgctgttgttgccagttttatcccagagccaacacttacacccacttctgatgtgaagggcagaaagaaaaatggggatgaaggaggcaaggatattatgaaaaagcatcgccggcaagttttgttcagtggaattgttacagccgtaggcataagtttgcacaattttccagaaggaatggcggtgttccttggatccttaaagggcctccgtgttggcatcaacttagcattagccattgctctgcacaatatcccagagggtgttgctgttgcacttcctgtttattttgcgacacaaagtaaatggcaggcattcaaattagcatcactttctggctttgctgaacccctgggagttataattgtagcctatctattccctagcagcttaagtcctgagattctggaaggtttacttggatcagttggtggagttatggcttttctgacccttcatgaaatgcttccattggcttttgattatgcgggacagaagcaatctgtgaaggctgtctttttggggatggctttcatgtctgcaagcctgtattttctaagtatcagcttacctgaggacttaagcttgtaggtgggaacaacctcttctcttctctaaatgtcatgaatttcagtcacattgtgatgtgtttcctgattctatcacctatcgcagca

SEQ ID NO: 313 - DNA, 1272 bp, Glycine max
tgtgttatgttcagttcgttgcatgcaaaaacgattatgaagacgccaaaacgccactcgccgccgccaaattcttccctgcgagtggagtctgattccggcgaaatcgtcacgaggttcaagaacggtcgccggagaagaattaaaatcaagcgaatgaaatacacttgccagacgaagatccgcgtcaggaatgacgccggcgccggcggcgtgtctcaacttctggcggtggattctgaaggagagaagagagagattcacgagaacgtggagatatcgctgtcgctggcttcgtcgtcgtcggaagaggaagagcgattgtcgtcgaagcaaaacgacggcgttttgtcgtacgggtcggcatcggtgatagggagcaggaaggagatggaggacgcggtgagtgaggagatagggtttgctgcgaagtgcgacttcttcgcggtgtacgacggccacggcggagctcaggtggcggaggcgtgcagggagaggctgtacaggctggtggcggaggagatggagaggagtgcgagtcacgtggaatgggactggcggggagtgatggaagggtgttttcggaaaatggactgcgaggttgccggcaatgcggctgtcaggacggtgggttccacggctgttgtcgccgtcgtcgcggcggcggaggttgtcgttgctaattgcggtgattgtagggccgtcctgggaagaggaggtgaggccgtggacttgtctagtgatcataagcccgacaggcccgatgagttgatacgaattgaagaggctggtggaagggtcattaactggaatggccagcgcgtgcttggtgttcttgccacttcacgatccataggagatcagtaccttcgaccttatgtaatatcaaaaccagaagtgacagtgaccaagcgaagcagcaaggatgaatttctcatactagcaagtgatggattgtgggatgtgatgtcaagtgaagttgcgtgccaagttgtaaggaaatgcttccacgggcagattaggagagtgtgcgatggagttgggaatcatcaaaaccgtgctaccgaggctgcaggcctcttggcagagatagcattggcaaagggaagtagagataacaccagtgtcattgtagttgagctaagaggatcagtaacaactgattgaggcctcatttctgccaaaacatgtatctttatttttattttcttctctacttattggcttgctgcttttggactaatatctactcaggatgtgcctcttcaatag

SEQ ID NO: 314 - DNA, 1639 bp, Glycine max
agaagcagtttccagtctccgtcagtaaaacgatgggcgacttcacggttgcgttaaaccctcccaaaaccttccgctccgacaatctcctatccaccaccaaccgcatttccccagcggcgcgtggctttcaaacctcactcgcgttcaaaccgcgcgtttttcgaggaatccgcgcttcggtgatgccaagagagggccagccacaacaacaacaacaacaagcgtcgtctctcggagacgctctcgtcaacagtccgcgccgaaacgacgtcgtcgaggccatcggaagaaccgcatcgctctccaactgcctctccgaaacgaacctccacgccaccgttcccggcctcgagtccaaaacccgcggcaaagttcgagatatatacgacgctggggattacctcgttttggtgaccactgatcggcagagtgcgtttgatcggattcttgcttccattcctttcaaaggccaggttctcaatcagacgagtttgtggtggtttgaaagaactaagcatatcgtctctaatgcggttgtatcagctccagataacaatgttacaatagctaggaaatgttcagttttcccagttgagtttgttgctagagggttcgtcactggaagtactgatacatctctatggacagtctacaataaaggcgttcggaactattgtggaaatgtcatcccagatggaatggtaaaaaatcagaagttgcctaaaaatatactcactccaacaaccaaggctgcagatcatgatgttcctatcactccagatgagatcatagaaaggggactgatgactcgagctgattatgtagaagcaagtgaaaaagcattatccttgtttgaatatggacagcaagtggctttggagcatggcctcatattggtagacactaagtatgagtttgggaaggcaaatgatggttcaattatgttgattgatgaggtccatactcctgattcaagtagatattggattgccaattcttacctggagcgctttcaaaatggtcttgagcctgaaaatattgacaaggagttcttgaggctgtggtttaaaagtcactgcaatccatatgaagatgaggtccttcctgatgctcctgaagatcttgtctgtgaattagcctggcgttacattttcttgtatgagactataacaaaatcaaagtttgaggtgcccttgaccgaggagcctatacatgaccgaatttcacgaaatgttgcatctgcactgtcatccttaaagtagcctgggaattatagggcactgttgtaattctgtattttaatatcttaatataaactatatcaaaaacttaaattaatggagaacttctccaagcaagtttttatttttcctaagtataacttaaagcagaaaggcaaaacaacagacagttttcagaaatttgacatgtgattttttttaagaataaagagctgtttttggaagcagaacccattgtgtcctttgccttgtatatttcattgtgacagtacgagaattaaatattatctgttctgtatgaggaattatttgcgcatgttactacattgtgcaatcttacctttccttttcttttctaccattgtttatcatccatttattcttcgggagacaga

SEQ ID NO: 315 - DNA, 1335 bp, Glycine max
ctgctgcgtcttcttcatccatggtgttagggttttggttggagtagccttttgcttcgtccgatattttggacatggacgccgaagcggaccctcctcaaaaccctatcacaagacacaaatgcttggcatgctataagcaatataagaagaaagagcatcttattgagcacatgaaaacctcgtatcattctgttcatcagccaagatgtggtgtatgtcaaaagcactgcaaatcttttgagtctctgagggaacatcttactggtcctttgccaagaggaatttgttcaaagattttctctcaacagggctgtcaactttgcctggcactatttgatagtcccgggtctctcattgatcatagaaaaatatgtcgcatatctgcccctacttgtccaggaacaagcgcattgccctatattgattcccagtttgattgtcaagattcttctgatgaaaaccatgctggcgagggccctggaggagcagttgcaatggactgtgaaatggttggtggtggaagtgatggttctctggaactttgtgctagagtgtgtttggttgatgaagatgagagattaatcttccatacttatgtacagcctgaaatacctgttactaattacagatatgatataactggattgacagaagagcatctcagaaatgccatgccacttaaggaagttcgagaaaagctactgcaaattctacacaatggagaatccattggcaaagttagactggatggtggaaaagcaaggcttcttgtggggcatgacttagcacacgatttggattgtttaaaaatgaattatcctgatcatatgctgagagacactgcaaagtaccgtccgttgatgaaaaccaacttggtcagccattcactcaagtatctcacccgaacatatcttggttatgatatccaatccggcactcatgacccttatgaagattgtatttctgtcatgagactatacaagagaatacgatctcaacttcatccggaggaagaccatggaacaatgaccctgagtaacaacattgttggcatgcctgatagctggatatctagggaacttgacaacctcacaccggatgaactttatgccatgtctagatcagattataagtgttggtgcttggatttgataccaagattgtcagcctgaattattgatctttgcatttgtccataacataagcatatttcttcaagaactatgagaatggagcatttgcaatgatattttctgtgcatatcttcctatgcatcgagttatcttccagacaagaaaattacgagaaaagataggtgctttatgatggagc

SEQ ID NO: 316 - DNA, 452 bp, Glycine max
acgttctcactcaaacctcttctatctcattgtctccactttcttctcttttttccccttttaacactttctcttccttgcatctctacgttcctcttaccacaaggtaaacaaagatggcagggtgcgataaggaagactatttctctgccccgaatgctgagacaacatccgagggaaagtacggtaggcttgccccaaagaagaagcctttgatatcgaaagataatgaaagagcattctttgattcggcagactgggcattatgcaagcaaggtgctggagtgaatcaacaatctacagcaacagtggagacactgcgaccaaaactacagagaactccacatcagcagcttcctccaagacgacctgcatgcacatctggttgagataatttcgtgaattactataatgtggagagtagacttaataaacggaacaaggatttgtag

SEQ ID NO: 317 - DNA, 696 bp, Glycine max
ggaagaatgcaaatggcaattttgttaagaggaggagcacttggagattctagctttcgtttgtgttcattaacatcaacttcttctttgcatgtctcccaaaatgttgccatacccacctcatcatcatcaccaatactacccttgattgcaagtaaatttaaaacggccagcagaaacagaattacctgctctgccgttcaagaatcatctcctagcacagcagctactactgctgaaacaaaggaggaggtaaaggaagccccaaaagccgcagcaccagcaaagaaacctcctgctaaagctccagctaagcctctgcctcagatgatggaggaggatgtgatcccttcactgaaagcaatatttgaagcccaagaagatttctcaaatattgagctggtcttcaaggacaataagttggaaggttcgtttttgaagaaaggtaacccctattcattttgggccttctttcccacaggaaaccttattggtccaaaggggttttctctgtcatcgtataactcgagagcaagcaccgttgagccatttctcgttgatgaaaagaagatcactgcaagacacattatcttttgggttgaaaaacgtttggcagcacaggggatcattcctgtatggaaagattagtcccttgacaatgaaattatactctggttgctgattatcatgtagcat

SEQ ID NO: 318 - DNA, 2657 bp, Glycine max
agagtcttgtgttgttcacctgtaacgtaacaagctttctaacgtgtcttctaaggtggtttcactgctccacggttgccgaatctagcttcttgcttctttctccttccaagatatcctttgattcaactttggatcttcacctctgatttcctttcatcgttgggtttatacacccttggggtttcccctcctcacccaactgtgtgcaacaaccacaaagtgtataccgtgtgttcttcctagaggggagaaaaaatggccacactttcagatattggggttgcagctggcttaaacattttgagtgcatttattttctttgtggcttttgctattttgaggcttcaaccttttaatgatcgggtatacttcccaaaatggtacctgaagggtttaagaacagatcctgtccacggaggagcgtttgttcgcaagtttgtcaatttagattggagatcatatcttaggtttttgaattggatgccagctgcacttagaatgccggaacttgaactcattgaccatgctggattggactctgttgtttacttgaggatttacttggttggacttaaaatctttgttccaatagcatttctggcatgggcagttctggttcctgtcaacgccacaagtaccgggctagaaagtgctggtctggacaacataacttcgagtgacattgataaactctcaatttcaaatgtccatagtacatctgaaaggttttgggcacacatactagttgcttatgcatttacattttggacatgctacattttactaaaggagtatgaaaaagttgcctcaatgagattgcaatttcttgcagcagaaaaacgtcgccctgatcaatttacggtgctcgttagaaacattccaccagatcctgatgagtctgtcagtgagcttgtggagcacttttttctggtcaatcatccagataactatctttctcaccaggttgtttataatgcaaacaaacttgcaaagttggttaaaaagaagaagaagttgcagaattggcttgtatattatcaaaacaaagttgaaagaacttcagaaaggcctcaaataaagactggcttccttggtctttgtggaaacaaagtagatgctattgatcatcacaacactgaaattgacaaactgtcaaaggaaatagcgttagagagggataatgtcagcaatgatcccaagtccatcatgcctgctgcatttgtttcgtttaaaacacgatggggtgctgcagtctgtgcacaaacccaacaaactagaaacccaacaatgtggttgactgagtgggcgccagagccacgtgacatctattggtcgaacttggcaattccatatgtttccctcactgttagaaggttgatcatggctgttgcattcttttttctcaccttcttttttatgatcccaattgcaattgtacaaggtcttgcaagtattgacggaatccagaaaagagcgccatggttgaatcctcttattgaaattcctttcattaagtcattcattcaaggttttctaccgggtattgcattgaagctttttctcatctttttgccaacaatattgatgatcatgtcaaaatttgaaggcttcggatctatttcatctctggagagaagagcagcatctagatactatcttttcaattttgtgaatatatttcttgggaacatacttaccgggacagcatttgaacagctggactctttcattcaccaagcagccaatgaatatcccataacaattggcactgcaattcctttgaaagcaagtttcttcatcacttatataatggttgatggatgggctggtatagctgcagaggttttgatgttgaaacccctaatcatatatcacttgaagaattttttcttggtgaagactgaaaaggatagggaagaggctatggatcctgggagtattggtttcaacactggagaacctcgaatacaattgtactttttgctgggtctagtctatgcttcagttacacctactgttcttcctttcataatagttttctttgggctcgcctatgttgtgttccgtcatcagattatcaatgtttataatcaagagtacgagagtggtgcagcattctggcctgatgtccattttcgtgtcattattgcactgatagtgtcacagatagttcttatgggacttcttaccactaaaaaggctgcttcatcaactccatttctaattgtactcccagtactgacgatatggttccatatatactgcaaaggacgtttcgaacctgcgtttgttagatatcccttacaggaagcgatgatgaaagacacattggaacgagctacagatcccaactttaacttaaaagcttaccttcagaatgcttatgttcatccagttttcaaagctagcctttttgatgaggacgaggacgaagaggtaatgagtctaaagttggaaactgagagtttgactgtacccacaaaacggcaatcaagaaggaacacaccattgcctagcagaattagtggtgcatcatctccttctctgcctgatcatggcattcgaaatcatccagagccataaatcatggacaccaaggaatcatatcattattttggaccgaccacaaccacgaccacataggctagtaggat

SEQ ID NO: 319 - DNA, 1217 bp, Glycine max
agaaagggaagggaaggtaacacgctatggcggcggaatcgggtggtacgccgacaaactttgatcttcccgaggaggtggtgcaagtgctaccgtccgatcccttccagcagctcgatgtggctcgcaagatcacttccattgctctatcgacacgtgtcaacaccctcgaatcagagctgtcctcgcttcgcgcccagatcgccgacaaagacaacctcatcgccgaccttcaatctcagctcgactccctcgacgcttccctctcccaaatcgccgacaaactcctccaaaccgaacaagataaggagagcttgctccaggagaatgcttcgctttccaacaccgtcaaaaagctcaatcgagatgtctccaagttggaggttttcagaaagacgcttatgcaatcacttcaggaggaggatgataactctggagcagctccagacattgttgctaaaatacagagtcaagcaagtttgacttccacgtcgcagattggagataatgatgtttcattgccaccgtctgtatcttcttcaacaggaaattcttttgccaaggatcatgaatctgatgccataagacctagagtatcacagaatctcctcttagcatctcaaggttccacccctcggattactccccctggttcccctcctagtttgtcggcatcagtatcacctacgagaacatctaaacctgtatcaccacagcgacattcaatttcctttgcaaccacaagaggcatgtatgatgacaggtcttcaatgttttcctcaatgtccttaactcatggttcaatatcaagctctgatgcaggaacaggatcacaaactggacgaacacgggtggatgggaaagagttctttcgccaagtcaggaaccgtttgtcttatgagcaatttggtgcattcttggctaatgttaaagaattgaattcccataaacaaacaaaagaggaaacgctacggaaagctgatgaaatttttgggcctgaaaacaaggatctgtacactatatttgagggattgattaatcgcaatctccattgacattgtgcttaagagattctttccaaatttgtaataacggatactatcgtgcatgtctccttatttatagcaacttttttttctcccctctgtataatacaatacttttttttgaacatgaaaaccgaatgacagtcttggcaggactacaaggttgcagtt

SEQ ID NO: 320 - DNA, 2870 bp, Glycine max
attcattccaccacactctgcgttcaacaacaccatgccactgcgtaaccatttttctaactaacttctcaaaacgacagcgtcgcagaaaatgacaattacgctttcaccctctctctctgtaccccacccttcccctttctccctcaccccaaccaccaccctccgccaactcttcttcactaacttcacaccgtccccgagacgcaggctccaactccaagcacgtgcgggaaagcccaatgtcctcatccccataaacccctcggtggcagttgagaaaggaaagtacagctacgacgtcgaaaccctaatcaaccgcatcaccgcgctgccgccacgtggcagcatcgctcggtgcctcgaccccttcaagaacaagctctcccttaacgacttcgccctcgtcttcaaggagttcgctcagcgtggcgattggcagcgctccctccgcctcttcaagtacatgcagcgccagatatggtgcaagcccaatgagcacatatacaccatcatgatcacgctattgggccgagagggcctcctcgacaagtgccgcgaggtgttcgacgaaatgccatcgaacggcgtcgctcgcactgtctacgtctacaccgccgtcatcaacgcctacggccgcaacggccagttccacgcctcgctcgaactcctcaacggaatgaagcaggagagggtctcgccgagtattttgacttacaacactgtgattaatgcttgtgctaggggtgggttggattgggaaggcttgttagggttgttcgctgaaatgaggcatgaagggattcagcctgatgttattacttacaatactttgcttggtgcttgtgctcatagggggttaggtgatgaggctgaaatggtgtttaggactatgaatgagagtgggattgttcctgatattaatacttatagttatcttgttcagacgtttgggaagttgaataggcttgagaaggtttcggagcttcttagggagatggagtccgggggtaatttgccggatattacttcttataatgttttgttagaggcttatgctgagttggggtctatcaaagaggcgatggacgtgtttaggcagatgcaggctgcggggtgtgtggcgaacgcggccacgtatagtgttttgttgaatttgtatgggaagcatgggaggtatgatgatgttcgcgatatttttcttgagatgaaagtgagcaacacggaccctgatgcggggacttataacattctcatacaggtatttggggagggtggctactttaaggaggtggttactttgtttcatgacatggtggaggagaatgttgagccgaacatggagacttatgagggcttgatatttgcttgtgggaagggagggctctatgaagatgccaagaaaattttactgcatatgaacgagaaaggaatagtgccgagttccaaggcttatactggggtgattgaagcgtttgggcaggctgcactgtatgaagaggctcttgttgtgtttaacactatgaatgaagttggaagcaacccaactgttgagacctacaattcattcattcatgcatttgcaagggggggactgtacaaagaagcagaagcaattttatccaggatgaatgagtctggtttaaaacgggatgtgcattcattcaatggtgtgatcaaagcttttaggcaaggaggtcagtatgaagaggctgtaaaatcttatgttgaaatggaaaaagcaaattgtgaacctaatgagctgacacttgaagtggtgttaagcgtatactgctccgctggtcttgttgatgagagtgaggagcagttccaagaaatcaaagcttcaggaatactgcccagtgtcatgtgctactgcctgatgctagctctttacgccaagaatgacaggttaaatgatgcctataatttgattgatgagatgatcacgatgagggtgtcggatattcatcaaggaattggacaaatgatcaagggagattttgatgatgagtctaattggcagattgtggagtatgtctttgacaaactcaattctgaagggtgtggattgggaatgaggttctacaatgcactgttagaagctctttggtggatgttccagagagaaagggctgctagagtgctcaatgaagcatcaaagcgagggctgttccctgaactttttcgtaaaagtaaacttgtgtggtctgtggatgtacacaggatgtcggaaggtggtgcattaacagcactatcagtttggctgaacaatatgcatgaaatgtccaggaccggcaatgatcttcctgagcttgcaacagttgttgtggtccggggtcacatggagaaaagcacagaagcccaagatttccctatcgcaaaggctgccatttcattcttgcaggataatgtcccatcatcctttacttttcctggatggaacaaaggtcgcattgtttgtcagcagtcacagctgagacgaattctctcgggcactgaatcatcttctagtaggaaaaaaatggataaattagtatctttaagtaataccccattgactactgcaggagttataacatccaaatctgatgtgcaaagtggtaaagctaatgatgttgattctagaaccgatagtacaagaacagagcttctaacgagtgcaatttagatcagattagaaagtatagaatttacattcatcactttcccatgccctgttttggtctttttgaaattaagattggggcttatttgttacacttccacgaaatattcccaagtgggcgctggctttcagatcgccaaaattttggtatatatatattatcaaggtatctgaacagttgtctgtcgtcaccaatatttag

SEQ ID NO: 321 - DNA, 713 bp, Glycine max
tgctccttctcacttcacaacactcaccccatttttctactcctttccttcttccctccttttatttcatttttctaacaaaatggaggaaagggtggtaccaaagaggccaagagaagaagagaccctagagcacaaagatgcatcattagatagttatgaattactagagtcctcatcaaagaggcacatgccatacaaccacatactatccctccttgaatcagaggaagaagactccacacaagacctctctcctctcatcactgccctccaacaagaaatcaccaattgtgccaatgattcggatacccttttgagccaacacaacctcaccaacaccacaacaacaactaataataatttagagtcttgttcatcctcaacaactcaatattctagtaacatggtggaggaacatgatgacaaagaaggggtcatgagacaccttcttgaagcttctgatgatgaacttgggattccaaataaagaggatgaatcactcgatcatggtgaagatgggttcaatttcaacggtggggacatgttttcttccttttgtgatgggttgttgtgggaccttgaagatgaagctgccaactactatgatctcttgcagtctcaactctttctttagttttttttttttttttggtgggggtagaaagtgaaaaaccaaagtttttcatgcgttcaagatgaaatccaaggag

SEQ ID NO: 322 - DNA, 1251 bp, Solanum lycopersicum
caagaaatttagagatggctggtgaatttagctcccttgttaacaagatcaagccttatttggctatggtgtctttgcaatttggttatgcagggatgtatattgtcaccatgatgtgtttcaaaagaggaatgagtcattggattcttgttgtttatagacatgcatttgccaccattgctgttgcaccctttgctatcgttctcgaaaggaaaataaggcctaagatgacacgcagggtctttattaagatagtggctcttggttttctagagccagtgattgatcagaatttgtactatttgggactgaagagtacaactgcaacttatgcatctgcttttgttaatctcctcccagcagtaacctttattctggctgtagttttcagaattgagaaggtaaatttgaagaaaaaatcaagtatggcaaaggttataggaacagcaataacagtggctggagccatggtgatgactctatacaaagggccaatgttcaacctggtcccacgtcacggtggcgcgcaccacgaagcctctgtcgcggcccctgagaattgggtagccggaaccattgagctcatcgcttgcattgttggttggtccggtttctttattgttcaatcgatgacactgaaagagtatcccgcggagttatctctagcagcatgggtatgtgtgatgggtgtagtggaaggtggaattgttgcacttataatggaacgtgattggaatgcttgggttattggatttgactctagactccttgctgctgcctattctggtattgtatgctcaggaattgcatattatgtgcaaagtgttgttaataaagttaaaggcccagtatttgtaacagcctttagcccattaagtatggttattacttcaattcttgctgctattatcttagctgaatcagtccatcttggaagcttaattggagcaattatcatagtcatgggactatattctgtggtgtggggcaagagtaaagaagggaaaatcaatgatatcactagtaaagatcaagaattaccagttgtggatattaaagaaagatcaactattgttgatgataatattaatgagaagaaaacttcaatctaccaagagcattaacatgatttaaaaaaaaaaagaagaagatgttgtatctttaaatctgtaattttaatttttgacttgttgcaatgtttaaattttctaagtgttgctctttaaaacaatgcaactaatgttgtgatca

SEQ ID NO: 323 - DNA, 675 bp, Solanum lycopersicum
ctcaattttcccgtctgtgtattataaaataatgagccgacatccttctatcaagtgggctcagaggtctgacaagttgtttattacggtggagttaccagatgccaagaatgtgaagctgaaactggaaccagaaggaaaattcttattctctgcaactgcaggagctgataatgtaccttatgaagtggatctcgatctgtttgataaaattaatgttgatgagagcaaaagtagtactacctctagaagtatcgtgtatctagtgaagaaggcggaagacaagtggtggagcagactggtaaagcaggagggattacgtccggtgtttttgaaagttgattgggacaaatgggttgatgaagatgaagaagacagtaaacctgagccagatatggattttggtgacatggacttctcgaaactcaacatgggagaaggtcctagcgattttgatgttgatgtgcctgagggcgatgacgacagtgacactgaagaaattgatgaagaggagaactctgaacccaaggcagcagtgcctccaagcaccgaacccggagtgaaagcttgacgcattccagcgtttgtaacattgaaaactttttaactgcttgagtttgagtgtggtacttcttctagctatggttagagctgtagtgcaggaaatgtttgatg

SEQ ID NO: 324 - DNA, 1225 bp, Solanum lycopersicum
aaaggatcctgattcaaatttcttttgctatggttctttctaaaaaactcatcttttttgttctgtttttgtcgatttctctgtttctatttccagcaagtgctatcagaggttttgttgagaagcccagaaatataaaaattgatgggtatttggattatgttgaatctccagagtatcgtaatagccgtgaatgtccagttttagatacgaatatgttaatttgtgacccaaatttgatacatgtagctatgactcttgatgtcaaatattttagaggatcagtagcagcagttcactctgttctcaagcattcatcttgcccagaaaatgtttatttccattttgtggcttcaaaggataaagattttcaagacctgagaaagatggtgaagtccatatttccatctctgagtttcaaagtttacagctttaatgaatttcgagtgaagaaactgatatcatcttcgattcgtcaagctcttgataatccattgaactatgctaggacttatttagctgagatcatccagccctgtgttgaaagggtaatttatcttgattctgatgttgttttggttgatgacatccaaaagttatggtcaatttctttaactggttcgaaaattattggagctccagagtattgtcaagcaaatttcagaacatatttcaccaacaatttttggtctgacccgaaattatcgaatgtgtttcaagagaaaaagccttgttatttcaatacaggggtgatggttatggatttagggaaatggagaaaaggggattatacagttaagattgagaaatggatgaagatacagaaagaaaaaaggatttatgaattgggatcattgccaccatttatgttggtatttggaggggaaattgaaagaattgatcatagatggaatcaacatgggcttggtggagataatttggtgaatagttgtagaacattgcatccaggtccagtcagtttgttgcattggagtggtaaagggaaaccttgggtcaggcttgatcaagggagtccttgtcctgttgatcttttatggatgccttatgatctgtatagacttagctcaattgattctttggacgatcaagagcgaagagctatgatttgattgtttaagcaccagtaaatgtatagaagttaaaactctttaccgattctttttctacattgtgaagaagtgagaacttagatccaggtaccttt

SEQ ID NO: 325 - DNA, 1136 bp, Solanum lycopersicum
actaggagctaagatggctgaggatatttgtttcttcgccaaggatagtataatcataaaacctgccaagaaatctccagcattgttaaggatggtggttgtagcgtttacgctgatctttggtatttatatctgttcaatttgtcttaaacaaactagcttggagaatacaagtaaatacttgaacattgaagtcatggaaaagccttgccataactatgacatggatcaatcccaaattccatatgtgcattatccgaagccaaaaacttttagccgggctgaatgtagctgtaatcctgttcggcgctttgccattctctcaatgcaaaggtctgggagtggatggtttgagacgctattgaatagtcatatgaacgtaagctccaatggtgaaatattctctgtcaaatataggagagaaaatgcttcttcaatcctgaggacattggacacagtttataatttggacttctttacgagtgcttccaaaaatcactgctcagctgcagtgggcttcaagtggatgcttaatcaggggttaatagaacattataaggaaatcgttgagtacttcaataggaagggtgtttccgtgatatttctctttagaaagaatctactgcgacgtatggtttctgttctttcaaattcccatgaccgatatgccaaactcttgaatggaacacataagtctcatgtgcactcgcatgaagaggctggtactcttgcgaagtataaaccagaaatcaatacaacattgttgatcacagatttgaaaagaatggaggtttctgccacggaggcactggaccacttcaatagcactcgacatatgattctgtattatgaagatattgtcagaaatcaagctaaattggtagatgttcttgagtttctaagattgcctaagatggatctaagtagccgtcaagtgaagatacataacgggccattgtggaagcatatcaagaactgggatgatgtgaacaagaccttaagtggaacagcttatgagaagttcctccgagctgattattaatttctgacttatcattttcattgatcgatgaaggaggtgtagatatcaactttgttttcttgtaaatgctgactggtgtactctcaacttggaa

SEQ ID NO: 326 - DNA, 2104 bp, Solanum lycopersicum
cggaacatgtcaaggccactccatagaggtgtgtcaggtggggggaggttatcagttaatggccctgatttctgggatgactctcaaatgaaagataaaatagaaaaggaagatttggagcgtaatcgctcgcctggtgatctgacttattcacctaccaaattcctttgccggattctgtttccagataattctccttcaaaacataatttgggtgaaaatggcttactttctgatccatttagccctggaacaggaagaaatagactcaagtatgctttggttttgatcaggctgagcttagttgtcataatacttcttgcccttactggatctttttggtggacaatttcgataacttcctcgtcgagaggtcatatataccatggatacaggcagcttcaggagcaagtagtatcggatttgagagacattggacagctctctcttggtgctacaaatgtgaaggatatagagtactgtcctcctgaatctgagaactttattccatgtttcaatgtgtcagaaaatcttgatttgggcctttctaaaggtgaggaggttgaccgccattgtggacctggttcaagacaaaattgcttggtacttccccctgttaattacaagattcctcttaggtggcctaccggtagagatgtcatttggcatgcaaatgttaatattactgctcaagaggtactctcctctggaagtatgacaaaaaggttgatgatgttggaagaagagcagatttcctttcggtcagactctgccatgtttgacagcattgaagactactcacatcaaatagcagaaatgattgggctgcggaatgaatcaaactttgtacgagctggagtccgaactattttggatattggatgtggctatggcagttttggggcacatctcttttctagccaactgttgaccatgtgtgttgcgaactatgaagcttctggcagtcaagttcagctgacacttgaaagaggtcttcccgcaatgattggatcatttaattcaaagcagttgccttatccatctctttcctttgatatgatacattgtgcggaatgtcatgttgactgggatcagaaagatggtatttttcttgttgaagtcgaccgattgttaaggcctggtggatattttgtctggacttcaactattacgaatactcagcgctccgtccgcaacaaagtgagcctcaaaaaatggaactttgtccagaattttgctgaaagtatgtgctggaagctgttagcccaacaagatgaaactgctgtatggaaaaagacaagtttaaagaaatgttattttgcaaggagaccaggtgttgggccttccatctgcagtaaaggacaggacattgaatccccgtattatcgacctctacaagcatgcattgctggaacccaaagccgccgatggattcctattgaagaaaggacaaagtggccttctagggccaaattaaactccagcgaacttaagattcatggtttgttatctgaagctcttgctgaggattcccttaactggaattcagcagttaacaattattggtcacttctttcacctttaatattttccgatcacccgaagagacctggtgatgatgatccttctcctccctataatatgcttagaaatgtgctggacatgaatgcccattttggtggtttgaatgctgctctactggatgctagaaagtcagtgtgggtcatgaatgttatccccactagtgggcctaactatcttcccctaattctcgacaggggattcgttggtgttttgcatgattggtgtgaggcatttccaacatatccaagaacttatgatctggtacatgctaatggacttctgtcaatggaattcggccaacatatcagatgcccgatgtttgacctgtttattgagatggatcgtgttcttcgtccggagggctgggtgattttacgcgacactgtccctcttattgaattagcaagatctcatgcagcacggttgaaatgggacgcgagagttatagaggtagaaagcagtgatgagaagctactaatttgccagaaaccattttcaagaagacaagctagctaataag

SEQ ID NO: 327 - DNA, 1227 bp, Solanum lycopersicum
atcttgatgcttcccagtttactcttcagtaatttgaatcataaaaatataccctttttgtagatagaagaaaagaaatgctaatgatacagtccaccatttcacttcctctgcaaaaatctgttcttgttccagctaaaattgcaacaagtgggagtaaaaatggttgttttcttgatttaaatggtcggtgtggttcaaaatcagcttcttatcactttccaagaagacccattaagggaaattcaattcagctgaagatttatgccaggaaatcagaatcactcccaattttgctttcagagaaagttgatgaattgccagagatgttgctgaatggcggagatattaccattagtagtggggagattctttctctatcagctttctcatgtggatctatcttctggttgacatctgggcaagtggcattagcaagtgaaggtgtcagagtaaatatggtttatgaggtcggggaattatttgaactgggaatccagcttacttacctgcttttactactagcattgcttggggttggaagtttctttgtgattcggcaagtccttgtccgcagagagcttgatctttctgccaaagaattgcaagagcaagttagaagtggtgatgccagtgccacagagctttttgaacttggagctgtgatgttgaggagaaaattctacccagctgcaaccaaataccttcttcaggcagtagaaaagtgggatggagatgatcaggatcttgcccaagtttacaatgcccttggtgtcagttatgtacttgatgggaaaattgacaaaggaattgctcagtttgaaaatgctgtaaaagttcaacctggttatgtcacggcatggaacaaccttggcgatgcatatgagaaaaccaaagacttaacatctgctctaaatgcatttgaagaggtacttctttttgatcctaacaacaaaatagctcgtcctaggcgcgatgcattgaaggacaaagtaacaatgtataaaggagtatcagtgaaatctaagaagagttgatatagctagcccattagttcttttacacacttgtgctgattatctttttgaggagctctttttgttctctttttccgctttctcctacacaagtggaattcgttgtcatggccatgttgaagttttggatgttccataatagaagttgtttgaactttctgtttttggtgtaaatgaaatgaacagtgtc

SEQ ID NO: 328 - DNA, 3143 bp, Solanum lycopersicum
agacatgagaactgtttgtgtacgcagaaataatggaagaagaaaacaagcaatctcctcttataccaccattgccaagagatccaagaggttctctagaagttttcaatccttcaacctactcttcccgatcaacaaatcctgttttccgatcacaaccttcatggaaaaattggaccgccgctgatcccattaccagtagtactatccctgaaacagaggaaaaaacagagcaaatcgcaattcccaaatcgagtaacgaaaatgaacaaatcgctacttcatggatggcaattgctccggcttcaacgaaattggcttctccgattactcaaaaatcaattaccggtggtgagaaggttaattcgaaggcggcagtggatgaagttggtgctgctgctcagagagcagccgagtggggacttgtgttgaaaactgatgatgagactgggaaattgcaaggagttaaagttagaacttctggagatgatacgaatggtaaaacagaaacttctcgaagagattccggcaactctggtcggagttccggcgaattttctgatgatggagctggcaaagagaggggaattccaagagtttcagaggatttaagagatgccttatctacatttcaacaaacatttgtggtgtcggatgcaaccaaacccgattacccgattctgtatgcaagtgctggatttttcaagatgacgggttatacatcaaaggaggttataggaaggaactgtcggttcatgcagggttcgggtacggatcctgaggatgtggctacgatccgagaagcattgcaatcgggttcaacttactgtggaagattactaaattataagaaggatgggacccctttttggaatcttctcactattgcacctattaaagatgatgctggcaaagtactcaaattcattggaatgcaagttgaggtaagcaagcacacagaaggctccaaggaaaaaactgtccgacccaacggccttcctgaatcattgatacgctatgacgtgcgtcagaaggagatggctagtaattcagtgaatgagttattagaagaaataaaaaatccaagaagggcaagagcacttagtgaatcaacaaataatagaccaactttcatgagaaagtcagaaggagatcaagttgaacaagataaacaggatactcataagctaaatttagtgaacaaagcaccagcaagaagacattcacatgctggtactagaaccaccaccatgaagatggagaagattaacgaagtccccgaaaagaaacctaaaaaatctgctcgtctatctttcatggggattatgaagaaaaaacgttctagtactacaatgactactgatgatgatgattttgaggcaaggatgacaatggataatgacgatgacgatgatgatgagagtgacaacgatggacgaccagttagtgttgatgacaaagtgaggaagaaggaaatgagaaaaggtattgatttagcaacgacgcttgaacgtatcgagaagaactttgtcattactgatccaagactgcctgataatcctattatttttgcatcggatagtttcttggagctgacagagtacagccgtgaagaaatcttgggaagaaactgcaggtttcttcaaggtcctgaaactgatccagctactgtgaagaaaatcagacaggcaattgataatcaaactgatgtcactgttcagcttattaactacactaagactggcaaaaagttctggaacttgttccaccttcagcctatgcgtgatcagaagggagaggtgcagtacttcatcggagtgcaactagatggaagtcagcatgtagagccacttcaaaacagtatccctgaagacaaagcaacagagagtgcaaagctgataaaagaaactgctggaaatgttgatgaagcagttcgagagcttccagatgccaattcaaaaccagaggatttgtggagaaatcattcaaaagttgttcagccaaagcctcacaggaaggacagcccatcttggaaagcaatacaaaagatcttggagagtggagaaccgataggcttgaaacatttcaagccaattaaaccactgggatcgggcgacactggcagtgtgcatttagtggagctttgcggaacagaccagcactttgcaatgaaagcaatggataagagtataatgcttaaccgaaacaaggtgcatagagcttgtgcagaacgagaaatcctagatatgttggaccacccttttcttcccgcactttatgcatcttttcagaccaaaacccatatctgtctaataactgattactaccctggtggagagctgttcatgcttctagatagacaacaaacaaaggtgttgaaggaagatgctgcacggttctatgccgctgaagttgtagtcgccttggagtaccttcactgtcaaggtataatttatagggatctgaagcctgaaaacgtcttgcttcagagtggtgggcatgtatctttgacggattttgatctttcctgtttgacatcttgcaagccacagcttttagttccagaaatcaacgaaaagaagaaacatcaaaaaggccaacataatccaatcttcatggctgaacctatgcgtgcatcaaattcttttgttggaactgaagaatacatagctccggagatcataactggagcagggcatactagtgcagtggattggtgggctcttggcattcttttgtatgaaatgttgtatggttatacaccattcaggggaaagacaaggcagaagacattctcaaatatactacataaggatttaaaattcccaggaagcatacagtctagtctccacgcgaagcagttaatgtatagattgttgcacagagatcccaaaaacaggttaggatctcgtgaaggagcaaacgaaatcaagcagcatccgttcttccgcggtgtgaattgggcattaattcgttgcatgaaccctcccaaactagattctgctccttttttgggaactgaatctgagaaagaaggaaaagacatcaatcctgagatggaggatttacaaacaaatgttttctaaaagtttgttgcagagatgaaatatttatatcccaatcaaatcaagtgcatgagttag

SEQ ID NO: 329 - DNA, 1324 bp, Solanum lycopersicum
cttcttcttcatcactcactgtaatgcgagcttgataaaagagaaaaaaactgaatattttctcgagaaaaacccaaaaacccagatgaaaatgggttgttttgggtttgatttttctaattttcaatcgattacagtgttttttttgttattgatgcttgggttatcgttttccccaaatgggtgtcttgggattcgaagttttcctgaagaaagacggtttatagaggcgccggagtatagaaacggcgttcaatgtccggtgacggcggaaactcaagatatggttcatatagcgatgacgcttgattcagaatatctcagaggatctatggcggctgtgcactctgttctccgccattcatcttgccctgaacatatcttcttccatttcattgcggctgagtttgacccatcgagtccacgagttttaacccagttagtccgatctatcttcccgtcactcgacttcaatgtttatatattcagagaagatacagttctaaatctcatttcatcttcgatccgtcacgcacttgaaaacccattgaactacgctcggaattacctcggtgatatgcttgacccatctgtaacccgagttatctacctcgattccgatatcgtccttgtcgacgatatcgaaaagctatggaaaacccctctttccggttccagaatcatcggagcaccggaatactgccatgcaaatttcacaaaatacttcaccgattccttctggtctgacccggatttacctcaagtgttcgggtcacgaaacccatgttacttcaacaccggcgtaatggtaatggatttgcagaaatggagagaaggtaactaccggaaaaagatagagaaatggatggagttacagagacaacggcgaatctacgaactgggttccttgccgccgtttctgctagtttttggtgggctcgtcgagcccattaatcaccggtggaatcaacatgggctcggcggcgacaatgtaatgggctcatgtagatcattacatccaggcccagtaagcttgttacattggtccggtaaaggaaaaccatgggccaggcttgatgaaaaaaggccttgtccattggattatctttgggagccttatgatttgtataagcccaagcccaaatcaaggcccaattatcaaaggagtaaaatgagactttatcaatataataatttggatttttcaactagtaatattctttttggttactccaattatttcatttgattcttttttttcttttttttgacaaggttgatttaagtgattcttttaatagccttgtatatgattagttggaaa

SEQ ID NO: 330 - DNA, 1022 bp, Solanum lycopersicum
cggtgatgtcgggggaagaacggccgtcgagtttagtggtggatccgttgttgaaggatctgagtgagaagaaacagaatttccggcgaaacgtggtgtcgcttgcggcggagcttaaggaggttcgcagccgtcttgcttatcaagagcagtcttttgttcgtgaaaccctaaccagacaggaagcagagagtaaagctaagaaaatggaagaagagataaacaaattgcaagagactttggaggaaaagaatggagagcttcaattttcagctttaaacactgagaagtatgttaagcagttggatgaccttaaatcacaactctctgcgactcaagcaactgcagatgcaagtgctgcatcagctgaatctgcacagcttcagtgtttggtgcttttgaaagagctggatgagaaaaacagctcactgaaggaacatgaagttcgtgtaaataaacttggtgagcaattagatcttttgcagaaggatcttcaagcaagagaatcatcccaaaggcaattgaaagatgaagtagtgagaatcgagcatgatatcatgcaagcattagcaaaatctggtgcaaacacagattgtgaattgaggaaggtcttagatgaggtctcgccaaagaacattgagaagatgaacaagctgttgactgacaaagatgaagaacttgccaaactccggtacgaaatcaggatcatgtctgcccactggaagctaaaaaccaaagagttggaatctcagttagaaaagcatcgtagggctgatcaagagttgaaaaagaggattatgaagttggaattctgtctacaagagactcgaagtcaaactcgcaagctccaaaggatgggagaacgacgtgacaaagctattaaggaactgagagaccaattatcagttaagcaagttggaacttccagcaacaataatcagaacttctgggatacctcaggattcaaggttgtcgtttcaatgtcgatgctgatgttagtcctcttttcaaagcggtaataa

SEQ ID NO: 331 - DNA, 1888 bp, Solanum lycopersicum
ttggtaatcaatcaccagaaagtgaaagaacatggggatagaaggtgaagtaccggaatcaggaggaggaatcaggcgaagaaattgtgtgtgcacaaaagacgattttctgccggaggaatctttcaagagctggggaaattacgcgaatgcgctgaggcaaactccgacgaggttaatcgaacgggcgttgacgcgatcgaatgatgaagcagagctggaggcgaagtcacggagtcaccatgaaatgaagaagacattgacatggtgggacctaatatggtttgggatgggagcggtgattggagcaggaatcttcgtactgacggggcttgaagcgagccaggacgctggccctgctgttgtactgtcatatgcagtttccggcatctccgccttgctctctgtcttctgttacactgagtttgccgttgagatccctgttgcaggtggttcatttgcctacttgagggtggagcttggtgactttgtggccttcattgctgctggaaacatccttcttgaatatgtgattggtggtgctgcagtggctcgttcatggacctcatactttgcaactttgttgaacttcaagcctgaaaaattcctcatcacggctcatggtttagctaagggctacaaccaacttgacccaatcgctgttgcggtctgcttcatcatctgcatcattgccattcgtagtacgaaaggctcttctcgtctcaactatgttgcctcgatcattcacattgtggtgattgttttcatcatcatctgtggcctaatcaaggcagataccaagaactacaccccctttacgccatttggagttcgtggcattttcaaagcttctgcggtgttgttctttgcttatgttggttttgatgctgtttcgactatggctgaggaaactaaggatccagctcgagatatccccattggcctagttggatctatggtgatcaccactactgtgtactgtttattggctataacactctgtcttatgcagccttatcagagcattgatcctaatgctccgttttctgtggcgttcaaagtagttggatggagttgggcgcaatatattgtagctgcaggtgcgttgaaaggaatgacctcagtgttgcttgtaggcgcggttggtcaggctcgttatctcacacacattgcgcggactcacatgatgcctccgtggttttcctatgttgatgaaaaaacagggacgcccgtcaatgccacagcggtcatgatgtctgctactgcaatcatcgccttcttcacaaagctcgaaattctctccaatctcttgtcgatctccacccttttcatcttcatgctcgtggccctcgctctcctcgttcgccgttactatgtgagtggtgtgaccacaaacgcaaaccgcaacaagctaattatatgcatattgctcatcctcgggtcctcaatcgccacagctgcttactggggacttagtgagaaaggatggattggatactgcttcactgtgcctatttgggtttcagcaactgcagggatttgtattttcattcctcaggctcgtaatcctaagctttggggtgtgcctcttgtgccttggttgccatcattatcgatagctatcaacattttcctactaggctcgatagataaagattcgttcatcagatttgctggctggacaggttttcttttggcgtattacttctttttcgggctgcatgcttcttatgacacagcaaaggaatttgaaaagagcaaagggtggaagaacaatattgaagaaggaaagggtacttctaatgtggttgttagcaaagatgttcctattgctcctggtaactgaattagttgtgtctaaatgatagcacaatgttacgttcctagc

SEQ ID NO: 332 - DNA, 2191 bp, Solanum lycopersicum
ctggtgaatttgttgttgaaagtagcttaaatggctccaagattgaatttttctgactggtggggtaaagataaagaaaggggaacaccagttatagtgaaaatggagaaccccaatttctccattgttgaaattgatggtcctgatgctgcatttaagcctatagagaagagtagaggcaaaaatgctaaacaagtgacatgggttttgttgcttaaggctaaccaagctgttggttgtgttgcttggttagcaacaattttgtggggtttaattggtactatcaagaataggttgattttgagaaaaggggtttctgttgcaagtgaaaaacttggaaagagtaatctactttttagaataatcaaagtttgtttgggggtttctttggttatgttagcttttgaagtgattgcttactttaaaggttggcattattttcagaatccaaatttgtatataccacatacttctgatgttttggggttgtttcacattatatatgttgcttggttggattttcgtgctgattatattgcgccttcagttcaaaaactctccacattttgtactgttttattcctaattcagtcgttagatcgtttagtactttgtttgggttgcttttatatcaagtgcaagaagattaagccaaggattgaaggggatccatttaaatcagatgatcttgagggatcaaacaatggttactaccctatggttcttgtgcagattcctatgtgtaatgaaagagaggtatatgagatgtctatatcagcagtttgccaacttgattggccaaaagaccgtttgttgattcaaattcttgatgattctgacaatgagtgcatccaagagttaataaagtcagaggtcgcgaaatggaaccaaaagggtgtcaacataatttacaggcaccgtctggttagaactggttacaaagcagggaacttgaagtccgcaatgagttgtgactatgtgaaggattatgaatttgttgcaatctttgatgcagactttcaaccaactccagattttcttaagcaaacagtcccgcattttaaggacaaccccgagttaggattggttcaaacaagatgggcatttgttaacaaggatgagaacttgctgactcgtctacaaaacattaatctgtgttttcattttgaggtggaacaacaggtgaatggggtattcttgaacttctttggtttcaacggaactgctggtatttggagaatcaaagctttggaagagtctggaggttggcttgagaggacaactgtggaggacatggatattgctgttcgtgcacatctcaatggttggaagttcatatatcttaatgatgtgcgggtcctgtgtgaagttcctgaatcttttgaagcttataggaagcaacaacatcgatggcattcgggccccatgcaacttttccgagtgtgtcttccggctattgtttcttccaagatatcaatatggaagaaagccaacctcatacttcttttctttttgttgagaaagctcattcttcccttctattcgttcacattgttttgtgtagttcttcctctaaccatgttcatcccggaagccaagctccctttctgggttgtttgctacattccaattcttatgacacttctaaacattcttccagcaccaaaatccattcctttcatcgccccctacctccttttcgaaaacactatgtcagtgacaaagttcaatgctatggtatctggacttttccaattgggaagttcgtacgagtgggttgttaccaaaaaggcaggaaggtcttctgaacctgacctactggctgctgctgaaaaagatttgaaagcatttggagcaccacagattagcagaggggcttcggaaagtgaactttctgagctgaatcgattgaacaaacagaaggatgaaacttctacacctgtcaagaagagcaataaaatatacagaaaagaactagctctttctttcttactcttaacggcgtcagctagaagccttttatctgcccatggactccacttttacttccttcttttccaaggagtgacattcctcctcgttggtcttgatcttatcggagagcagattagttaatattgctcaagagaagagaaagaacaacttacatattgtatgtcaagaactgatccacttcctctcatctgaactt

SEQ ID NO: 333 - DNA, 1035 bp, Solanum lycopersicum
tcaactctagtcactgctgctgctgccatggctactcatagcaatttgaagaatgctttgattgcctttcttgctccacttccctctttacttttctatctatctttccttcgccattatcatgaagatcatccaatctacaattggtgttaccaccaccctcttctgtttgctaatgtcttgtttttcttcaatgtcaatatcctcttctatgccattagttacatccaatctagtcactggatgatagatttgttctggactgtgattccagtaatgctagtgcatttctatgcaaatcatccattggcacagtataatgtgtggaggtctaaggtggttatacttttaacttggatttggagtataagacttactcataactacttccgtcgcgagaattggcaatggggacacaggcaagattggagatttacagatatgagccaccagtatggcaagaactggtggtggatatctttcttttttgtttatttctctcagcagatttttctgattggtatatgcctgcctatgtatgttgtccactctgaagacaagccatggaatatctgggatttcattgctgtattcatctgcttgtctgccattataattgcttattatgcagatacagagctctacaattttgtgagcagaaaccagaaactaaaagagctcggcaagccaatggttcccaatcttgatgaaggcctctggaggtattcacgacatccaaactattttggagagcagttatggtggtggggactcgtcctatttgcctggaacttgggtcagacttggacttttgttggtgcactcgctaatagcttgtgtcttgcacatgtcactgtgcttgttgagaataggatgcttaagcaagcctacagagctgaagcatacaaactctaccaaaggacaacatctgtgtggataccatggttcaagtcatccgcaaaagggaaagataaggaaacttgagtctattttcaatctctttggtgtcttcctttgttaaatgtcgacgattag

SEQ ID NO: 334 - DNA, 505 bp, Solanum lycopersicum
tgttaccagttcagtagaaaccacaagtatcaataatggattttatcatccttctcatcgccatccttgctctttctagcacaccaattaccattatatccggatctgtgacaaaccatacatattcaactacaaactcttacaccaacgttgctctttctgcacgaaaagttgtatttcctcctcccagacagctaggaaaagataattctgatgacgatgacttgatctgcaaaacttgcaagagattatcagaacaccgtacatgttgtttcaactacttttgtgttgatttgttcaccaacaggttcaactgtggctcctgtggcctcgtctgtatcgttggaacaagatgctgcggtgggatctgtgtggacatcaagaaagacaacggaaattgtggcaagtgtaacaatgtatgctctcctggtcagaactgctcatttggcctttgtgtcagtgcctaatttaatgtatttctctatctgtaccaataaccaattcc

SEQ ID NO: 335 - DNA, 919 bp, Solanum lycopersicum
aatatttaacaacgaaagttgatcgatacaagtaatcatggaagatctaccagggttccgatttcacccaacggaagaagaacttcttgaattttacctcaaaaataaaatccttggcagaacatcgcgatgtgatgtaattggtctactgaacatttatcgtcatgatccttgggacctgccagggctttcgacgattggagaaagagaatggtatttttttgtggcaagagatagaaaacatggaaatggaggtaggcctaataggactacagaaaagggattttggaaggcaactggttctgataaaaagatcattggtttatcaaatcctaaaaatataattggtcttaagaagactttggttttttatactggaagagcacctcgtggctctaagacagattgggtcatgaatgaatttcgattaccagataccgtctcgtggcctcaggacattgtgttgtgcaaaatatacagaaaagcgacatctttgaaggtgttagaacagagggctgcaattgaagaagaaatgaagcacgtacacagctctccttgttcaacaaccctgcagacaatggacgccatgtcatttggtaatgaacatcatgaactgactgataagagccccgatttgtttacgtcaatcagcaaggatgaagtagatgatgataggttatcagtagctgagaacaaagtttcagctgaaaccaaagagaagagtaattgctttaggccaaaattattaaatggacaagatagcctggctgaactgcaagtacccaaattcagcatggactttagtcaggaccctgtgtggatgcaattgcgtagcccttggctggataattttatcttgacaccttccgcgtttgtgcataacttttaggttaagaaaccatccatctcaatttcttag

SEQ ID NO: 336 - DNA, 742 bp, Solanum lycopersicum
ccattcttcaccaactgactcaaagaatttacttccattccatggccaaactaatactccaaatcttcaccatttccctcttcctttctctggtggcctttcgcgccaccggagaagaagataattatatttttggaaaatccataaacaaaaaacccacaaggttaagaaaggaaaaaatcagtcattttcgatttttttggcatgatattttaagtggttcaaaaccaacatcaatgatgattattccaccacctaaaaacacaacaacaggttttggacaaatgaatatgatagataatgccttaaccttaggaccaaaactaagttccaagattgttggtagggcacaagggttttatggtgctgcttcacttaatgatgttggattaatgatggttatgaattttgcttttattgaagggaaatataatggaagtacttttactatacttggtcggaatccggtgttcgagaaggtgagagagatggcggtgatcggagggagtgggcttttccgatttgctagaggatatgttcaagctagtactcattcatgggatttcaaaactggagatgctactgttcagtatgatgcttatgtctttgcattattgaggtttactaattttatatattttcatcgtgtcaatttatgcgacctagtttacacgaaatttaagaagtataagaatatattttgtattattgcgttccaaaattattcataaaaagggtagac

SEQ ID NO: 337 - DNA, 1511 bp, Solanum lycopersicum
gttgcatggccaataaagttttttgtccgaaactccttaagaacctcggatttcatgtccgccgtttaaactcagctccgtcacctctttccgccgtcccaccgctaaattttactggcgattttaacgccgtggaacccgcacaacaaattaacacaacccttcaccaccaccacgaccatcacaacattatcaatttcgatgatgttaaggagcttttctacggtgttcccaccacgaaactgattcgatcttcgatgacgttacaaatggctgctattgatccgatggttgatttgggcatgtgggtaatgaattctaaacttatggaaatgcctatttttagggaggttattcttgggtttgttaaaaatacattttatgaacatttttgcgccggcaaagacttaacggaagctagacggaccgttactaatctatcggattctgggttaaaagccatgcttgattatggggtggaacatgccaccgataatgaatcttgtgaacagagtactgcggcgtttattcaaacgattgaatcaaccaaatcacttcccgaatcttctgcaagttttgtggtagcaaagataactgctatttgtaccccaaggcttctcaaaagaatgagtgatttgttaagatgggaacagaaagatccatcatttaatcttccatggaagcgagagtcgcttccccttttcgccgaatcgagccctgtttatcacacttgtagcaaaccagagcctctatcggtagaggaagagcgtgatcttcaattagctcatgaaagacttagaaaaatttgcgagaaatgtttggaacatgaagttccattactaattgatgcggaagacacaaccattcaacctgcaattgattattttgcgtattcagcagcaattaagtatcacaaagatgatcagcctttgatattcggaacaattcaagcttacttgaaggacgccaaggaacgaatggttattgcgaaaaaggctgcagagaaaatgggagttccaatgggatttaagcttgtgaggggcgcttatatgtgtagtgaaaaggaattggcttctacattaggattcaactctccaattcacgacagcattgagcaaacacacgcttgcttcaattcgtgcgcggagtttatgattgaagagattgctaatggttctggtgcagttgttctcgccactcataacattgaatcaggaaaacttgctgcaaccaaagctatagatttgggaataaaaaatgagagacaaaatctccaatttgctcagctatatggtatggcagatgggctttcatttgggctgagaaatgcaggatttcaagtaagcaaatatttaccatttggtcctgtagagcagattatgcattaccttatgaggcgtgctgaagaaaacagaggcatgctgtctacatcggcattcgacagacaactcatgaggaaggaattgagcaggagattcgaagtggctacttcttaaattcatattcagtaa

SEQ ID NO: 338 - DNA, 1855 bp, Solanum lycopersicum
aacgccataactctgaattctcccaaaaaccaaacaaagcttttagggttttcgtagaaaggatatgaaggatcagaatttggacctattcgacccgagaacggcggtcatggacccggaatactcccctactcataccggggaacccgatttcgcctttgccttcgacgacgtcaacttctccgatcgtattctacggatcgagatccttggagattcaattgccggtggttctagttccgacggcggctgcagtagcttagccgattgggctcgtaatcgcaagcgccgacgtgaggatttcaggaaggaaaacgctttggatatcacagcatgccctgaagatcagataatttgctgtaatcaaattgatagtgaagatgctgataacgagaatcaggatgaagcagttgttgcaatgattgaagagacaaactcaggagatgatgctgctaatagtgatgattcaacttggaattgtgattctccaagggttatgagagttaaaacactaaacattagctcccccattttagcagcaaagagtccattcttctacaagctcttctcaaatgggatgagagagtctgagcaaagacaagtaactctacggatcaatgcttcagaggaagctgcattgacggagctcctgaaatttatgtatagaaatatgttgactacaaatacagcgcctgggttgcttgacgtgctcatggctgctgacaagtttgaggttgcatcttgcatgaagtattgcagcaggctactgtgtaatttgcctatgactccggagtcagccttgctgtatctggagcttccttctagtgtcctgatggctgatgcagttcggccattgactgatgcagcaaaacaattcctagctgcaagatacaaagatataaccaaattccaagaagaggtcatgaaattgcctcttgctggtattgaggcaattttgtccagtgatgaccttcaggtagcatcagaagatgcagtatatgactttgtcttgaaatggacaagggctcattatcccttgatagaggatcgccgagaaattcttagttcaagacttggtcgctgcatccggtttcctttcatgagctgccggaaacttaggaaggttcttacatgtaatgactttgaacatgagtttgcatccaaactagtgcttgaggccctgttttttaaagctgaggccccacaccgccaacgaactcaagctgcagaagaatcagcttcgaccagtcgtcgttttgtagagcgtgcatacaagtatcggcctgttaaggtggttgagtttgaacttccacgccaacaatgtatagtctacttagatcttaagcgggaagaatgtgctaatctttttccatctgggagagtatattctcaagcttttcatttgggtggacaagggtttttcctgtccgcacattgcaacatggatcagcaaagctctttccattgttttggtctctttttgggaatgcaggaaaagggttcagtttcatttacagtcgattatgaatttgctgcgaggacaacactagcagaggagtatgtcagcaaatacaagggaaactatacatttactgggggtaaggcagttggctatcgcaatttattcgccataccgtggacttctttcatggctgaggacagtctctattttattaaaggcgtactccatctcagggctgaacttactatcaggcactgatttttctctcctacgatttcaattactactgttgttttgcttattagctgagcctcccgattcccgatcttttttcttggcttttgatcaagcaaaaagaagtgtaacgtgtaggtgtcggtactaactgctgta

SEQ ID NO: 339 - DNA, 1157 bp, Solanum lycopersicum
aagtacggccaatgggagactcgagcggctccgtttcggtggatatggaaacaatctccgtcaccggaaaggagcaccttgtaaaaactggccgtggttatgtctctgttgccgtttttggggaccaggacaagccggctcttatcacctaccctgatttagctttaaattatatgtcctgtttccaaggattattctattgtccagaagcattttcattgctgctccataacttctgtatttaccacataagtcctcctggtcatgagttgggagctgctgtcatgagtcttgatgatcctgtcttatcggttgatgatttagcagaccagattgtggaggtgcttgattactttaggcttggtaaagtaatgtgtatgggtgtaacagctggagcatatattcttaccttgtttgcggtaaaatacacacaaagggttatgggtttgatactcgtttcccccttgtgcaaagcaccctcttggacagaatggttgtgtaataaggtgatgacaaatctgctttactattgtggcatgtgtacgttggtgaaggagttactgctgttgcggtactttagcaaggaagtccgcggcagtgttgaagttccagaatctgatgtagttcaagcatgccgaagattgctaggtgagagacagagtccaaatgtattgcggttgctcgaagctatgaatgagagaccagacataacccaaggcttgcggaaactaaaatgtcgttctttaatatttgttggagagagctctccttttcattctgaggctctccatatgacatcaaagttagatagaaggttgagcgcgctagttgaggttcaagcatgtggttcaatggtgactgaagagcagccagaggcaatgttggtcccactggaatactttctaatgggatttggattttatcgaccgtctcagtgcaatgtcagcccaagaagccctttaagtccaaccagcatttctccggagcttttctcgccagaaagtatgggtttgaagttaaaaccaattaaaactagattttctgaagaagtatgagtctgggcttaaagttaaaataagtttttgtaaaatttgtaacaagttccactttgattgaagacagttaggaatgtgaagttatagaggaagagggagggt

SEQ ID NO: 340 - DNA, 1598 bp, Solanum lycopersicum
cagaagaaccgagtggataaacatagaaacttttctccctttttctcttcaacccaaatctcgatctacaattagttttcatttttcttcgtgtttaatcaatcaaatttattttcgatgtgttaattgatgtctgattgttaaatttctggatcgggatcgaacgaacctcgatcaatctgttcccttttgtgttcaaggtcatttggttggggtaaaacatgtctcatcaacaagaggatgatgctgattacatggcaaacgagtatgacatggaagctatggatgatgatatggatgacgagttccatggccgagatgttggtggctctgattcagatgcagatgattatgacttcacgaataataaaatgcaagatacctctgctgctgaggcaagaagaggtagagacatccaagggattccatgggaaaggcttagcataaccagggagaaatacagacaaacgagattagagcagtataagaactatgaaaatattcctcaatctggggaggcctcagagaaggactgcttagccacgaagaaagaagtttcatactatgacttcagacgtaattcaagatctgttaaatcaacaattttacatttccagctgaggaatttggtctgggcaacctccaagcatgacgtgtaccttatgtcacatttttccgtcattcactggtcatccttgacctgcagcaaaagtgaagttctgaatgtatcagggcatgtagcaccatgcgagaaacatcctgggagccttttggaaggatttacacaaactcaagtcagtactcttacagtgaaagacaagttgctagttgctgggggatttcaaggagaactaatttgcaagtatgtagacaggcctggagtttgcttctgttcccggacaacatatgacgataatgctattactaatgctgttgagatttataacacctccagtggtgcacttcattttattgcttcgaataatgattctggagttagagactttgatatggagaagtttcaactgtccaagcatttccgttttccatggccagtgaatcatgcatcactgagccccgatggcaagcttattgcaatagttggggataatcctgaaggtttattggttgattccaggaacgcaaaggttgtttcacctttgagcggacatattgactactcatttgcgtcagcatggcatcctgatggcctaacttttgcaactggcaaccaggataaaacctgcagagtatgggatatacggaacctgtctaaatcagttgttgctctgaagggtaaccttggagctattcggtcaatccgctacacatctgatggaagattcatggcaatggcagaacctgcagatttcgttcatgttttcgatgtaaaaaatggctacgagcaggagcaagaaattgatttctttggtgagatatcaggtctgtcttttagtcctgatacagagtccctttttgtcggagtctgggatcgcacatatggtagccttcttgagtttggacggcggcacaactactcataccttgatacaattatgtaaacactctcttgaatgctgctttgggtatgtttactt

SEQ ID NO: 341 - DNA, 2347 bp, Solanum lycopersicum
ccgtgccctagttgtgtatactggtcccatagatctctctttcccccaataaatttgcagtttgccttgtttttcgctgttcatcagattctcctctcctctttgcttggtgaaagttggaaaccgcaattattgcattaaaatagtcaaccttacaggattttttattcaaattcgatttatcgattgctcttttttcgcataattatcctccattgttgtgcacaatttgtctgcgaaaagctgatcattttgaatcatgtaattagggttttcaggaaaaaaattcagtttctcagaagcttcctccatcacgatttcattatagataagttgaatttttttttacctttgatttatttttgctcagaaagtgcatacccagaagctgaaatctcgtaaattaatgattctggttcagattttgttgtatgtatcttttgtattgtaatctagttgcaaaattgtgtatcttgtgagcgaggtgtgtgtgcaagctggctcggacaccatggttattaaaaacaaagaaaattgtgtgtcttgtggttagtgttgtaggaatttttgtatatgattagttaataattagaaatatgaagcatcagaagaagaaaaagagatcaaaagcttgtaaaaaagttggggttggtaatggttcgttgccatctgggaatagtaatgatggaggggagagtgttgtgacggcgttaacggaggcatttacctctgtatctatggaggaagcaacatgtgcttatgaagaggcaaatggggatttgaataaagcaatggagattctgggtgatatggtggagcgtaaggaagaggataagatcactacttgttcaagctcgagtggaaacgttggttcaagcttggattcgagtaactcagaggtgtttgttgggggtcattcctggcagaattcagttcagcgcaaggctaaggtgaagaaattggtggctgctactggaacagtatcgacgatgatagggaaggattatgtgagaacaactacaaagaagagttgttcaaagctcaaggggttacatgatgaaacatcgagcaacgaagatgttgagcagtttttgtattccatgcttggggaagattctgatttgagcttagctgtcgtcagagatgtgttatgtcaatgcggatatgaagttgagaaggctctgagtgtgttgcttgaattatcagcttcctctaatgagaaacctaagcttagcgactgtagtgcaaactggaaagaagaggctgtgtttcttcattcaagtgatggtcttactgactggacatctgattctacttctcattcatctgaaagcgaagttctagataatgtgtggttttatgggcctcctggcaggaattcgttaaaagttcctgctggaaactctgaacattcttcatcatctacagtaggaaattctggatcagtacttcctcaagatattctggaatctttgttctgtatgccaacccccaagagtgttgaacatgaaccaactactatgaactggaagaatgtagtaaagaaaatgacatctttgggacaaagatctggatcttgtcctaatgatattccaccactgcagcatactcatgctgagggagctgagtatcagctgttcagggaaactgcaaagcaacattgggagtcaatgagatcccattatcagaaggctgcaacagctttttcaaatggccaaaagggacatgctgcttatcttgcggatcagggtaggctacacaacagaaaggctcgagaagctgatgcaaaggctagccaggatatatttgcagctagaaacaagaacatagaaaatatgataactattgacttgcatggccaacatgtcaaaccagcaatgaggcttttgaaactgcaccttctgtttggagcatttgtacgctctgttaggttgttcagagttatcacgggatgtggggcacatggcgttgggaagtcgaagctgaaaaactcggtagttgaacttttgaagaaagaacatattgaatggaccgaggagaatagaggaacattgcttatcaagctcgatggacgaatgaattttagctttgtagatactgatgataatgatgaagatgataactgattatcccttagccatggttgctagcagttgggcaccgcggattttagcattaacagtggcagtaaatgtaattaacatcactatattatcttgatgctaggtggtataacaacctagattgtgatattttacgacatttacatttttcttttgttagtgtgagaattgtaaattgtgtatcctagctctgagcattatgcagcgttatagctaagctcatg

SEQ ID NO: 342 - DNA, 1300 bp, Solanum lycopersicum
ttaatgtctccactctttctggacccccttttgaaaagtgataagattcttgtgcctaacaaaacactctgcatttgcagcttttgctgacccaaaaaagaaaatctctcaaagaaaaaacatgactgaagtaaaaaaagatgaagaaaatcatcaccagcatctttgtgatttttgtggaaacaacacagcacttttgtattgcagagcagattcagctaagctctgttttacctgtgaccgtgaagttcattcaacgaatcagcttttcactaaacacactcgttggttgctctgtaatctttgtgattcttctccagcttctatactctgctgtacagagacctctgttttgtgtcagaattgtgattgggaatctcataacaaactattgtctctacatgaaagaagaccactcgaggggtttaccgggtgtccttctgtttctgagctgttgtcgattcttggatttgaagatttggggaagaaggaacttttgtgtggcggggatgatggagcttatggtttctctgattgggttatttgggatgctccgtctgttgttactcttgatgatttgattgctaataataatgagtctcgacataattatcaagctattggggttcctcctctaccgaagaaccgaaatgctgcttgtggaaaacacaaggaagaaatacttggtcagcttcgcgaattatcaaagttggaaccaaattctggtgatgatcaagatgaaaatgtaccaactacaggatttcaatctatggaacctgtccaaaattgtccgttgagatataaaggttcgggatttatgcagaggtcagatcaacatgtagttccttcatctgaggggagtgcctttcattggcacggtgatactggtgaattcgtagatcaaggcttttcttcttctttaacggactgcttcattgagacaaagtgcttactacccgacagagattcagatgtttgtgatgcttctggtggaggaaatgaagaacaatctcatcatcctacgactactgaaacatttcaaatggtacctaaagtcgttcatcgcgagttgaacagccaagaaagagaaactgctgtgtcacggtacaaggagaagaagaaaacaaggagatatgagaagcatatcaggtacgagtcaaggaaggctcgtgcagaaactagaacacgaatcaagggacgttttgccaagatggattacagggattcctccgtgcatcagtaatgtcaaacgttgtttgtttttctccgaatccaggacattctgcttgaagatcattag

SEQ ID NO: 343 - DNA, 1801 bp, Solanum lycopersicum
atacatctgcacgtttctgttcccggtaacccattcttttcactaaatccatctcctctcctctccaatctttacccattcttttttcgtcgaaatacttacaaaaagttcgttgtagatattcatttctgaaaactaaaaggagtcattttgatggatcatagtacggggaaaccgggtttttttaggaatgttttggtacgtttatgcctgttttgtgttgtgattgtctgttgtcggtttgcttatgtggtgactctcaaaggggaaacttgtgacctcggcgatttctgtttcttctctttaccggaaaatgtcaatgttattgccggcgtcggaaagctcactgagtctgtatcagcggtgatgactaccgagaatgccgtaaaatctgctcccgcgaagcccaaacttcccgatctatgggcaaacaaggagtttcaaaaatcagcccagttttactcttcggtgtttgaggatcttgttgcagagggttttttgagcccaaattcaaaaactctttgcgttgaaacaccgatgggttctgatgtttttgcgttgagggaaattggggtagccgattccgttgggatttacaagaaaggttcaaagcctttagtgattacaggcaaagctgttaaacaaccctttgaagatgatacgtttgatttaatattttccggtgccggaatgatagacaagtcacttaagccgggagatttcgcggcggagatttgccggactctaaaacccgaagggtatttagttgtccatacaggttctaatgatacatacagtttcaattcattccttcatttgttcaattgttgtacattaattaagtctaggaatattgatggttttgattcgactattcgtgagatcatcatgaaaaaggatatatttgttgaagaaaaagtgagtgattccaagaacaattgtggtcatgttcctgattataaaatgaaactgattagaaaagctgagcctttgattaaagaggaacctaagaaaccatggattacacttaagaagaatgcacagagcattaagtacttgtcatccatggcggatattagttttaagcagagatacgtgtatgttgatgttggttcgaggagttatggttcaagcattgttagttggttcaagaaacagtatcctaagcaaaacaagacctttgatatatatgctgttgaggctgacaagacattccatgggcagtataaggagaagaaaggggttacattgttgccatatgcagcttgggttaggaatgagacattatcgtttgagattaatcaagatccgggtcataaagatgtgtcgaaaggaagaggaatgggaagaattcaacctgttgaatcttctagtgaaggtgcaagtgaggtggatttaatccaaggttttgactttgccgagtggttgatgagcgcggtatcagagaaggattacgtggtgatgaagatggatgttgaagggaccgaatttgatttgatcccgagattgattgaaacgggggcgatatgcttgattgatgaagtatttcttgagtgccattacaataggtggcagaaatgctgccctggggagaggtcttcaaagtatccgaatacgtatagccagtgtttggatctcttcacttctctaagagaaagtggagttcttgttcatcaatggtggtaatacagtctagctctttagtcttttttgttatacaagaggccaaaaaattctctcttttacttcatatgtatctactgtttgccccaatataaagaattacgttcaatgtgtttgc

SEQ ID NO: 344 - DNA, 1562 bp, Solanum lycopersicum
gatccaacacttgtgtaattgtgttatttatctaaaaacatgactgttgaggtgcaatgtgaggcaactcaagtggctgaagtagttgttccacaagaggaattagtggctgctaacaaggttgtggaggaggttgaggtgaatgagaaggtaaaagaagatgaagaagaggaatccaagcctaatacaattgagaaaagctcttcttatagagaagagagcaacttcctctctgatctcaaagagaatgagaagaaggcattgaatgagttgaaatctatagttgaggaggccattgttgggaacactctattcaaaaaagaagagaccaacaagtctctagaggaagagggaaagaatgaggaaaatcccgatgcgaatatagaggagaaggagggtgatttggatgttgttgaagtggatagagagatttctatttggggtgtacccattttgcctagcaaaggggatgagaaaaccaatgtggttcttttgaaattcttgagagcaagggattacaaagtgaatgaatctttcgaaatgctcaagaaaacactccagtggaggaaggattttaatatccaatccatcttggaggaagatttgggctcagatcttgcaccagctgcttacatgagtggggttgataaccaaggacaccctatttgttacaacattttcggcgttttggaagatgaagagatttataacaaaacgttcgggacagaggagaaacggaatcagttcttgaggtggagagttcagttaatggagaagggcattcagcagcttgatttcaaagctggaggtgttagttcactgcttcagataaatgatctgaagaactcgcctggaccgtctaagaaagaagtcagggttgcaaccaaacaagccgttgatcttcttcaggataactatcctgaatttgttgccaaaaatatattcatcaatgttccattttggtattacgccgtgcactctctgctgtcgcctttcctaacacaaagaaccaaaagcaaattcgtatttgctcgccctgctaaggtcactgagaccttgctcaagtacattccaatccatgaaatccctattcaatatggtggactcaagagggagaatgactttgagttttcagcctccgactgtgaagcttcggagattctccttaaagctggatcaactgaaactattgaaatacctgcagtagatgtggaaagtacatttatctgggatgttacgattgtgggcggagaagtgagctataaagaggaatttgtgccagaggatgagacttcttacactataatcattcagaaggacaagaaggtgagctcgacaattcgcaacacgttcaagaacactgaagcaggaaaggttgtgctgacaatcaagaacacttctagcaagaagaagaaggcgttttatcgacacaagatcaccaaatcaacaatttgagatgagcaagtttctattttgagtgaagatggagttctttttctctgtttttaagaatatgtataatgtagtaacctttttgtggtggttcatatacttgattattt

SEQ ID NO: 345 - DNA, 750 bp, Solanum lycopersicum
cgctttacttgctccctgaacttacgcagcatagccatggcagaaactgaacctgaagtcgccgccgccgtgcccgccgttgaagccgtggtagaggccgagaaagaggacacttcggctcaggacatggatgtcgaagctcaagccgccgatgatacggaagagaacggcgggtcgaagcgtccaagggaggaggaaaacgaggtggagaaggaagacgccacaaagaagctgaaggtcgataagtctgtggaagaagaacgattcgagaatttagatggaagcaaaacggtggatgaagaaaagaaagatgtgtcaggtccgattagcgtgggccctaagaacttcggatcgtctgtggaggtgttcaattacttttataagcttctccattcttggtctcccaacctcaacctcaacaagtatgagtacattgttttgcttgacttgctaaagaagggtcatttagagccagatagaaagattggtacaggagtccgtgcattccaaatccggtttcatcctcaatataaaagtcgttgcttctttatcattagggaggatgactctgtggatgattttagcttcaggaaatgtattgatcacattagtcctctcccagagaacatgcaagtaaaacacgaggcaaacagagacttggcacgtggtggaaaaggaggtgggcgtggccgtggaagaggagggaagccaagatactgaaggcagctgcatgttctgtcaattgtttag

SEQ ID NO: 346 - DNA, 1024 bp, Solanum lycopersicum
agatagtccatctcattggcagtatttaccatgaataacgataccccaagcatgattcatgatccattgattgattccacaggagatggaggctatgcattgagtggaaaaattatgctaagtgctattgttatcttattcactgttgttgttttcatggtgggtcttcatttatatgctcgttggtaccttgtgtctcagcgccgccgtgaactccttcgccgccgtagggtcaaccatcgacggactcatattgttttctacgttgataatcctggttccggtttgtctgatgctaaccggggtttggaacaggcggttctcagttccttgccggtttttgtttattccgacaagactcacccggaaccgctggaatgtgctgtttgtttatcggaatttgaggagaatgaaaagggtcgggttttacccaagtgtaatcactcttttcattcggaatgtattgatatgtggtttcattctcattctacgtgccctctttgtcgctctccggtggaggcagtacttatcgaaccggatattaaccgggttgaggtggcggtaacagtgaacgaaccgggttcgagttcgggttgtgaggagaatagtagtcatcattctaatatgacgccgttgggttgccggcgaaaaggattggatctgaccggagtaagaatagaggtaccaagaaggaacgatttcgaagccgatttggaaatgggagtgagagtaagttcaccggcgattcaatcgagatcaccagcgactcgtttaatgtctttgagaagaatcctaagtatgaacagaaaaacacccaccggaactagccattctcctagtggaagttgcgccgcggattttgatatagaaaccggcggtagtagtggtggtggaaaaattcaagtcggcggcgaacgcatcacaacaccgtgagttaaaaatgcgggcacacatccctaggcaaaagctgaaaaatattgagtcacgccgattgcgtgaaaacaggagaaacagtgacttgact

SEQ ID NO: 347 - DNA, 1699 bp, Solanum lycopersicum
acaggcccaaagtctctatgcgttcacaccacattttatcccatatatatgaatgaaccttgtttcccagaagaaaattcttcaatttcttatatcatgaatcatctacccaataaacgccgtagaaggaggaaagaaatcgcacaacaaaccccaactaatagtagtgcaggtggtggtggtaatgatgaatttgggtcggaaaatcaaggggctgtcaaaacgaaggagttgaaacagatattaacctctttgttgttacttgaagagcaagaaaaatcggaatttgcaaaggaagaggaagaggataaacacttactcgaagccaatcataagaaaacaacgaaagtgatgtgggattattattccaatgttcaacagcatcattcggatttagaacagttagatggtgttcgaaagaggaaagggagagggaattctgctgctcttactgctactgcttgtgcccttgcttctgcagctgcagaggaagaaggggtttccagtaataaatctaccgataaaggtgcgcctcataggcgattgtgggtgaagaataggtcaaaagcttggtgggatcaatgtaacagtcctgatttccctgaagaggagtttaagaaagcgtttcggatggggaaagatacatttgaattgatatgtaatgaattgacttctgtggttgcgaaagagaatactatgctaagagatgctgtacctgtgaagcagcgtgttgctgtttgtatatggagattggctactggagagcctctgagattggtatccaagagatttggattggggatttcgacttgccataagcttgtgctagaggtttgtactgcgattcgaactgtgttgatgcctaagtatcttcaatggcctgatgagaagaaaatgagggatataaaggatgagtatgaggatatgtcagggatcacaaatgttgtgggatcaatgtatacaactcatatacctataattgctccgaaaattagcgttgcagcttatttcaataagaggcatacagagaggaatcagaagacttcgtattcgattacagttcaaggggttgttgatccaagaggggtgtttactgatgtgtgtatcggttggcctggttcgatgcctgatgatcaggtactggagaaatccgcccttttccagagggcgaatacagggttactgaacaacgtttggattgttggtagttctggataccctttaatggattgggttttagtgccttatacacagcagcagctaacttggactcaacatgctttcaatgagaagattggtgaggttcaacgggtggcaaaggaggcgtttgtaaggttgaaaaggagatggtcttgtttgcagaaaagaacagaggtgaaactacaagatttgccagtggtgctaggggcgtgctgcgtcttgcataatatttgccagatgaggaatgaggagatggatccagaactcaatttcgagctcattgatgatgaaatgcttccagagattcaattgagatcgaccaatgctaggcttgcaagggatgctattgctcataatcttctacaccataaccatgctggtacttctctcctttaatacaatcaaaggagggaaaactttgattcatgtaattctttcaagttattacttatattttcacatttgtttttcttaagttaagttagtgtgcaaacggatg

SEQ ID NO: 348 - DNA, 1356 bp, Solanum lycopersicum
cactatctctcgaagcaacctctaaattaaactttcattctctattaaataataattcattccctttttcttcatcatctacatcaaatctgcttcaatggagcctccaaatccccagcaattccagcaatttctcagcagtgttctgtctcagcgtggtccagctgcacttccttatgctgaagatgtgaaatggctgattcgtcaacatctcctttctttaatcgatatgtatccttcacttcagccgaaaactgcttcatttactcataatgatggaaggactgtgaatctattgcaagctgtaggtactgttccgatggtttatctagatcgtacgtataatattccggtgattatttggttgatggaatcttacccacgtcatccgccgttggtttttgtgaatccgactagggatatggttattaagaaacctcatccgtttgtgaatccatctgggattgtgtcgattccgtatttgcagaattggatataccctagttcgaatcttgttgaattggttcgtaatttgagtcatttttttggaagggatcctccgctttatgccaaagtacaagcacatccatcaaaccctaaccctagtcctaggcctacccctacccctaaccctcatcctccgccaagtacgagttttcctaatcacagctcgccagtcgggtcatatgggattcggcctgcgatacctcctcggccagttcaacaaccaccttatggtgcagtgaaacatgatgatccggaggaggtttttaagcggaacgcgacagataagctgcttgttgacttgcataatgatatagttgggttgaggaatgcacaggagaaggatatggatgggttgtttaatgctcagggagtgttgaagcagcgggaggagcagttgaaacaagggttaaaggaaatgcaggatgagaaagaggggttggagcagcaattacagatggttttgatgaatagtgatgtattagagggatggctgagggagaatgaggggaaagcgaccaatttagggaatgtggatgtggatacggcctttgagccgtgtgatagtctttccaagcagatgctggattgcacggcatcagatttggcgttagaggatgtgatttattcgttggacaaagctatacaaggcggggcaataccatttgaccagtacttgaggaacatcaggttgttgtcccgcgaacaattctttcatcgtgctacagcatcaaaagttagggctgctcagatgcaggctcaagttgctaatatggctgctagaacatcacaatatgcattgtgatagacatctgatcacttgcaggtgtgtttgcaatagactgaaggtca

SEQ ID NO: 349 - DNA, 1011 bp, Solanum lycopersicum
gttgcagatttgtacgttcgtggcatgtttctgcatatattgattggctttagctgaaattttcctagtctgcttacatcatcatggcttcactggatatgaccctggatgatatgataaaaagtcggagaaatactgagaggggtggtaggggtcaaggcagggcccgacgcggaagaggggcagggggttcatttagaggtggatcatttagaggtggaaggacaacaggggctcctcgtagagggccacttggcgtgaatgctcggccatcagcctacaccattgccaagactttccgcagaaccaagaatttgccatggcagaatggtttgtttgaagatagccttagagctgcaggactgtcatcagtattggagagtggcacaaagttatatgtttctaatttagacgttggagtgactaatgaagatataagggaactcttttcggagatgggagaactagtacgatttgcaatccactatgacaaaaatggacgtccaagtggcgctgctgaggtggtctttgccagaagaagtgatgcattccaagctcttaagagatataacaatgtgcagttggatgggaagcctatgaagattgaaatagttggttccaacccagaaattcctttgtcagctcgtgtaaatgtagttggaggaaccaaccggaggaggactgtggttatggcgccaggtggtccagctcgtggaagaggagctgctactagtcgtggttctagtcaaaggggccgtggtggtttgaggaatgcacctggacgtggtcgaggtggtggtggcggtcgtggttggggtagaggtcgtggccgcggtggtaggggaagtagcagcaggggcgctgataagtcagctgaggatcttgacaaggaactggacagctaccacgccaacgctgacgccatgcaaacttagatatggcgcttccataacttgtgagttaactagaagaaccaatcatgtctactatgtctctgtatcacgtcaccaa

SEQ ID NO: 350 - DNA, 1346 bp, Solanum lycopersicum
agccaacattctttcacaattcttccttttggggtatactataattccaaaattttcaaccccatttcatgattttccctttactcaaaccccattatcataaagtttcaatttttatcaagaaaatgagagcagtttcagtatttggtggtgtgttccttgtgttggcagtgtattgtgggttggacccttttaagcatagtgcaatttctgagttcccaaattttgagtcttttaaggttgagatgccagcttggtctgaaatcccagttgaaaaagattcacaaaatttgcttcaaaaatctgaagttaagttcttggatcaaattcaggggccagaaagtattgtttttgatcctcagggtagaggaccttatacagggatagctgatggaagagttgtgttttgggatggtgaaaaatggaatgattttgcttatacttcagctaataggtcaggcttgtgtgatccaaaaccgtcagcgttgagctataggaagtacgagcacatctgtggtaggcctttggggttacgatttgacaaaagaacaggtgacttatatattgccgatgcatatttggggttaatgaaggtaggccctgaaggtggattagcagaatctttgacaactgaggctgagggggtacctataggatttgcaaatgacttggatgttgatgatgaagggaatgtttattttacggatagcagcacaaagtaccaacgcaggaattttatacagctggttttctcagcagaagatagtgggaaggttctcaaatacaatcctaggacgaaagaaaccactattcttattcgcaaccttcaatttccaaatggtctgtcactaagcaaggatggttccttctttatattttgcgaaggttccaagggcaggttacgaaagtactggctgaaaggtgagaaagccggtacatcagaggtaatagcaatcctcccgggatatccagacaacgtacgagcaaatgaaagaaatgagttttgggtagcaatccactgtcgtcgtaccatctacagttacataaatggcatataccctcgactccgtcaattcttgctgaagcttcccatctctgcaaagctccaatacctcattcacattggtggcaggttcactgcagttgtcgtgaagtacagccccgagggcaagctgttgcagatattggaagatcgacaagggaaagtcgttagagctgtcagcgaggtagaggagagggatgggaagctttggatgggaagtgttctcatgtctttcatttcagtttatcagctagaatgaactcttgagcttttgctttggctttggctcatcatcaattactag

SEQ ID NO: 351 - DNA, 1965 bp, Solanum lycopersicum
aaacaatggcgaaaatggtcagcccagatgctatttcaactattttagcgaacccatcgccggattcttcttcagatcttcctgaaattattgttcaagtagtggatctcaagcccactggcaacagatacatgttttcagccaatgatgggaaaatgaagattaaggggattcttcaatctagtttgtcatctgaagttatatctgggtctatacagaacctgggtcttattcggattattgattacaccctcaatgatatcccaactaagaatgagaagtacttgattgtaactaaatgtgaggcagtgtctcctgctcttgaagttgagtacaaggctgaagtgaaaagtgaagacactggcattgtcttgaagccaaggcaggaagagactgggattgttttgaaacctaaacaggaatatcaaactaaatctgctgctcaaattgtacatgaacaaagtggaaacatggcaccgactgctcgaatggcaatgacaagaagaattcagccacttgtctctttgaacccttaccaaggaaattggaccattaaggttcgagtaactagcaagggtaatatgcgaacctacaagaatgctcgtggagaaggctgtgtgttcaatgttgaattgactgatgaggatggtacccaaatacaagctacaatgtttaatgaagctgcaaagaagttttttgacaagtttgaattggggaaagtatattacatttcaaagggaactcttcgagttgccaacaagcaattcaaaactgtacaaaatgattatgagatgactttgaatgaaaattcccaagttgaggaggctagcaatgaagaagcttttattccagagataaagtttaactttgtcccaattgatgaattgggcccttatgtcaatggcagggagcttgttgatgttattggggtggtccaaagtgtatctccaacaatgagcatacggaggaagagtaacaatgagacagtcccaaagcgtgatataactattgcagatgagacgaagaagactgttgttgtttctctttggaatgatcttgccacccatgttggacaagaactgctagacatggctgataaatctcctgtagttgcaatcaaatcccttaaagttggagacttccaaggattgtctttatcagcattaagcaaaagcaatattgttgtgaatcctgatttacccgaagccaaaaaattgagatcttggtatgattctgaaggtaaagaaacttcattggcatctattggttctgggatgagcccttctaccaagagtggagcaagatctatgtatactgatagggtttccttgcttcatataaccagtaacctgtcccttggtgaggagaagcctgtctttttcagcttgaaagcatacataagtttcattaagcctgatcaaaccatgtggtatcgggcttgcaagacatgcaacaagaaagttactgaagcttttgggtctggatattggtgtgaaggatgccagaagaatgatgcagagtgcagtttgagatatataatggcattgagagtgtctgatgcaagtggtgaagcatggctctctacattcaatgatcaagcagagaaaatacttggatgctctgctgatgaacttgacaagctgaaatcagaggaaggagaaactgcatatcaaatgaaattgaaagaagctacatgggttcctcaccttttccgggtcagtgttgcacaacaagaatacaacaatgagaaaaggcaaaggataacagtcagagctattgctccagttgattatgaagcagaatccaaatacttgctggaagaaatgtctaagatgaacattgctatttaatgaggctagcctaacatagaatatttttagatttatttttgttatatttaagtctgaatgctcactaggattcgttagtaaaacagctgtatatatgtctcattgcctttgctta

SEQ ID NO: 352 - DNA, 1539 bp, Solanum lycopersicum
cactttttcttcattcaccatggaaggcgcagcaacagctcaagctttatctcgtattgggttagctggcttagctgttatgggtcagaatttggccttaaacatagctgaaaaagggtttcctatatctgtttacaatagaaccacttcgaaagtagatgaaaccctagatcgtgctcagaatgaaggacagcttccattgattggacagtacaatcctcgtgatttcgtgttgtctattcaacgacccagatctgttatcattcttgttaaagcggggtcacctgttgatcaaacgattgctgcgctttctgagtatatggagcctggggatacgattattgatgggggtaatgagtggtatgagaatactgaaaggaggattgatgaggcgtcgtctaaggggcttttgtatttgggtatgggtgtttctggtggagaagaaggggcgaggaatggaccttcgcttatgcctggtgggtcttatggggcttatacgaatatcaaagatattcttgagaaggttgcagctcaagttgaggatgggccttgtgttacttatattggtgaaggtgggtcggggaattttgtgaaaatggtgcataatggaattgaatatggtgatatgcagttgatttcggaagcttatgatgtgttgaagaatgcgggtgggttgagtaattctgaattggctgatattttcgccgaatggaaccgtggggaattggagagctttttgattgaaattacagcggatatattcaatgtgaaggatgaattgactggaaatggggagttagtggacaagattttggataagacaggaatgaaggggacggggaaatggactgtgcagcaggcggcggagctgtctattgcagctccgacaattgctgcttcgttagacagtaggtacatgagtggattgaaggatgagagggtagaagcctcagagatttttaggaaggaaggtttaaaggaggaaataagttctgatattaatggtattagcagtgttgataagaagagattgattgatgatgtgaggcaggcattgtatgcgtcgaaaatctgtagttatgctcaggggatgaatttgctaagggcaaagagctctgagaaaggttggaatttgaatttgggagagatggctaggatttggaaaggtggttgtattatcagggcagtttttttggatcgtattaagaaggcgtatcagaggaatcctaatttggctaacttgatggttgacacggagttcgcaagggagatggtgcagaggcaagctgcttggaggagagtggtgggacttgctgttcagaagggaattagtgttcctggaatgtctgctagtcttcagtatttcgacacctacaggcgttctaggcttcccgcgaaccttgtgcaggctcagagggactatttcggggcacatacttatgagagagttgacaagccaggagcataccataccgagtgggcaaaacttgctaggaaagctcgagtgtaatgctgctgcagctattgcggattatgatc

SEQ ID NO: 353 - DNA, 1773 bp, Solanum lycopersicum
ataaactctcgtgaacagcctccaatggggagttctacagcaacccatttcatatttttttttgcaaattttgagctgctagctatgttagagaaacatagatcttgatatttatatagctaaagtgtttatcttttttcaattttgataaaaatgggttctttatttttgcaaaagggagtgttggtgtggctttttttgtttagtttgagatttatttgtggaacaaaagctcaaggtactgtgtttatagatgggaaaattgctattggaagaatagacaggcattttatttgtgctactttggattggtggccacctgagaagtgtgattatggaacttgtgcttgggactattcttcattcttgaatctggatcttaacaacattatttttctcaatgcaataaaagcattctcaccattaaagattcgtttgggcggaactttgcaagacaaagtcatataccaaactgaagatcatcaacagccctgtgtctcatttgttagaaacacaacagagatgtttggttttactccagggtgccttcccttgtctagatgggatgaactcaacgcattctttaataaatctggggctagtataatttttggattaaatgctctatatggaagatcggtacaccctgatagtttatctgtcggagcgtgggatccaagcaatgctgaatcacttatacgttatactgttaaaaagggatatgatatccatggttgggaactcgggaacgaattgagtggtagcggagttggaaccagagtagcagcagatcaatatgcatctgatactattgccttgcacaaaatagtgaaagatgcttatgagaattctgaaactaaaccgttggtcctggcaccgggaggtttctttgatgaaggctggttcagggaattagtaaataaagctggggcatcatttgatgtggcaactcaccacatatataatctcggtccaggaagagatgaacaccttcttgagaaaatccttgatccatcttatcttgatggagaagctgatacatttagcaaacttcagaatatcctcaagacatctggtagttcagtggttgcatgggttggtgaggctggaggagcttacaacagcggtcgcaaccatgtcacaaatgcctttgcttttagcttctggtatttggaccagcttggtatgtcagctgcctatgataccaagacatactgccgacagacattgattggtggaaactacggtttactcaatacgactacctttgaaccaaatccagattactacagtgctcttctttggcaccgattgatgggaaggaacgttttggcaacgagtttctcaggaacaaagaaattacgtgcatacgctcattgtgcaaagcaatctcaaggtatcacattactgttgatcaaccttgatggcaacaccaccattcatcccagagttgattttaacggtaccatgttacatcaacaaaaacacagacatcatcataaccacagaaagagttcaatcaaactgcctagaagtaacaaagtagcatcaaacacaagagaagaataccatttaacagcaaaagatggaaatttacaaagccagacaatgctactaaatggaaaggcactaattgtagattcatctggaaatatacctacatttgagcctatatatgtcaattcaacagaggcgataaccgtcgcgccactctctattgtatttgtacacataccatatgtacttttgcctgcttgtagctgagtttgttaa

SEQ ID NO: 354 - DNA, 1441 bp, Solanum lycopersicum
ttacagaaatggcagcagctaaacggtttttagataattctaatccggatccaaaccaaccgaattacaaacgcatgagaccttctttcgcttctgttattaaggaagcaatgaaggcgaatttcctagagaacgtgtcttctgctttggaaccgatgctccgtcgagtggttgttgaggaagtggagaagggactaaggcgttattcatgtctttcaataacgagatctccttcgcttagaatcaaagcattagaaccatcgaatcttcgtctcattttcaacaaaaagctctctaaaccaatatttaccagcagcaaagtcgtcgccggcgacggtcagagtcttcaaattcttctggtggatacgagcggcgaaggcatggttccgacgactttaccttaccctatcaaagtagaactcgtcgtactcgacggagatttcccgtccggagaaactgaaacgaattggtctcgcgaagaattcgacaaacgcgtggttaaggagagaaccggaaagaggccattgcttaccggcgaactgaatttcacgatgcgtgaaggcgtcgttcccgttggggaaatcgagtttactgacaattcgagctggattcggagccggaaattcagaattggcgcaaaagtggttcaaattggaaacaatcaaacttctgttcgaattatagaagccgttactgaatcgtttgtggttaaagatcaccgcggagaattgtacaaaaaacattacccaccagcactaggagatgaagtgtggcgtcttgagaagattggaaaagatggaactttccgcaaaaagctctcttcaaaaggcatcaacactgtacaagatttcttgaagttagctactattgacacacaacaaatcagaactatactgggaactggaatgtctgataaaatgtgggaagtgacatacaagcatgcaaaaacttgtgagatgggctcgaagttattcatggcccgtggctcaaactacgttctaatccttactccgatttgtgaagttgttagggcagttattgatgggcaaatttaccctactcatgacttaactgggatacaaaaggcatatatccagaatttggtgaaagaggcttataccaattggagttctttagaggaagttgatggtctagttaatgagccagcactactaactcaaggagaaccaatggtggatcaatatccaaatgttcatcagcagcaacaaccaatgataagatcctatcaacgaaacacaattttgacagatgcatctgaacaattaatcgaatacaatgactggattggtaatcctaactacatttgatacacctgctgataataacggtggtagttacttttcagacagatagagaattgtgttacattttacactgtcagcatatagaagttaaacagaagacaatgaaggattgaagc

SEQ ID NO: 355 - DNA, 1678 bp, Solanum lycopersicum
cctataccctttccataataaatccattattaatattcctcttcaattttttttttttacttaaattccatatatattcatcactaattacaatttttttttattaaaatggattttttctacaaagccaaagctgtaaaattaaaaagtcatctagacaaataccttgtagccgatgatgatcaagaaaatatccgacaaagccgaaacggctcatcaagaaaagcccggtggcttgttgaacttgttgaagccgaaaacagccactttatacggcttaaaagtggctccggcaagtatctcacggcttccgacgagccgtttcttcttggcatgaccggaaaaaaggtaattcaaactttgcccgaagaaatgaaggacttgagaatcgaatgggaagtaataagggatggatttcaagtaaaattaaggggttttggaggaaaatatttacgtgcaaatggaggaatgccaccatggagaaataaagtaacacatgataatccatatagtggtagtacacaaaattggattttgtggaacgttgaacctattgatgtgcccgaaaatgaatcgttgacggaatatttaactatggtttcaagtttttcatcgatttctgatgagcttttaagcctggatttaggatctccgacttctgtacattcaagtttttcattctcacctaggagggctaagatttctttaccaaaaagatcagcaatggagctatttcacaaagcaaaagctgttcgtttacagagtcaccatgagaagtacttaacagctgaagaagatgaagaatcagtgactcaagatcgtaacggagcatcaaaaaacgcgaaatggacagttgaatttgttgaaaaaaccgaaaatgttattcgattgaagagttgttatgggaaatatttaacagcttcgaatcagccatttcttctgggtatgactggtagaaaagttcttcaaactttgcctaatcgacttgattcttcaattgaatgggaacccattagagaaggacatcaagttaagctgaggacgagatatgggcaatttttgaggggaaatgggggtcttcctccatggagaaattctgttactcatgatattcctcataggacgaaaactcaagattgggttctttgggatgttcatgttgttgaaattttggcgcattcgacggcggagacggtggcggagacgacggtggtgggtggtaattctgattcgtttgcttctgaatcgagttctgctactactactggttcatcaaaatcttacagcttttcgagacaagagtcaagtgattcattgattagttcaccgcctaagttggtagatggaaggcttatatattatcacgttacggatgaatttggagaaattgacgaaggagccgagggactttgcataacttttaagggaaatagtgttgaggatctaaagaagagattggaggaggaaactgggctcgaggatattactgtgtgtactcggagtgctttgaatgggaagctttatcctctccgtttgcagcttcctcccaacaacgcaaatatgaacgttattattttgccatcttcatctaaagaagctagtgatattgcataaccaagaaggccattgtagccctactcgtggagcacttatcgcggattgttgcagtagatggatt

SEQ ID NO: 356 - DNA, 623 bp, Solanum lycopersicum
cagtgtatagtatgagtgtcatcagcaaattaacattgctcatcatttcaattgcttgcatttttcaggtatcatcactaagcgcagatgggtcatcacttgtaccactaatcatagaccaaatgataagcagcaatccggctaatacatttcttgatccattcaaagttttagaacaaataccatttggattagaaaacactctgctcgcgagagtcgactggaaagagacggcgaagggacacgtgataagcgtagaagtacctggattgaataaagatgatataaagatcgaaattgaagaaaacagagtgttgagagtgagcggagagaggaagaaagaagaagagaaaaatgatgaagagaatcattggcattgtgttgaaaggagtcatggaaagttctggagacaatttcgtttgcctgaaaatgctgatattgatacaatgaaagctaagcttgaaaatggtgtgcttacaatttcatttgctaaattgtctgctgatagaattaaaggtcctaaagttgtgtctattgagagtaaacaacaaggaaaagagtcctctgttagagaagagctttaattttatgagttcatcctctgttttctgttcatcctctag

SEQ ID NO: 357 - DNA, 1451 bp, Solanum lycopersicum
ccctctttggaattcagcccctttgaaacaaactttcaaattacaccaactattaaatcgtttcttgtttttggctatctgggattttgttctcttgaagaaagattgaatctttctagattttggtcatctggggttaagtgttttggaaaaagattcaatcttttgttggttttggttatctggggttaagttttttttgaagaaagattgaatctttcttgattttggctatctggggtcaagtatttttggaaaaagattcaatcttttattgttttggttgtgtggggtgtaatttggtgtaagtacataaattttggtgtaaaagaaaggtattttttagtgggatgaggatgggggttgaaaatgtagtggggtatgagagggaggtagaagaagaggaagaggaaagggaaatggaaatggtggtggctcatgggtctccccagcaacagatgaagttggtggtggtaggctatgctcttacatccaagaaaactaagagctttttgcagcccaagcttgtaggtctagctagaaataagggaatactgtttgttgctatagatcagagcaaacccctttcagatcaaggtccttttgacattgtgctccacaagttgtcaggaagcaagtggagtcgtattcttgaggattataggcaaacacatccacatgtcgcggtccttgatcctccagatgccatacagcaggtgtataatcgtcaatacatgcttgaagaggttgcagacttgaacttgtcagatagctatggcaaagtaggtgttcccaggcaattggttatagagaaagatccttcgtctatctcagatgcagtggataaagctggtctttcactacctcttgtggcaaagcctttggttgcaaagtcacatgagttgtctttggcctacgatatggtctctcttcagaagcttgaaccaccgcttgttctgcaggagtttatcaatcatggaggtgtactttttaaggtttttattgttggggaagccgttaaggttgtcaggcgtttcagcttaccagatgttagcaaactcgagctgtccaacaatgctggggttttccatttccctagggtttcgtgtgttgcagcatctgcagaagaagctgatttagatcctagtgttggtgagcttcctccgcggccattacttgagaggcttgctaaggaacttcgtcgtagactgggtctcaggctctttaacttggatataattcgagaacacgggactaaagaccgttattacgtaatagatatcaactatttccctggatacggtaaaatgccagaatacgagcacatatttacagattttctcctgagccttatgaagcagaaataacaagaaaatccatcctgtacataacttgtctatactatagaagagaagaagaggatattatccagtcagtacaagcaaggagag

SEQ ID NO: 358 - DNA, 2211 bp, Solanum lycopersicum
taacaaacaatttcaccgtgccgctgccggctgccatcaccgatcgccgtccggcgaaactcagaaaaaggcattactttgtctgccaattgaattacaatggcgtaccaagggggaaacttgaagtccactgccataaatggagtgaagatgtatactgttgctggccaacaccgttctgtggctacatggcttcctccgaagaagctcagagctcttcgtaaagatccaggttatatgcaaagagtggatctgattcaagatttgaaatttgaaactgcaacaacacgtattaaagtgactcctgatggggagtatctaattgcatcaggtatttacccaccacaagtaaaagtgtatgagctgcgggagctgtcgttgaagtttgaaaggcatttggtgtcagagattgttaactttcaagtcttgggtgatgactactcaaaaatagcatttctctgtgctgatcgttctgtttgcctccatgcaaaatatgggagtcactataaattgcggattccaaggatgggaagggatattatatatgatagctggtcttgtgatttgctttgtgctgcctcatcaccagatctgtacagaataaatttagagcagggacgctttctttcctcactgtgcacacggtccccagcacttaatgtggtttcacggagcaaggtccatgggctagttgcttgtggaggggaggatggtgcgctcgaatgctttgatatgagagcaagatcttcagttggtaggataaatgctgttgcacctgctgggggtggggaccaggaggttactgcaatagagttcgagggagatggaggttacctcatggctgttggaagtagtgacggaaaggttctggtttatgatttgcgttcttctcaacctatgcggataaaggatcatatgtatgggagcccaatattaaacattaagtggcataaaacgctcaacactgaacgaacaaagttaataactgctgacagccacattgttagggtttgggaccccgagacgggagaaggcatgacgagcattgaaccgactggtgggagaatcaacgatttgtgtgcattcactggcagtggattgatgttgttggctcttgactctagtcaaataccttcatatttcataccttctctgggacctgcgccaaagtggtgttcttaccttgaaaacctaacggaagagcttgaggagcaaccccaaacaactatttatgacgattataaatttctgacaaaggaagatctggaaaagttgaatttgaccaatttgattggaaccaatcttctaagagcttatatgcatggttacttcattgattatcgtctgtataaaaaggcacacgcagcgtcaaatccgtttgcttatgacgagtatattgagcagcggaagaaggaaaaattcgaaaaagagcgtgatagtcgtatcacgattaagaggaggcttcccaaagttaatcgcactctggttgaacaacttcttgagaatgaggaagctgagaatgtgaaggaggatgttgatgacgttgatgcgaagaagacatcaaagaagaagaaaggactgaccatggacgttcttgaagatgaacgtttcaaacgcatcattgaaaataaggactttgaaattgaagaagattctcatgagtatcgggcattgcaccctatgccttccttaaaacgaccatctttagtggaagaacattttgagcctgtgatggaaggtgaggaggctagtgattctgatgcacaatcatcagaagatgaacaagaaaatgacaggaattcaagaaagaaggccagagttccgagaatgtatgaagtcaaggatgataggcatgcagaagcattctcaaaccatatttcacttgcaaaagaggatgctctttcactaggtgaaagggttgcagggttgtcaaatggcagagcttctcatgatatgaacaatattaaggttggtcccggaggttcgagagaagtttcattcttttccaggagctcagccaagtatgtggaagatgatggagagaaggaaacacgaaccgaaaagagaagaggggtccagtccttaaaactgaagcctgagagatcaggttttcaggggtcaggttctcgagggcgggggagaggaggaagaggtcgtggaatgggcagaggaagaggtagaggtagaggaagagggagaggatgattttaa

SEQ ID NO: 359 - DNA, 648 bp, Solanum lycopersicum
tgtacctatggctagtgaacctgcaaaggttgttcccccaaccgaagctccggtggtggagcctgaaaaggcggctccaccacctacaacttggcccaccgactactttgcggtggctgatgtggtgttaaggttgttagtgtttgcttcggcggttgtgtctgtggtggtcatgtcaactagtaaggaaactaaaatgctcccaaaccctcgtcctgctaagttcactcactcaccggcactcatctattttgtagcagcactctctgtggctggtttcttcagcctaattactacactaggctcattgtactccctcatcaagcctggttgctgtgcaaagatcatttcccacttcattgtcattgatgtacttttgctaggaatagtggcatctgcaacaggagcagcaggatcggtgacttacgtgggactaaaaggcaacactcatgtgaggtggggaaaggtttgcacactgtatggaaagttttgcagatacgtaggagcttctataggagtctcattgttcgcgagtgttatgcttgtgctacttgttctcctctctgtatactccctttctaagaagatccccaagtgacaagacagatgaaaagtgaattcttcatgtatagcagaacaacccttggt

SEQ ID NO: 360 - DNA, 5157 bp, Solanum lycopersicum
tttccaatgcaaaaacggggttcatacccggtgttccaatcgggacatgggtttcaccggaattcgccggaattttcgaaacgaagaataccaaatttcacaatccaactccgggcaacaccggtgaactggaaactgaactggcaacatctgaacagcttgataacaaaattacccttcaccccagaaaacccatcagttgtagactcaagttatatcgtaggaaccctatcgtatgttgaatggtgtcaaacattagaagttatggtgaagttatgggagttaaggttaagtggtgagcattgttttaacccaattttaaaagcaaaagttgaacttccatctgataaagaagaattgaatgagagaatagaaggggttttcttggagaaactgaataggttaatcaatggtgttttagtacaaaaatggcagaaaaaattgggttttgtgattgatgagattgggaaaatttctttgttgttgaagaaaccaaacaggattggtgtttaccaggagctatgtaagaaaaaaaagggtattgaaggtgaaagagatttgatattatcaaggattgatgaatacaagaatgggattaaatgtatcattgataatttggaggattcaaagaattatgaggatgttaaagtgtttgattttggtgaagggattgattggaatagaattcactttatcatgatgagagaatgtagaaggcttgatgatggattaccaatttatggttttaggcagcagattcttcaacaaattctttctcatcaggtgactgttttggttggggagactggatcaggaaagagtacacaattagtgcaattccttgctgattcaggaatagctggcgatggttctatagtttgtactcagcctcgaaaacttgctgccaactctttagcaagtagggttagagaggaaagccaggggtgctatgatgattgttcgatctcctgtaatccaccacattcatccgatcagcagttggattcaaaggtgatttttatgacagatcactgcctattacagcactatatgggcgacaagaatttgtccaacatttcatgcatcatagtcgatgaggcacatgaaagaagccttaacaccgatcttcttttagcgttgattaagaaactacttcatcagaggtttgatctgaggcttattattatgtctgctacagttgatgcaaaccagcttgcaggctacttctttggttgtggaactttccatgtggctggtaggacttttccggttgatataaagtatgtaccctgtgaagataacgcccattatgctgtaggtgcaattgcctcttatgtccacgatgttatcaagatggtgactgagattgatagaactgagggagtgggggctattttagccttcttgacatctcagagtgaagttgagtgggcttgtgagcagtttaaagcaccactcgccattgctttacctttgcatggcaagttatcctatgatgaccaaaaccgagtgtttctctcctatccagggaagagaaaggttatattcaccaccaatctagctgagacatcactgacaatccctggtgtcaaatatgttgttgattctggcatggttaaagaaagcaggtttgaacctggctctggcatgaatgttctcaggatatgcagtgtgagccaaagttctgctaaccaaagagccggtcgtgcagggagaactgaacctggaaagtgtttcaggctgtactctcaaagtgattttgaggatatgcctcgtcatcaggaacctgaaattcggaaagttcatcttggtgttgcagtgctgaggattcttgctttaggtatcaagaatgtgcaggattttgactttattgatgcaccgagccccaaagctattgagatggccaccagaaatctggttcaactaggagctgttacacaaagagatgatgcatcatatgaattaactgaaggaggactaaaactggtgaagttgggtattgaacctcggttgggaaaaatgatccttagttgctttgatcaacgtttgggtaaagaaggtgttgtgcttgcagccgttatggcaaattccagcagcattttctgtagggttggttctgaaggagacaagcttaaatctgattgccacaaggtgcaattttgccatccaagtggggacctctttactttactatctgtttacagggaatgggagattgtgcctagggaaaagaagaatagctggtgttgggataatagtatcaatgctaaatccatgagaagatgccatgagacagtgctggaaatggaagcctgtcttcagaatgatctcaatatgatcttagccagttactggtgctggcatcctcaagtgcataacaagtgtgacgaagtattgcaaagtataattctttcttcacttgcggaaaatgttgctgtgtactcaggttatgatcagcttggttatgaggttgcactaactgggaagtgtgtccaactacatccttcctgttcgcttttgaattttggccaacgaccacgttgggtagtctttggggatgtccttgcatcagctaacgagtatctggtctgtgttactgcatttgagtttagttctcttgttagcctcactcctgctcctttgtttgattttctgaagatggatgcacgaaagttagaaaaaaaggttttgacaggctttggagtcttgctactcaaaagattttgtgggaaatttaacagtagcattaataatcttgtctcgcgcattagaacttcttgtaaggatgaaagaataggcattcaagttaatgttgatgagaatgaggttcttttatatgcttcttcgagagatatggagtgtgttacactccaggtaaatgatgctctagagtatgaaagtaagctgttgcggaacgaatgcttagagaaatgtctattcaatggaggatcggcctctgttgctctctttggagctggagctgtgataaagcatttggagcttgagaagagatgtttgactgtggacatatttccttcaaatggaaatgccattgatgacaaggaattgctgatgtgtttggagagagcaacatctggtaatatttgtatggtgcacaagtactataatatgggccaggacaaagtggagaacaagtggggcacagtaaaatttcttacccctgatgctgcagaacaggctacatccttaaataaagtggaatttaatggtggctttctgaaaatggttccatccaggagcataaattgtagtgatcaaaaaatgtttcgctcagttctcaaagctaaagtttcttggcctcgtaggtacagtaaaggagtaggctttctgagatgtgatcctatggatgttcctttaattttagatgacctctctgatcttatgattggtggaaatgtcatccgttgtgaggcaagcgataagaaccctaataacatagtcattgctagacttgataaggacatggctgagacagagatacttgaggtgttaagggcaacaacaaataggagagttctggatttcttcttggtgagaggagattctgtagaggatcctcccatagctacttgtgaagaagcacttcggaaagaaatatctcccttcatgcctaaaaaggttccatttgttaactctgttcgtgtccaggtgttccagccgaaactaactgagtatttcgcaaaagcaactataacatttgatggatctcttcatcttgaagcagccaaggccttggagcaaatcgacggcatggttttgcccggatgccttccctggcagaaaataagatgtgagcgactgtttcacagctctgtttcctgtcctgcagcagtttatcatgtcatcaggaaccagctggattttttacttgctagcctccgccaaagaaaggttggaaaatgcgagctacagagaaatgataacggttcctatacagttaggatatctgctactgccaccaaagttgtggcagatttgagaaggccactggagcaacttatgaaaggcaagattgtagatcacgtggacattactccgaaggttgttcgacttctgttctctcgggaaggaaacaacattatgaggacaattcaacgggagacaggaacctatatttattttgacaagcatagcttgcttgttagtatatttggttctttagacaacgttgatagggctcgacagagatttatcgattcccttctggcgctacatgaaaataaacaacttgaggtgcatcttcgtggaggacatttgcctcatgacctgatgaaaagagttgttcagacatttggaccagaccttagtgcgcttaaagaaaaggtgcctggggcagagttctctctgaacacaaagcgccattgcatctatatgaatggtacaaaagatatgaagcaaaatgttgaggacataatctctgaaattgctcaaagaagttttccaactcaaacgacaggagatgatgctgactgtcctgtttgcttgtgtggactggaggatccttataaacttgaagcttgctgccatctattctgtcggacatgcttgctagagcagtgcgagtctgcaatcaaaagccgggaaggtttccccatatgctgtcttcatcaaggttgtgcggaacccatattgcttgctgatttgaagtctttattgtcaattgagaagttggaagaacttttcagggcttctttgggggcttttgtggcagccaatgggagtacctaccgcttttgcccctcaccagactgcccttcagtttatcgcattgcagatcccgatatggttggtgcaccttttgcctgtggtgcatgctatgtggagacatgtacgagttgccacatggagtatcatccttacctctcatgtgagatgtaccagaaagttaaaaacgacccagattgctctctagaggaatggtccaaggggaaagagaacgtaaagaaatgtcccgtttgcagatgtacaattgagaaggtggatggctgcaatcatatcgagtgtaagtgtgggaatcatgtttgctgggtttgcttgcgcttctttgacaccagtgataattgctatgatcatttgaggtctgttcaccgatccattacatgagaaataggaaccgtagtttatgtaagcgtgtag

SEQ ID NO: 361 - DNA, 1157 bp, Arabidopsis thaliana
cttcaatggagcttccgttactctcgtatgctagctccgcgtcgttttcacggacaggcttatgctcttcttcttcttcctcctcaactagtatctatgagtttccggagagaagacggagtttaaaattgagattcaatggtggagaaaggtcacgaagcgttatagcttccgctgaacggagcagtgaagggattgagaagacaacagacaccgtcggtggcggaggaggaggaggagcaggcagatttgctggtactgccatggaggttactacacttgatcgtggttttgctaactccaccaccgttgattttccgatctgggacaaaatcggcgccgtcgttagacttacttatggaatcggaatatatggagcaatggctgtagcaggaagatttatatgttcagtgactggaattgattcatctggtggatttgatccttctcttgatgcactacttgctggacttggctatgcaacaccaccaatcatggctcttctcttcatactcgacgatgaagttgtgaagctatcaccgcatgctcgggccattagagatgtggaagatgaagaactaagaagctttttcttcggaatgtccccatggcagtttatactcattgtcgcggccagttcaataggagaagagctcttttaccgtgttgctgtacagggtgctctgtctgatatattcttgaaaggaacacagttgatgacagattctagaggcatggcatctctgaccggagtgtttcctccatttgtcccatttgctgaagtctttgcagctgtaatcaccgcgactctcacaggctctctctactttcttgctgcgtctccaaaagacccgacatacatagttgccccggttttaaggtcacggcgagatgattttaagaagcttttgtcagcttggtatgagaagagacagatgaagaagatttactctccactccttgaaggactcttagccctctatctcggtattgaatgggttcagacggataatatattagcaccgatgatgacgcatggtatatactcggcggtcatattagggcatgggctgtggaaaattcacgatcaccggagaaggttacgccggagaatcgaacacattagatcggaggccacggataagttgatttaataa

SEQ ID NO: 362 - protein, 589 aa, Arabidopsis thaliana
MGKSEKTSLGRSLVKHHNHMIQESKDKGKYYKNLQKKVLESVTEVSDIDAIIEQAEEAERLYTINHSSSTPLSINLDTNSSSSVIAAEEWREQQKIEEALHASSLQVPRRPPWTPEMSVEELDANEKQAFLNWRRMLVSLEENEKLVLTPFEKNLDIWRQLWRVLERSDLIVMVVDARDPLFYRCPDLEAYAQEIDEHKKIMLLVNKADLLPTDVREKWAEYFRLNNILFVFWSAIAATATLEGKVLKEQWRQPDNLQKTDDPDIMIYGRDELLSRLQFEAQEIVKVRNSRAASVSSQSWTGEYQRDQAVVGFVGYPNVGKSSTINALVGQKRTGVTSTPGKTKHFQTLIISDELMLCDCPGLVFPSFSSSRYEMIASGVLPIDRMTEHREAIQVVADKVPRRVIESVYNISLPKPKTYERQSRPPHAAELLKSYCASRGYVASSGLPDETKAARLILKDYIGGKLPHYAMPPGMPQADEPDIEDTQELEDILEGSESDDSAVGDETENEQVPGIDDVLDDLSSFDLANGLKSSKKVTAKKQTASHKQHKKPQRKKDRTWRVQNTEDGDGMPSVKVFQKPANTGPLTMR

SEQ ID NO: 363 - protein, 754 aa, Arabidopsis thaliana
MAEDFARAVDDGLKLAKRIYFGKDRAVAAPRPPAPMDRSSTTQPYLPTAPMVYAVIPDPGIVDNPDLPSYQPHVHGRCDPPALIPLQMNSIELDVDCYLDTALVTVTGSWRVHCVMGSKRCDCRIAIPMGEQGSILGVEVEIPRKSYTTQLITAEDGNEFEKTALPETGGFLKPNIFTLTIPQVDGGTNLSIKMTWSQKLTYNQGQFFLDIPFNFPEYVTPAVKKISKREKIYLSVNAGTGTEVLCKGCSHQLKEKLRSAGKLRFAYEADVLKWSNTDFSFSYTASSSNIVGGLFLQSAPVHDVDQRDIFSFYLFPGKQQKTKAFKREVVFVVDISKSMTGKPLEDVKNAISTALSKLDPGDSFNIITFSNDTALFSTSMESVTSDAVERGIEWMNKNFVVADGTNMLPPLEKAVEMLSNTRGSIPMIFFVTDGSVEDERHICDVMKKHLASAGSVFPRIHTFGLGVFCNHYFLQMLANISCGQHESVYNTDHIEERMDKLFTKALSTILVNIAIEPLQSLDEVEVYPSNIPDLTSASPLMIYGRYRGKFPENVIAKGLLGDLSSFSTDLTVQSAKDMPLDKVFAKNVIDLLTAEAWFSEDKQLKEKIAKLSIQTGVLSEYTRMIQLENTEELKPSETGGKKKTTSNGEKQKMISRTIPLQSLGIGFGDKTATRENVPPGFGEQKAPDAAEKFVKAASSCCVSLCNKCCCMCCVQCCSKLNDQCVLVFTQLFTAIACIACFECCSTVCCSGDDG

SEQ ID NO: 364 - protein, 490 aa, Arabidopsis thaliana
MENGSGKVLKPMDSEQLREYGHLMVDFIADYYKTIEDFPVLSQVQPGYLHKLLPDSAPDHPETLDQVLDDVRAKILPGVTHWQSPSFFAYYPSNSSVAGFLGEMLSAGLGIVGFSWVTSPAATELEMIVLDWVAKLLNLPEQFMSKGNGGGVIQGSASEAVLVVLIAARDKVLRSVGKNALEKLVVYSSDQTHSALQKACQIAGIHPENCRVLTTDSSTNYALRPESLQEAVSRDLEAGLIPFFLCANVGTTSSTAVDPLAALGKIANSNGIWFHVDAAYAGSACICPEYRQYIDGVETADSFNMNAHKWFLTNFDCSLLWVKDQDSLTLALSTNPEFLKNKASQANLVVDYKDWQIPLGRRFRSLKLWMVLRLYGSETLKSYIRNHIKLAKEFEQLVSQDPNFEIVTPRIFALVCFRLVPVKDEEKKCNNRNRELLDAVNSSGKLFMSHTALSGKIVLRCAIGAPLTEEKHVKEAWKIIQEEASYLLHK

SEQ ID NO: 365 - protein, 754 aa, Arabidopsis thaliana
MARFPTSPAPNLLLRLFSSNKRASSPTAALLTGDFHLIRHFSAGTAARAVKDEKEPWWKESMDKLRNIGISAHIDSGKTTLTERVLFYTGRIHEIHEVRGRDGVGAKMDSMDLEREKGITIQSAATYCTWKDYKVNIIDTPGHVDFTIEVERALRVLDGAILVLCSVGGVQSQSITVDRQMRRYEVPRVAFINKLDRMGADPWKVLNQARAKLRHHSAAVQVPIGLEENFQGLIDLIHVKAYFFHGSSGENVVAGDIPADMEGLVGDKRRELIETVSEVDDVLAEKFLNDEPVSAAELEEAIRRATIAQKFVPVFMGSAFKNKGVQPLLDGVVSFLPSPNEVNNYALDQNNNEERVTLTGSPDGPLVALAFKLEEGRFGQLTYLRVYEGVIKKGDFIINVNTGKRIKVPRLVRMHSNDMEDIQEAHAGQIVAVFGIECASGDTFTDGSVKYTMTSMNVPEPVMSLAVQPVSKDSGGQFSKALNRFQKEDPTFRVGLDPESGQTIISGMGELHLDIYVERMRREYKVDATVGKPRVNFRETITQRAEFDYLHKKQSGGAGQYGRVTGYVEPLPPGSKEKFEFENMIVGQAIPSGFIPAIEKGFKEAANSGSLIGHPVENLRIVLTDGASHAVDSSELAFKMAAIYAFRLCYTAARPVILEPVMLVELKVPTEFQGTVAGDINKRKGIIVGNDQEGDDSVITANVPLNNMFGYSTSLRSMTQGKGEFTMEYKEHSAVSNEVQAQLVNAYSASKATE

SEQ ID NO: 366 - protein, 446 aa, Arabidopsis thaliana
MELNKDQTVMSEDKKPQDPNPRFACEGCSVLLDINDGDRLVFARLSSGAILKIGNKNYSLKPLIGAPFGSLFQVETGEDGSFLSRILPIKQESNSNNVMDDSRDNREIVDNNEAQNLTGEEIEAMRREGAKGDEIIEALIANSKTFDKKFQLSQEKYKLKKQKKYAPKLLLRRPFARSICEAYFKKYPARIGFLRVDALSLLLTMANVTAYSDVLVVDMVGGLVTGAVAERLGGTGYVCNTYKGSSPYPVEMVRMFNFSDKVLKRIVQSSINELSSAKTASTEGNNQQEGVCKAENNINETATSDVMVEEISVTTEAGVVDIVVPESKIIKAAKAGAKASKETIEMWQENGFSSLIMAAQDQDPWIVAKDVLPLLSYSAPFAIYHQYLQPLATCMHKLQQGKMAINLQITEPWLREYQVLPSRSHPHMQMSSFGGYVLSGIRISTT

SEQ ID NO: 367 - protein, 225 aa, Arabidopsis thaliana
MVREEEKSRWWWFESHKSSKHSQWLQSTLAEIDAKTKAMLKLLDGNADSFAQRAETYYKKRPELISFVEDFYRAHRSLAVNFDHLKSSDHYGSRSAKVPQQSMESVSDSNSHFEDADSEIEDPLQDDASAADCKEDETWQLEQERLKLIEETDALRKQLLDKDEEKREVIRQLSLTLETLKDENLSLKRRLAHHSLKQRTVLEFKPLNKFFGKLFYIMCDGNKVL

SEQ ID NO: 368 - protein, 255 aa, Arabidopsis thaliana
MSYSRQSMGSGSRSTRGYEFGRTYVVRPKGKHQATIVWLHGLGDNGSSSSQLLESLPLPNIKWICPTAPSRPVSLLGGFPCTAWFDVGEISEDLHDDIEGLDASAAHIANLLSAEPTDVKVGIGGFSMGAAIALYSTTCYALGRYGTGHAYTINLRATVGLSGWLPGWRSLRSKIESSNEVARRAASIPILLAHGTSDDVVPYRFGEKSAHSLAMAGFRQTMFKPYEGLGHYTVPKEMDEVVHWLVSRLGLEGSR

SEQ ID NO: 369 - protein, 460 aa, Arabidopsis thaliana
MSILCCVPVLECVYCLGCTHWLWKKCLYSAGHESENWGLATSDEFEPIPRICRLILAVYEENLHDPMWAPPDGYGIDPNHVILKKDYDQTEGRVTPYMIYLDHENGDVVLAIRGLNLAKECDYAVLLDNKLGQTKFDGGYVHNGLLKAAMWVFEEEHVVLRELLEANPSYSLTFVGHSLGAGVVSLLVLFVIQNRVRLGNIERKRIRCFAIAPPRCMSLHLAVTYADVINSVVLQDDFLPRTTTALENVFKSIICLPCLLCLTCLKDTFTFEERKLKDARRLYAPGRLYHIVVRKPLRLGRYPPVVRTAVPVDGRFEQIVLSCNATADHAIIWIERESQRALDLMVEEDQVMQIPVEQKIVRQKSIVEDHDEEYRAAIMKAASLNIPMSPSPSYGTFHDTEEGESSAGSGMEGSPSGWSFKGMRRKWDQFIDCHFPVNDNSEHMIFKNQESQALLCGQET

SEQ ID NO: 370 - protein, 316 aa, Arabidopsis thaliana
MDHQQSSDSPMHESTTSSSSSSWSFGNLIKTLSTKSESVIGSYRRDLVEFGSELKKETSIIRRVASRLPDSLEIGASVASESLESVGQVIDDIGATVWKSTAKIISRGKESLEPNRDRTNQVLSLKPYRRFEMMLLALQSDKGTFVREPDDLSDFENWSLGLKLEEKRNEIVELINGNKGVKEIYEEIVPVEVDAETFWRRYYYKVYKLEQVEEARVKLVKRAISGEEDEDLSWDLDDEKEKVESRDVSSKDSDYSVISTQPSLLGSEDLGWDKMEEDIRSNEERLDWRRRAGVAVEEEEDLSWDIEDEDDDSVQQ

SEQ ID NO: 371 - protein, 102 aa, Arabidopsis thaliana
MATDCNRVNDFLFSQQQESTSGANKYGGLVPKKKPLISKDSKRAFFDSADWALLKQEASIDQRTIAAIEKLRPKLQRTPRKQLSPRRPTCATGNENLTESSF

SEQ ID NO: 372 - protein, 852 aa, Arabidopsis thaliana
MRDFVIVFGSSSAITNPHHHHRRCYATAPESNRKTKSNSSFTKLLPSLPQQHSPSPASVSATHSLSSHFSNVVRWIPDGSLEYYADFASKLAEDGRIEDVALIAETLAAESGANVARFASMVDYDLLSKGISSNLRQGKIESVVYTLKRIEKVGIAPLDLVDDSSVKLMRKQFRAMANSVQVEKAIDLMEILAGLGFKIKELVDPFDVVKSCVDISNPQLAIRYACLLPHTELLLCRIIHGFGKKGDMVSVMTAYEACKQILDTPNMYICRTMIDVCGLCGDYVKSRYIYEDLLKENIKPNIYVINSLMNVNSHDLGYTLKVYKNMQILDVTADMTSYNILLKTCCLAGRVDLAQDIYKEAKRMESSGLLKLDAFTYCTIIKVFADAKMWKWALKVKDDMKSVGVTPNTHTWSSLISACANAGLVEQANHLFEEMLASGCEPNSQCFNILLHACVEACQYDRAFRLFQSWKGSSVNESLYADDIVSKGRTSSPNILKNNGPGSLVNRNSNSPYIQASKRFCFKPTTATYNILLKACGTDYYRGKELMDEMKSLGLSPNQITWSTLIDMCGGSGDVEGAVRILRTMHSAGTRPDVVAYTTAIKICAENKCLKLAFSLFEEMRRYQIKPNWVTYNTLLKARSKYGSLLEVRQCLAIYQDMRNAGYKPNDHFLKELIEEWCEGVIQENGQSQDKISDQEGDNAGRPVSLLIEKVATHMQERTAGNLAIDLQGLTKIEARLVVLAVLRMIKEDYMRGDVVIDDVLIIIGTDEANTVSGKQEITVQEALVKLLRDELSLVVLPAGQRNIIQDAHCVDDADQENTKSFVSISSTRRPAILERLMVTKASLYQWLQRRK

SEQ ID NO: 373 - protein, 608 aa, Arabidopsis thaliana
MASDAVKYMPIHGGGTTATTAADIKSFFSALKPKKTSTFAYAFVITFVSFTLFFAFSPSPNSSSPWFSNIFTSSSTTTTSDNTSGSQFSSIFSYILPNVTSTKPTNRSSDATDSLSVNATSPPLNSNSKNGTLQTPAPETHTPVAKNTTFESPIVNGTNPDAKNNTSSHPLLSDKSSTTGSNNQSRTTADTETVNRNQTTSPAPSKAPVSVDLKTNSSSNSSTASSTPKKQTKTVDLVSSVKQEIEKWSESLKNCEFFDGEWIKDDSYPLYKPGSCNLIDEQFNCITNGRPDKDFQKLKWKPKKCSLPRLNGAILLEMLRGRRLVFVGDSLNRNMWESLVCILKGSVKDETKVYEARGRHHFRGEAEYSFVFQDYNCTVEFFVSPFLVQEWEIVDKKGTKKETLRLDLVGKSSEQYKGADVIVFNTGHWWTHEKTSKGEDYYQEGSNVYHELAVLEAFRKALTTWGRWVEKNVNPAKSLVFFRGYSASHFSGGQWNSGGACDSETEPIKNDTYLTPYPSKMKVLEKVLRGMKTPVTYLNITRLTDYRKDGHPSVYRKQSLSEKEKKSPLLYQDCSHWCLPGVPDSWNEILYAELIVKLNQLSQTQRKT

SEQ ID NO: 374 - protein, 91 aa, Arabidopsis thaliana
MAGLRWREWWNTMAFPTRRIWNRFTVRVGFRHSGLLRLEHDVSSCEYEDIHIMWNLLHKNEDLTRVPIQQQQQQRKKPCWNLLGSYLCQRF

SEQ ID NO: 375 - protein, 221 aa, Arabidopsis thaliana
MANSESSSSPVNEEENSQRISTLHHQTMPSDLTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNRNNNNNNSSQVR

SEQ ID NO: 376 - protein, 433 aa, Arabidopsis thaliana
MSSSVDFVTEQGRCGDDGNGAGETVKNGEIDHLLSEPSAPTISLPTESFLRAATLLKNQVVEATWKGGVEALASGSGPVLDPTVYTGLLGTAFTCLKSYEVTRNHQDLLTCAEIIDTCANVARATTRHVTFLCGRGGVCTLGAIVANYRGDQSKRDFFLGLFLELAEERELPAGPEEGGFGMSYDLLYGRAGFLWAALFLNRYLGQGTVPDHLLSPIVAAILAGGRVGAADHEACPLLYRFHGTRFWGAANGLAGILYVLLHFPLSEEDVKDVQGTLRYMMSNRFPNSGNYPCSEGNPRDKLVQWAHGATGMAITLAKASQVFPKERDFREAAIEAGEVVWKSGLVKKVGLADGVAGNAYAFLSLYRLTGDVVYEERAKAFASYLCRDAIELVNMTSQETEHDYSLFRGLAGPVCLWFDLVSPVDSKFPGYEI

SEQ ID NO: 377 - protein, 197 aa, Brassica juncea
MTTIAGGSFGATSSRISIVTPTLSSSSLFPPLTLHQSGNKKDSQLRCAVQESSTSAVATEKKEKEDSTVEVPAKKPKPAAAKAAVAKPLREMMEEDVIPPLKAILEAQDDISEIDLSFQDDKLEGFFFKKGIQYSFWAFFPTGNLTGAKGFSISSYGSGPSTVEPFLVDERKPTANHVVFWVEKRLAAQGIIPVWNQ

SEQ ID NO: 378 - protein, 234 aa, Unknown
  Sequence found in Organisms: Brassica juncea, Brassica rapa
MASLQQTMLSLQSKLPPSSFHIGGSLPMRKTALPLRTRGGNAAGARMSATAAGSYAMALADVAKRNDTLELTSADVEKLEKVFSDPQVLNFFANPTVELEKKRLVIDEIVKSSALQSHTSNFLNILVDANRINIVRDIVKEFEMVYNKITDTQLAEVRSVVKLEPPQLAQIAKQVQKLTGAKNVRVKTVLDPSLVAGFTIRYGDSGSKLIDMSVKKQLEDIAAQLELGEIQLAA

SEQ ID NO: 379 - protein, 376 aa, Brassica juncea
MELPLLSYTNSASFSRTGLCSSSSSSSSTSINDFLERRRSLRMSFNGGETSRSVKTFAGRSSEGIEKTDGGVGGGGQFAGPAMEVTTFDRGFANSTTVDFPIWDKIGAVDRLTYGIGIYGAMAVAGRFICSVTGIDSSGGFDPSLDALLAGLGYATPPIMALLFILDDEVVKLSPHARAIRDVEDEELRSFFFGMSPWQFILIVAASSVGEELFYRVAVQGALSDMFLRGTQLMTDSRGMASLTGVFPPFVPFAQAFAAVITATLTGSLYFLAASPKDPIYIVAPVLRSRRDDFKKLLSAWYEKRQMKKIYSPLLEGLLAFYLGIEWVQTDNILAPMMTHGIYSTVILGHGLWKIHDHRRRLRRRIERLRSETADE

SEQ ID NO: 380 - protein, 499 aa, Brassica juncea
MEEVTSTLLFIVLITLIFFIGRNRTKLKLKLPPSPPFALPIIGHLRLLKPPLHRVFLALSQSLGGAPIFSLRLGNRLVFVVSSHSIAEECFTKNDVVLANRPHTVASKHVSYDYTTMVTAPYGEHWRNLRRIGAVEIFSAHRLSKFLSIRQDEVRRLIARLARNSSHEFVKVEINSMFSDLTFNNIMRMVAGKRYYGDASEENSEAKLVRKLIADLMSTFGAGNVADYVPVLRWVTGFEKRVKELAGRFDEFLQGLVDERRAAKEKGNTMIDHLLSLQETQPEYYTDRTIKGTILSSILAGTDTSAVTLEWALSSLLNHPEELSKAREEIDSKVGFNRLVEESDISSLPCLQNIVSETFRLYPAGPLMVPHVASEDCKVGGYDMPQGTTLLVNLWAMHRDPQLWDDPETFKPERFEKEGEAHKLMTFGLGRRACPGSGLAQRLVSLTLASLIQCFEWERIGEEGVDMTEAGGVTMHKAKPLVAMCRARTFVGKILHQNA

SEQ ID NO: 381 - protein, 904 aa, Brassica rapa
MFCKESSSGLQTLSIAKSLSSPFHKPSPLINPIWTGRRDKLCRPRNLGGRCKVTASQSNSEPKGNIMKEKVKKIKVKGYIQAEEGTVLEGLRWSRGLDDISDIAGRSLLVELISAETDNRTLMEKDPVEDYAQRVWFDGESPDEKYECEFNMPEDFGTVGAIRIQNQHHRDIFIKERELELPSGSVTFSCHSWVAPKSVDPAKRIFFSSKSYIPSATPEPLKKLRKEELETLQGNNRKKVGEFEKHERVYDYDVYNDVGDPDKNDELARPVIGGLSHPYPRRCKTGRKSSKKDPSTEKREGDFYVPRDEEFSTTKGTAFTGKAILAALPSVFTQLESILLDPKSPFPHFKSIEDLFDVGINLPKDAGLLPMLPKLIKVLSEAQDDLLQFDPPILLNKDRFSWIRDDEFARQTLAGLNPYCIQLVTEWPLQSKLDPAVYGDPNSLITWEIVEKEIRGVMSVDEALKNKRLFMLDYHDLLLPYVNKVRELDDTMLYASRTLFFLSDDSTLRPVAIELTRPPDVNRPQWKQVFTPGYDATSCWLWKLAKTHVVAHDAGYHQLISHWLRTHCCMEPYIIAANRQLSAMHPIYRLLHPHFRYTMEIKASARQSLVNAGGIIETCFWPGKYSLELSSDVYGKLWRFDKEGLPADLINRGLAVEDEKAEHGVRLTIPDYPFANDGLMLWDALKEWITDYVNHYYPDAGLITSDEELQAWWSEVKNIGHGDKKDEPWWPELKTQDDLIGVATTIAWVASGHHAAVNFGQYGYGGYFPNRPTTTRRRMPVEEPTEEELKEFYEEPEKVLLKTFPSQKQATQVMVTLDLLSTHSPDEEYLGEEPEASWIDEPVIFAAYERFKGRLQYLEGVIDERNVNVSLKNRAGAGVVKYELLKPISEPGCTGMGVPYSVSI

SEQ ID NO: 382 - protein, 403 aa, Brachypodium distachyon
MLATASPHLQAAARRLSLAALPARLPRSVRLPRSSTRHPIRHASLRASSSAAEATPSAKDGAAGAEELGFEEMLSRTTRRYYMLGGKGGVGKTSCAASLAVRFANSGHPTLVVSTDPAHSLSDSFAQDLTGGALAPVEGTDSPLFALEINPEKSREEFRTLNQKNGGTGVKDFMDGMGLGILAEQLGELKLGELLDTPPPGLDEAIAISKVIQFLEAPEYSMFSRIVFDTAPTGHTLRLLSLPDFLDASIGKILKLRNKIASATSAIKSVFGQEVQQQDAANKLEQLRERMVKVRELFRDTESTEFIIVTIPTVMAISESSRLHSSLQKESVPVRRLVVNQVLPPSSSDCKFCAIKRKDQTRALDMIRSDPELMGLNIMQAPLVDMEIRGVPALKFLGDIVWK

SEQ ID NO: 383 - protein, 133 aa, Brachypodium distachyon
MADNGGARRQATFTKIDELRPSTHGHNLIVKVLNSKPITFQRPQPRQMRVAECLVGDETGVVVFTARNEQVDVMKSGAIVEVRNAKVDMYKGSMRLAVDKWGIVKAAESPSELTVKEDNNLSLIEFEMITLMV

SEQ ID NO: 384 - protein, 359 aa, Brachypodium distachyon
MPLPCRQQLRPGPNRQRLRQLGSTKKRKKGYAPSTRPLVKGSNLCFLFVKHKYTNSFRVPCSLLIISYSGSAPHRPRRPRHATSPPPGGDQSAIAPMPLPTMTHSSSFLLPSPPAEAAAAADAVAYAVIVLNQRLPRFASLLWTRAQLRVCADGGANRLFDGMPELHPGEDPDEVRARYKPDAIKGDMDSIRPEVKEFYSNLGAKIVDESHDQDTTDLHKCISFITRNPPGPDKANLCILVLGALGGRFDHEMGNINVLYRFSNIKIILLSDESLIFLLPKTHNHEILVDQSIEGPHCGLIPMGMPSSSSTTTGLRWNLDNTSMSYGGLVSTSNIVDDKKVMVTSDSDLIWTISLRNHT

SEQ ID NO: 385 - protein, 562 aa, Brachypodium distachyon
MRGPWRGSSVGEASSRVLDWRKRARMDPDFSRASGGPSYEFAFNSVNFSDRVLRIEIVAGDDTAGAKGATGEGCSSIADWARHRKRRREELRREKESGKHMLDLTNVKVKAEEPDTYEEINEEPVAMIEESPPDIGQDGEDGGSSDSSWNMECNSVLRVKSIYISSAILAAKSPFFYKLFSNGMKESDQRHATLRITASEENALMELLSFMYSGKLTTNQPTLLLDILMISDKFEVVSCMRHCSQLLRSLPMTTESALLYLDLPSSISMAAAVQPLTDAAKEFLSNKYKDLTKFQDEAMNIPLAGIEAILWSNDLQVASEDAIYDFVIKWARAQYPKLEERREILGTRLLPLVRFCHMTCRKLRKVLACNDLDHEQATKSVTDALLYKADAPHRQRTLAADVLTCRKYCERAYKYRPLKVVEFDRPYPQCIAYLDLKREECTRLFPSGRIYSQAFHLAGQGFFLSAHCNMDQQSAFHCFGLFLGMQEKGSTSVTVDYEFAARTRPSGEFVSKYKGYYTFTGGKAVGYRNLFAIPWPSFMADDSLFFINGVLHLRAELTIKQP

SEQ ID NO: 386 - protein, 633 aa, Brachypodium distachyon
MGHWAEPTAIGRIPLPPRSSMASGDPFAAAGDVTGDSSSSSPTTARLLEALAALSQVFESGDPASSGAATAAVVEIFGGSADADAGGDAARPDTANMVSEQLLREVHAFLSCPSSNQMAIDALSLELPKPVAKLGARMGNCRDIAKTIIELLVSNCNPRDMLSILCEALDTPLAFNGSAYFVLILDMLARVLIMIQRRHIEQVKVVLPAVLRVMHAIISECDEEHGTTAVDLFNAALQIGNAIQEMCKTMVNHKKEELCLILGLYSLQNIALISESKHQHILSACGSLVLQHFKIVTFCGFTYLGLLTGNEVTSATNKLSKEEDADFLGCFSFTVEGASLLAVWTYMHDDMSKYAGAELESAIKEVQDNYIRKWEAINMFRYVLSSVNYPWVIKSYSIDLLLTLVDENCIEETKDHEDFLYSTQFFATLKAIESVMIAAPDPLMRKKAFATLKKVISVVPSSQRFDILQSLIKNSMFPSLTAIHLDLVKNEVVRESSRAKDLIESDQSQDAGDSPHWASQSLELVELILRPPEGGPPCLPDHSEQVLSALNLLRLILIIDSRGSRSLKLFRQETTRKVYSEWLIPLRPVVAGVQSEMEKDDSEGANQMMCMLNPVQLVLHRCIELVEEKMKGS

SEQ ID NO: 387 - protein, 181 aa, Unknown
  Sequence found in Organisms: Brassica napus, Brassica rapa
MASSDVALLSSRIQFRSSSSIRYALPTIFNLSSPAASSCATKSTQFLKRRLRAKSTNFSLSSLPRRRFVCRAAEYKFPDPIPEFAEAETKKFRDHMAKKLSKRDLFEDSVDEIVGVCTEIFETFLRSEYGGPGTLLVVPFIDMADTLNERELPGGPQAARAAIKWAQDHVDKDWKEWTGTD

SEQ ID NO: 388 - protein, 322 aa, Brassica napus
MFLLKTWRSTAFGIYGYMNFTKNGFLDHSKKFKPEDMQIQIQGKNCVVTGANSGIGYAAAEGLASRGATVYMVCRNKERGEEALSKIQNSTGNQNVYLEVCDLSSVNDIKSFASSFASKDVPVHVLVNNAGLLENKRTTTPEGFELNFAVNVLGTYTMTELMLPLLEKASPDSKVITVSSGGMYTSPLTTDLQFSGEKFDGVLQYARNKRIQVALTEKWADKHKNKGIGFYSMHPGWAETPGVARSLPSFKESFSGKLRTSEEGADTVVWLALQPKEKLVSGAFYFDRAEAPKHLTLAGTSKSHDLIDSVIDTLHSMAALDP

SEQ ID NO: 389 - protein, 665 aa, Brassica napus
MAARTLHSLSTSPLFLLLLLSALSPPTKAQQPYVNNHQLACENRDFDNITNGFTCNGPRSCRSYLTFWSLPPYNTPNSIATLLNASAAEIQSINNLTSLTTVIPTRRLVVIPTTCSCSGGGGFYQHNATYRLSGERQETYFSIANDTYQALSTCQAMMSQNPYGERNLTAGLNLLVPLRCACPTANQTAAGFRYLLTYLVAQGDSVSAMAEMFRSSTPAGSSGNELTSDNIYFFTPLLVPLRTEPTRIVITPPSPTPPVATPPQSPPVDPPGGSSSSHKWIYIGVGIGAGLLLLISILSLYFCYYKRRSKTSSLIEQNKLTDSSTKQSLPTTSTNQWSIALSNSSDTTSGLKSAIESLTLYRFSDLQSATSNFSEENKIKGSVYKATINGDDAAVKVIKGDVSSSEISLLKKLNHSNIIRLSGFCIREGASYLVYEYSENGSVSDWLHSSNKKKSLTWRQRVEICRDIAEALDYLHNYVTPPHIHKNLESNNVLLDSNFKAKISNFGVARILDEGDLDLQLTRHVEGTQGYLAPEYVENGVITPKLDVFAFGVVVLELLSGKEAVTTVDKEEKEEMLLCREINNVLGGENVREKLKEFMDSSLGDEYPLELAFTMAQLAKSCVAPDINSRPSIAQVLTTLLMIVSSSIDWEPSHDLLHDSGSLGN

SEQ ID NO: 390 - protein, 867 aa, Brassica napus
MAYRFPLHSSSPHSRFLSPSNHPKTPRSPRKHHTSISCQNTNDPQDEEKSKINLLAIPITLTLISASLPQPSLAAATKKRSQKKKPQEALTPEQLKSWSKDLPVVSKRIPYTDLLTLKSQGKLKHVIKPPSLTLRLKAEPVLVVLEDSHVLRTVLPSIDGNKRFWEQWDELKLDSVCVNAYSPPVKKPPVPSPYLGFLWRVPSYMLTLAKPKKESKRAAELKRMREDFKRQRKEEMERMNEESEAMEKAIKAQKKMQERKKRKAVRKKKYEESLLEARRNYRDMGLMWARLAEDSNVATALGLVFFYIFYRVVVLNYRKQKKDYDDRLKIEKAEAEERKKMRELEREMEGIELDDEEEESGEKNPYLQMAKQFMKSGARVRRASSNRRMPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARDNAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEIAAINMMRDGRTELTTDDLLQAAQIEERGMLDRKDRSSETWRQVAINEAAMAVVAVNFPDLKNIEFLTINPRAGRELGYVRVKMDHIKFKEGMLSRQSLLDHITVQLAPRAADELWYGEDQLSTIWAETSDNARSAARSLVLGGLSEKHHGLNNFWMADRINDIDVEALRILNMCYDRAKEILQKNRTLMDEVVDKLVQKKSLSKQEFFTLVELYGSIKPMPPSILELRKIKRLQLQEAVMKQDMTSARNS

SEQ ID NO: 391 - protein, 250 aa, Unknown
  Sequence found in Organisms: Brassica napus, Brassica rapa
MAIARLTLAPLLLIAAVILSTETSAQPAAPAPGPAGPINLTAILEKGGQFTTFIHLLKITQVGEQVNIQVNSSSEGMTVFAPTDNAFQNLKAGTLNKLSADEQVKLILYHVSPKFYTLDDLLSVSNPVRTQASGRDNGVYGLNFTGEANQVNVSTGYVETRVSNALRSQRPLAVYVVDMVLLPGEMFGEHKLSPIAPAPKSPTTGVSDDDTKSNSSKKAAAPADKSASGERRVGLGFGFGLVVLCLKFLF

SEQ ID NO: 392 - protein, 250 aa, Brassica napus
MAAAKAGLVPWIIPSSSAATSSPLFSAAVKLPLRGRKAEKDVSVSVAFNPSGNFDISAFDSHDDTDKVEPPMPPTSGRYEVVIDNDSIQRLDLSPFQTATGITSPSSADPREYLDRSIGFTINYRREDAGDPRELSEYPDIRLWFVRLDATYPWLPLLLDWRAGELARYAAMLVPHQMSLRMGVVFNPEALELFVMSKVFVVYPWLKRHAVPKPRLKTSDMARMLGFGIGDQLFDLIDQYDHYQTTTDSL

SEQ ID NO: 393 - protein, 363 aa, Brassica napus
MAPLPISSIRAGKIDDVQELIKSKPNKVPERFIREANERGVLVSHKTHLHHHIPVVDLSKLSKPHTDDDFLFEILKLSQACEDWGFFQVINHGIEVGVVEDIEKVAKEFFEMPLEEKKKYPMEPGTVQGYGQAFIFSEDQKLDWCNMFALGVHPPSIRNPKLWPSKPARFSENLEGYSKEIRKLCKRLLKYIAISLDLKEERFEEMFGEAVQAVRMNYYPPCSRPDLVMGLSPHSDGSALTVLQQSKNSCVGLQILKDNTWVPVLPLPNALVINIGDTVEVLTNGKYKSVEHRAVTNRERERLTIVTFYAPNYEVKIEPMGELVDDETNPCKYRSYNHGDYSYHYVSNKLQGKKSLDFAKILN

SEQ ID NO: 394 - protein, 240 aa, Gossypium hirsutum
MASLQQASISLQPKLLSSSQHPRSLPSLNLSFSATFPSLKLCTTRPLHGGAKMSASAASSYATALADVAKSNNTLDATSSDVEKVEKIFSDPQVLEFFTNPTIDVLKKRQVLDEIVSSSELQPHTANFLNILVDAKRIDLIKEIVKEFELVYNQLTDTELAVVSSVVKLESQHLAQIAKQVQKLTGAKNVRIKTMIDPSLVAGFTIRYGSSGSKLIDMSVKKQLEEIAAQLDLGDIQLAV

SEQ ID NO: 395 - protein, 692 aa, Gossypium hirsutum
MVRFSCFNAHIGSQKPKKTVQPSVEAMHTTIEDFSQVQAPKELTKAANMDSFFPETQTTAEIHESVEPVTVSSSPNPSWKSEDIKDGVILDSSSRVLQNPHYLKKCRSLGSGLCLEGRVPGQNDTDDQTDQGFSSDSHDHGLVEDGSKHIAVSQNASFSESVQVSSNHVYNEPVFSIGDSLLPEKDGHDISNLPLPCERANASGDHSPNNAPVIVKSCSMPNIVASALLFGGHSPPKCLARRTRSSEDVHVLSMRQKETLIHDVDTEVMREQERDDGMHKNHKTNFESSYEGFESYSCSASAKDWIVPVSDEVSSMKMLQEELRVLNRNELTGKDFKIKRIEDWVNGLQHVRPSEDSVELSHPNDQVKAEPAVYNDLTAAKVDVKVTPGMEAAKRYISSLSASATTAQLANHGLVVIPFLSAFVSLKVLNLSGNAIARITAGALPRGLHMLNLSRNNISTIEGLRELTRLRVLNLSYNRIFRIGHGLASCSSLKELYLAGNKISEVEGLHRLLKLTVLDLRFNKISTAKCLGQLAANYNSLQAIGLEGNPAQKNVGDENLKKHLQGLLPNLVYFNRQAIKVSTVKDGAERSVRLGISAHQFDRGLRSEHRATRKNSHGTSIHRPSSSSTRGHKSQVASPMQSRGRHGRYPPSGAKATNNRQNHHVDLGSKVLNFKSELSMRRTQSEGTLGLL

SEQ ID NO: 396 - protein, 352 aa, Lotus japonicus
MASSSFVTLLLISSFLSFSHIRVSEAATAPIVKGLSWTFYDSSCPKLESIIRKELKKVFDKDIAQAAGLLRLHFHDCFVQGCDASVLLDGSASGPSEKDAPPNLTLRAQAFKIIEDLRSQIEKKCGRVVSCADITAIAARDAVFLSGGPDYELPLGRRDGLNFATRNVTLDNLPAPQSNTTTILNSLATKNLDPTDVVSLSGGHTIGISHCSSFTDRLYPSKDPVMDQTFEKNLKLTCPASNTDNTTVLDLRSPNTFDNKYYVDLMNRQGLFFSDQDLYTDKRTKDIVTSFAVNQSLFFEKFVVAMLKMGQLNVLTGSQGEIRANCSVRNADKKKSFLTTVVEEVVEELIEM

SEQ ID NO: 397 - protein, 265 aa, Medicago truncatula
MSAIARLRAISPSLKTLNRPFGSAAALQYSYDDDEDEDLNYNAPRGMLDTEGSAPERGIQWVMIGEPGAKRHVFAERLSKLLEVPHISMASLLHQELNPRSSLYQQIAGALDHGKIVPEEIIFALLSKRLEDGYDRGETGFILDGIPRTRMQAEILNHVAHVDLVVNFKCPQEELMKNKLGLRKFTSCQEHIFKTSSWTPTKQSQDEYVQKRAEESKMLEDYYRKQKKLLNFEVAGGQGETWQGLLAALHLQHINALSSSQKLTA

SEQ ID NO: 398 - protein, 350 aa, Medicago truncatula
MASASTTITSSFLSTPSSLTEKPSSFNQTLSLGFKPRHSISVSASAAPSPPPSYDLNAFKFAPIKESIVAREMTRRYMTDMVTHADTDVVIVGAGSAGLSCAYELSKNPNVKIAIIEQSVSPGGGAWLGGQLFSAMVVRKPAHHFLDELEIEYDEQDDYVVIKHAALFTSTIMSKLLARPNVKLFNAVAAEDLIVKNERVGGVVTNWALVSMNHDTQSCMDPNVMESKVVVSSCGHDGPFGATGVKRLKSIGLIDTVPGMKALDMNTAEDAIVRLTREVVPGMIVTGMEVAEIDGAPRMGPTFGAMMISGQKAAHLALRALGLPNAVDHAGNIHPELVLAAADSADIAEA

SEQ ID NO: 399 - protein, 580 aa, Medicago truncatula
MAAVTSSCSTAISASSKTLTKPTTTSFAAANLSFSKLYPQSVKARRCIAVGGAVGARMVSAPPATLPAKLDFETSIFKKERVNLAGHEEFIVKGGRDLFHLLPDSFKGIKQIGVIGWGSQGPAQAQNLRDSLAEAKSDIVVKIGLRKGSRSFNEAREAGFTEESGTLGDIWETISGSDLVLLLISDSAQADNYEKIFSHMKPNSILGLSHGFLLGHLQSVGLDFPKHFSVIAVCPKGMGPSVRRLYVQGKEINGAGINSSFAVHQDVDGRATDVALGWSVALGSPFTFATTLEQEYKSDIFGERGILLGAVHGIVESLFRRFTENGMSEDLAYKNTVESITGVISKTISTKGMLAVYNALSEDGKREFEKAYSASFYPCMDILYECYEDVASGSEIRSVVLAGRRFYEKEGLPAFPMGKIDQTRMWKVGEVVRSTRPAGDLGPLYPFTAGVFVALMMAQIEILRKKGHSYSEIINESVIESVDSLNPFMHARGVSFMVDNCSTTARLGSRKWAPRFDYILTQQALVAVDNGAPINQDLISNFMSDPVHGAIEVCAELRPTLDISVPADADFVRPELRQSN

SEQ ID NO: 400 - protein, 335 aa, Medicago truncatula
MATVLRTPTFRPSPTLLTTAATSSNHSRTSRVSVASSRRRPSPLKSHRFSSIPTLRFAKLVPFAFDGDTEAPQVQDSPEVQVLDSTDGAADVEESTGDDEVSDAGEIPASPLIVLLQSYKEALANNDSVKVAELESSLKSIDDEIVGLEGKIASLSEELSIEKDRKLRIGADFDNYRKRTDRDRLSLVTNAQGEVVESLLPVLDNFERAKAQIKVETEGEEKINNSYQSIYKQFIEILNSLGVEPVDTVGNPFDPMLHEAIMREDSDEFEDGIILQEFRKGFKLGDRLLRPSMVKVSAGPGPAKPEQEVPQEEEVTNETSQDSKDNDGNTETESA

SEQ ID NO: 401 - protein, 927 aa, Medicago truncatula
MALTKEFMGSSLVERPIFPSSSPCFQQKNGSFLISPVFVPYGNKRVVRLRKSAKFPVAAISEDLMKSSSSSSSISSSSSSVPAEKPVKFKVRAVVTVRNKIKEDFKETFVKHLDAFTDRIGRNVVLELFSTEIDPKTNAAKKTNEAVLKDWSKKTNIKAERVNYTAEFTVDSNFGEPGAITVINNHQQEFYLENITIEGFATGAFHFPCNSWVQARKDLPGKRIFFSNKPYLPDDTPAGIKLLREKDLKNLRGDGKGVRKLSDRIYDYDTYNDLGNPDRGIDLARPTLGGSEMYPYPRRCRTGREPSDTDITCESRVEKPLPMYIPRDERFEESKMNTFSVKRLKGVLHNLLPGLKSSLSAQNKDFNEFSDVDGLYSVGLLIKLGLQDDILKKLPLPHIVSKIQESTSQGILKYDIPKIISKDKFAWLRDDEFARQAIAGVNPVTIERLTVFPPVSKLDPEIYGPQESALKKEHILNQLNGMTVQEAIDQNKLFIIDYHDIYLPFLERINALDGRKSYATRTIYYLTPLGTLKPVAIELSLPPSGPNTRSKRVVTPALDATTNWMWMLAKAHVCSNDAGVHQLAHHWLRTHACMEPFILSAHRQLSAMHPIFKLLDPHMRYTLEINALARQSLINADGVIESCFTPGRYAMEISSAAYKTNWRFDQDSLPQDLIRRGMAVPDPTQPHGLKLIMKDYPYAEDGLLIWSAIENWVRTYVNYYYPNPSLIINDRELQAWYSESINVGHADMKDESWWPRLNDSDNLVQVLTILIWNASAQHAALNFGQYPYGGYVPNRPPLMRRLIPEENDPEYTSFISDPQKYFLNALPSLLQATKYMAVVDTLSTHSSDEEYLGERQQPSIWTGDAEIVEAFYQFSAEIGKIEKVIDSRNCDRNLRNRCGAGVLPYELLAPSSGPGVTCRGVPNSVST

SEQ ID NO: 402 - protein, 90 aa, Medicago truncatula
MAWRSGSLSRSIFSAARSIPTRSSLQHSSTSSIRSHLLQPRRPLVTVPRALGILGCTQSLMPLHNADAAARLTSHVSVELRACCELSQGT

SEQ ID NO: 403 - protein, 183 aa, Medicago truncatula
MVCIRKATVNDLLAMQACNLFCLPENYQMKYYLYHILSWPQLLYVAEDYNGRIVGYVLAKMEEETNECHGHITSLAVLRTHRKLGIATKLMTAAQNAMEQVFGAEYVSLHVRKSNRAAFNLYTETLGYKIHDVEAKYYADGEDAYDMRKQLKGKTIHPPQHHHHHHHHGGGCCSGETKGNAKA

SEQ ID NO: 404 - protein, 643 aa, Medicago truncatula
MGRRHGWELPFHTFQVVAITVFFLLCIAYYAFFAPFLGKDIFEFVAFGVYSLLALSVFFLYVRCTAIDPADLGVMIDCDKTSKNRSKLDEELAEPSKTRLKDDGISDQHDSNGCSKLGCCLCSFLAREDCRSDEDFILQQQSGEEDALFCTLCNAEVRKFSKHCRSCDKCVDGFDHHCRWLNNCVGRKNYISFVCLMAVSLVWLLVECGVGIAVLVRCFVDKKDTENLIAVKLGAGFSRAPFATIVAICTAVSFLAIIPLGELFFFHMILIRKGITTYEYVVAMRTLTEPPGPSVDAGEQQSLPSSPTGSSVTAISGRSSVGMSLQIKGAWCTPPRIFMDQQDEIIHHLEPGRLPSTVDPDAIQPPDKGKKLNQRPVRISAWKLAKLDSNEAAKALAKARASSSVLRPISSRSHAYDVDHLSSSNLSGRSSPISNRGFHNKYDQAGTSRLSPSKSSYPPSQASREDLDACHHSMSNLSSPQVSNISPSPMQRPGLNRDHFNPMYQQPSINQSPSSVRGSEGSVNPVHENGARVAMRNNSLAVLEDRRSSVFWDQAAGRFVPNPSRAQGSSQIPGTELTYSGRSIFFGSPAVSEQSNAGTRNSSSVAGVSDRDNTIRDFQQGRSHRGAQLPVFVPSYSQQNKFS

SEQ ID NO: 405 - protein, 355 aa, Medicago truncatula
MAATHGKIILFMFLAAFMLFNTQNAFVSCALTSELQNKIAKINEEGPYLGLIIPNSFELNPLLQNPGYTPSDSIIDFAGRRFRFGSIGEKPVILVMTGLSVINAAITTQLLLSFFKVDGVVHYGIAGNANPSLHIGDVAIPHYWAHLALWSWQRYGQDADDTLPLEINGDYTRDVGFLKFSDFTSNISAANSFTVNNHLNNLWYQPEEIFPVDGIPEQRQHALWVPVDSKYYRIAKKLEQMKLEACIDSDTCLTTTPKVVLVERGTSAGFYLDNAAYRTFIFNKFNVSPVDMESASVALICLQQRIPFIAIRALSDLAGGGTAESNEADTFSPLAATNSVAVVIEFVKLLSNHTK

SEQ ID NO: 406 - protein, 75 aa, Medicago truncatula
MSSCGCGSSCNCGDSCKCNKRSSGLNYAEGETTETVILGVGPAKIQFEGAEMGVAAEDGGCKCGDSCTCDPCNCK

SEQ ID NO: 407 - protein, 178 aa, Medicago truncatula
METVMEDVEEYNYREVKLPSLIPIVPEPELERETGERRRGRDIVLAIDHGPNSKHAFDWALIHLCRLADTIHLVHAVSDVKNQTVYDLTQGLMEKLAVEAFQVSMVKTVARIVQGDAGKVICKEAERIKPAAVVLGTRGRSLFQSVIQGSVGEYCFHHCKAAPVVIVPGKDAGDASIV

SEQ ID NO: 408 - protein, 169 aa, Medicago truncatula
MALVTGRSSALNPNAPLFIPAAFRQVEDFSPQWWELVKSSTWFHNYWLSQHKEEDFVESGGNDATNDDDIEHMLSETFDLGIEEDFNFLDNEFEKLVMSDEAQECPVMDEPVEEKKPVHGVNKDAAALIKILSPKERGSKSPIGSPKQFEKPAQYVNLKCAPQRIHQPR

SEQ ID NO: 409 - protein, 372 aa, Medicago truncatula
MASSDSNATNMLQAIRYNRGSLQLLDQTKLPLESVYLEIRDSNDGWNAIRDMVVRGAPAIAIAAALSLAVEVSNLDDFNGSTDDAVYFLQKKLDYLVSSRPTAVNLSDAATKLKEIISKAAATTSEAKGVFQAYLEAAEIMLEDDVASNRAIGTYGASFIQNQTEKLKLSVLTHCNTGSLATAGYGTALGVIRALYSGGVLERAYCTETRPFNQGSRLTAYELVHDKIPATLIADSAAAALMQAGRVDAVVVGADRVASNGDTANKIGTYSVALCAKFHNVPFFVAAPLTSIDLSLSSGQQIVIEERSPKELLNMRGGLGEQVAASGISVWNPAFDVTPANLISGIITEKGVITKTPAGDAFDIKAFVQKTG

SEQ ID NO: 410 - protein, 228 aa, Medicago truncatula
MEGIVKSLYLPKIPKSQTCSGSLLNSPLLLHSNATSVTFNSATHHLHKCFLFQQPGGVIHPKAQEKVNLGAIHASKATTPTTTTTQRWILEPVGDGDSRHIGFKVERPGAYEITSNEVTVGRVPEKADLVIPVATVSGVHARIRIKQDNLLVIDLDSTNGTFIGDKRLKPGVVTTVSSGSYITFGDTNLAMFRVSKIEEKAADTVGEPEGELENDGKSDSTETSSTSS

SEQ ID NO: 411 - protein, 281 aa, Medicago truncatula
MENGHKFQEVSNPKYDCLLFDIDDTLYPLSSGISAQTAKNIEEYMLQKLGMEAATVPELCYSLYKTYGTTMAGLRAIGYDFDYNDFHSFVHGRLPYNLLKPDPVLKGILQSLPFRKVLFTNADMGHASRVLKRLGLEDCFERIISFDTLNSSDSIIPSNEKVGSEIFDFCEYTRRPDSDTVLPKTPVVCKPFEDAFEKAFKLADIDPQRTLFFDDSIRNLQTANRLGLHTVAVGTSVRSTGVDHALESIHNIREAFPELWEVDEKHEIVNYKVAIETTVKA

SEQ ID NO: 412 - protein, 410 aa, Medicago truncatula
MGNCLDSSAKVDAAQSSRSTSGTSKTTPSSLTIPSYSDKSNSSSLLPTPRSEGEILSSPNLKAFSFNELKNATRNFRPDSLLGEGGFGHVYKGWIDEHTFTAAKPGSGMVVAVKRLKPEGYQGHKEWLTEVNYLGQLHHPNLVKLIGYCLEGENRLLVYEFMPKGSLENHLFRRGPQPLSWSIRMKVAIGAARGLSFLHNAKSQVIYRDFKASNILLDAEFNSKLSDFGLAKAGPTGDRTHVSTQVVGTQGYAAPEYVATGRLTAKSDVYSFGVVMLELLSGRRAVDKTIAGVDQNLVDWAKPYLGDKRRLFRIMDSKLEGQYPQKGAFMAATLALQCLNREAKARPSMTEVLATLEQIEAPKHASRNSLSEHHRVHAPVRRSPARNRTPSYVTPTASPLPSVRQSPRAH

SEQ ID NO: 413 - protein, 699 aa, Medicago truncatula
MKVAEKSLDPQLWHACAGGMVQMPSVNTKVFYFPQGHAEHAQSNVDFGDSFRIPPLILCRVASVKFLADSETDEVFSKITLIPLRNSELENDDSDGDGSENSEKPASFAKTLTQSDANNGGGFSVPRYCAETIFPRLDYSAEPPVQTVIAKDVHGEVWKFRHIYRGTPRRHLLTTGWSSFVNQKKLVAGDSIVFLRAESGELFVGIRRAKRGIVNGLETPSGWSSGNGNCGLGPYGGAFTAFLREENKLGGVGGNLGGGRVKVSGESVKEAMRLAASNQTFEVVYYPRASTPEFCIKTSAVKAAMRIQWCSGMRFKMPFETEDSSRISWFMGTISSVQVVDPIRWPNSPWRLLQVTWDEPDLLHNVKRVSPWLVELVSNMSMIHLAPFSPPRKKLRFPQHPDFPLDVVQFQIPTFSGNPFNPLCCLSSSDNYNAPAAGIQGARHAQIGISLSDLHLNNNKFQLGVFPNNRETISNVSNITTNHDNKSKESISCLLTIGNSHKRSLEIKSDNNDNRHQFLLFGQPILTEQQISRKDSSDDVLLSKKKDKEKWFFSDTTQSSISEQFSPAKSSTTSASADFCWQLGLDTGHCKVFLESEDVGRTLDLSCVGSYEELYRKLAKMFGIERSEMLSRVLYRDATGAVKQTGEEPFSDFMKTAKRLTILMDSGSKDTRRVCITGTRNAERGLDASNKTGPMSIFV

SEQ ID NO: 414 - protein, 318 aa, Medicago truncatula
MIISHPFTPFPSCITITCSKPFSHNNHFIKSYIPPFLLLRNARSSTLLCSARSGRNENSNSLDFDIDINEEDQVLENDDYGGFSAQGMETNDIIDVDEGQDDGDGRRYSGGGPYKGRDEKDFDRNPEFAEILGDYLDDPEKAQSRMEERLRKNRNKILHTKTGSGVPMKVSFNKFDFSNSYIWFEFYNAPLAKDINLICDAIRAWHIVGRLGGCNAMNMQLSQSEIEKRPSYDYIQGANVTPTTFYNIGDLEVQDNLARIWIDIGTNEPLILDVLINALTQISSDFVGIKQVVFGGEEFENWKEDLTSEDSGYGVHKI

SEQ ID NO: 415 - protein, 934 aa, Medicago truncatula
MLHNKSFVKKTKGGKVIRQVREHYLRDDIYCGAPSCTICNTSGARLSASPSTILVLDTNVVLNQIDLLENPAIDDVVVLSIVLDEVKNKNLSVYNRLRAICSNPMRKFFVFSNEYHRDTYVKEMSGETKNDRNDRAIRVASQWYQKHLGDAIKVLLVTNDKENKRKASEEGICAETVESYVKSLDRPDLLDLLVRPSSEDVEMEDVEDHRPSKRKIIYAEHKPMSEITSGLHRGIYHQGKLRVNRYNPFEAYVGSESIGDEIIIYGRSNMNRAFDGDIVAVELLPQDQWQGEKSMSIASEEDEDDDDVHLAPNSADVAPRTIPQQSSTGEINAGSGRPSGCIVGIIKRNWQSYCGSLEPMPIPGGSRGVAYALFVSKDRRFPKIRIQTRQLENLLDKRIIVSVDSWDRQSRYPSGHYVRTVGKIGDKDTETEVVLIENDINSRPFSAQVLACLPPLPWSVSSEDLSIPFRQDLRHLRVFSVDPPGCKDIDDALHCIALPNGNFDVGVHIADVTNFVFPGTPLDDEASQRGTSVYLVEKRIDMLPKPLTEDVCSLRSDVERLAFSVIWEMTPEADIISTRYTKSVIKSAAALSYVEAQARMDDSRLMDPVTTDLRNMNSLAKKMRLRRIENGALTLASAEVKFQIDTETHNPLDIGIYQIKEANQMVEEFMLAANVSVAQQILKSFPLCSLLRRHPTPTKEMLEPLLRVSAAIGLNLDVSSSKALADSLDHAVGDDPYFNKLIRILTTRCMSQAVYFCSGDLSPPEYHHYGLATPLYTHFTSPIRRYADVIVHRLLAASIGISKLPSVFQDRLQLTSIADNLNYRHRNAQMAGRASVELNTLIYFRTRPTDTEARVVKIRSNGFFVFVPKFGIEGPVYLTTRAEKGSGEWYVDEQEQKIKKMDGSFSYSILQTVQIHLEVVEPQPNRPKLQLTLI

SEQ ID NO: 416 - protein, 588 aa, Medicago truncatula
MAKMNPLFILAFFFFFSTVRSDSSDKRYKEGDLVPLFANKVGPFHNPSETYRYFDLPFCIPDHLKEKKEALGEVLNGDRLVSAPYQLEFQKDKDSLSVCKKTLTKEEVANFRSAVRKDYYFQMYYDDLPIWGFIGKVDKEGKDPSDYRYYLYKHIHFDIFYNKDRVIEINVRTDPNALVDVTEDNEVDVEFFYTVKWKETNTPFEKRMDKYSQPSSLPHHLEIHWFSIINSCVTVLLLTGFLATILMRVLKNDFVKYAHDEETAEDQEETGWKYIHGDVFRFPKFKSVFAAALGSGTQLFTLTVFIFILALVGVFYPYNRGALFTALVVIYALTSGIAGYTATSFYCQLEGTNWVRNLLLTGCLFCGPLFLTFCFLNTVAIVYNATAALPFGTIVVIVLIWTLVTSPLLVLGGIAGKNSKAEFQAPVRTTKYPREIPPLPWYRGAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICFGFFLMLGTVGFRAALFFVRHIYRSIKCE

SEQ ID NO: 417 - protein, 324 aa, Medicago truncatula
MAFSSSMWSSLFVPNPNKTNRFATFSPSSHSKLLTTTFAIPPLSTATAADVTGAIDGTTVAVISGGFVAGLTALLSLSDPERRRREQAEEVGGDDKEVVREYFNNNGFQRWKKIYGDTDDVNRVQRDIRLGHSKTVENALQMLKDEGSLQGVTICDAGCGTGSLSIPLAKEGAIVCASDISAAMVAEAEKLAKEQLVSSENGVSPAMPKFVVSDLESLDGLYDTVVCLDVMIHYPQSKADGMIAHLASLAEKRLILSFAPKTFYYDALKRVGELFPGPSKATRAYLHSEADVERALRKVGWTIKKKGLIATQFYFAKLIEAVPM

SEQ ID NO: 418 - protein, 430 aa, Medicago truncatula
MATLNVFSQPLHPTTISSSLCSSSSSNSTFSCHFSLLSSHSSPTLSKLSNHVHTHFSKSGNGSSWLQSSSTADSIAHKKGPVYSVFPSSPAQVSSVQDLYEFICSGPLLYKIGLTPEKVAESIDKWLSYGRQLCRLFQLNELFLTEPQKVRLYHYYIPVFLWCESEIAQHQAKFKDKEDIPPLVIGFSAPQGCGKTTLVFALDYLFQMIGRKSATISIDDFYLTAEGQNKLREANPGNALLEYRGNAGSHDLPFSVETLTALTKMSREGTKMKLPRYDKSAFGGRGDRADPSTWPEIEGPLTVVLFEGWMLGFKPLPVEAVKAVDPQLEIVNKNLKAYYDAWDKYIQSWIVIKIKDPSCVYQWRLQAEIAMREAGNPGMSDDEVRDFVSRYLPAYNAYLPTLYSEGPSGSDPQHLLNIEIDEKRNPILGV

SEQ ID NO: 419 - protein, 321 aa, Medicago truncatula
MDSSSNEVVLDLSPMIKIYKDGHIERLIGSDIVPPSFDPTTNVESKDILISKDQNISARIFIPKLNNDQFPNQKLPLLVYFHGGGFCVETPFSPPYHNFLNTIVSKANVIAVSVDYRRAPEHPLPIAYEDSWTSLKWVVSHLHGNGSDEWINRYADFGKMFFAGDSAGANIANHMAIRVGTQGLQGINLEGIVLVHTFFWGVERVGSEATEKSEHLSLADNLWRFVCPTSSGSDDPFLNPGKDKNLGRLGCKRVLVCVAENDSLKDRGWYYKELLEKIGYGGVVEVIETKGEGHVFHLFNPNCDNAISLLNQIASFINHSG

SEQ ID NO: 420 - protein, 256 aa, Medicago truncatula
MEMEGYDIFGDATERIGKNGFEVNNEVIGSGYGSSFSLVLDRERGELVEEPVKMEGKGVSTTERSVEALKNHSEAERRRRARINAHLDTLRCVIPGALKMDKASLLGEVVRHLKELKRNETQACEGLMIPKDNDEISVEEQEGGWNGFPFSIKASLCCEYQPGLLSNIRQALDALHLIIMKADIATFGDRMKNVFVVISCEEQNFDAAEYRQFLAGSVHQALKSVLSRFSVSQDMLRARKRRRVSIFSSSSLENFL

SEQ ID NO: 421 - protein, 653 aa, Medicago truncatula
MAPATKKKPSKPVKPQKAPKKVQIVPIKDDSTSESEEEEAPPLQHLELDGSDSDLSSDGDDQLADDFLQGSDDEDDDNDDEGSDLESGSGSDEDEDSESGEEDIARKSKLIDRKRERDSQAAADELQTNIQTNIQDESDEFTLPTKQELEEEALRPPDLSNLQRRIKEIVRVLSNFKALRQDGATRKDYVDQLKTDIRSYYGYNEFLIGALVEMFPVVELMELIEAFEKPRPICLRTNTLKTRRRDLADVLINRGVNLDPLSKWSKVGLVVYDSQVPIGATPEYMAGFYMLQSASSFLPVMALAPQEKERIVDMAAAPGGKTTYIAALMKNSGIIFANEMKVPRLKSLTANLHRMGVSNTVVSNYDGKELPKVLGFNSVDRVLLDAPCSGTGVISKDESVKTSKNLEDIKKCAHLQKELLLAAIDMVDSYSKSGGYVVYSTCSIMVAENEAVIDYVLKRRDVKLVPCGLDFGRPGFTKFREQRFHPSLDKTRRFYPHVHNMDGFFVAKLKKMSHPKPARTSETFEKDEKETELVIDDDKPSNGVEENGKHSFELESKKRKKDKFPSKPSNDVKANVKEASEPESKKRKKDKFPSKPSNDVKANVTETSEPKPKRVKRKPPSREEISKAREEKRLALIEKKRKSGKQQRGKNDE

SEQ ID NO: 422 - protein, 226 aa, Medicago truncatula
MVPKMLKFSRMLHSSSRNHLLEVLYARDFSTATNNNYSAKGYTSDRIFAPYSVYKGKAAFSLSPCLPTFTKLDSGALVVDRHGSIMMSFMPAIGERKYDWEKRQIFALSATEVGSLIAIGPQDSCEFFHDPSMKSSNAGQVRKSLSIKPHSNGYFVSLSVVNSVLNTKDNFSVPVTTAEFAVMKTACSFALPHIMGWDRLTNQQSSGTVSFQPKMNSQILDLEWEK

SEQ ID NO: 423 - protein, 172 aa, Medicago truncatula
MASSSTSSANREGHYRGVRKRPWGRYAAEIRDPWKKTRVWLGTFDTPEEAALAYDGAARSLRGAKAKTNFPPAPVAGGLCLDLNAPSSDLRWPSVPSRGRVLTEFLQTGVLKDFNPPPPPPIGGVVGQRHNEVTLAVAGRTMVAENSPTAAYLGLVRRGIPIDLNEPPPLWL

SEQ ID NO: 424 - protein, 720 aa, Medicago truncatula
MAGIPITSSNYNYASSIHSLPLFFARTNFTTTINISPTSSFRVFCHTQSKTKKTEIRRFSPLLESSGNGGVALDEWKAVPDIWRTSAEKYGDKVALVDQYHDPPSTMTYKQLKDAILNFAEGLRVIGVKPDEKIALFADNSCRWLVADQGMMAIGAINVVRGSRSSIEELLQIYNHSESVALAVDNPEMYNQIAKPFYLKTSIRFIILLWGEKSSLVNEADKGVPIYTFMEVINFGRQSRRALHTSDDAREHYIFETIKLDDIATLVYTSGTTGNPKGVMLTHQNLLHQIKHLSDVVPTTEAGDKFLSMLPPWHAYERACEYLVFSRGLEHIYTTVRNLKDDLGRYKPHLMVSVPLVFETLYSGIMKQISTSSLVRKLVALTFIRVSLGYMECKRIYEGKCLTKNQKAPSYLYAMLDWLWARIMATILYPVHMLANKLVYSKIRSTIGISTAAISGGGSLPSHVDKFFEAIGLNLQNGYGLTETSPVIAARRLGCDVIGSVGYPLKHTEFKVVDSETGEVLPPGSKGILKVRGPQLMKGYYKNPLATNRVIDSDGWLNTGDIGWIAAHHSTGRSRNSGGVIVVEGRAKDTIVLSSGENVEPGELEEAATRSNLIQQIVVIGQDKRRLGAIIVPNKEEVLKAAKELSIIDSNSSDVSQEKVTSLIYNELRTWTSGFPFQIGPILLVNDPFTIDNGLMTPTMKVRRDRVVAQYRDQIENLYK

SEQ ID NO: 425 - protein, 510 aa, Medicago truncatula
MSFAVTTIIFAFLLFTFMYFLFKLFLHSKQKTIIHEKPPGPPTLPIIGNLHILGTLPHRTLQSLSKKYGPIMSLQLGQVPAIVISSSKAAESFLKTHDIVFASRPKIQGSELMSYGSKGMAFCEYGPYWRSVRKFCTLKLLSASKVEMSGPIRKEELSILVNTLKKAALVGEVVNVSEVVENLIEDIVYKLMFGRSKYEQFDLKSLVQEGLALIGAFNLADYVPWLGIFDLQGLTKSCKKVSKALDEVLEVILTEHEQAANVNKTQKDFVDILLSIMHQTIDIEGEQNLVIDRTNIKAILLDMIVAAIDTSATSIEWALSELLRHPRVMKKLQDEIQNEVGNKRMVNEKDLKKLNYLDMVVDETLRLYPVAPLLVPRESRESTTIDGYFIKEKTRLIVNAWAIGRDPNVWSENAKEFYPERFVEKKMNYLGQEFESIPFGSGRRRCPGIQLGLITVKLVIAQFIHCFNWELPHNISPSNLNMEEKFGLTIPRAQHLHAIPSYRLNDAKLE

SEQ ID NO: 426 - protein, 282 aa, Medicago truncatula
MSRRTMEWAAKSDHLHGIPRKVVIAAVGSFAKTVSSLINTTFVHNADTLLRLVRSRPKGIPLITVSNHMSTLDDPAMWGFKGFPIFDTKLARWVLAAEDICFRNPLYSYVFRTGKCIPITRGGGIYQKHMNEALGRLNDGEWLHTFPEGKVHQDDAPIRRLKWGTASLIVRAPITPIVLPIVHHGFHEVMPEKYMFGRRPPLPLCNKKINIIIGDPIEFDLPAMSEMAIAQSRNDSFPTIGWPRTSDGLDEAAQRHLYTTLSEKIRVAMEKLRCYGKSFLKS

SEQ ID NO: 427 - protein, 575 aa, Medicago truncatula
MDPSQRVSRFEAAQKAINSIGLGFDITLDINFDNCKSIGSPLIFINNQQHCRHLELPGGVTIPNVSNSVKCVRGESIRIHSDVLTLHQMLQHFNHEMRLVGDTASGHFCASFGLSGRCIKDLASIKSLAYDGWFIKRYAVELENYHGELHDHVKEAVPSSWDPEALARFIERFGTHVIVGVSMGGKDVFYVRQEDTSDISDPTSIQKLLKETASMKFMDSADNQRSASEDLSNKKENLFMVHKRKGGSSKTMYHSEWLDTIDQQPDVISMHLLPLTSLLLNIRGNGFMSHAINLYLRYKPPIEDLHQFFEFQLPRQWAPILSEIRLGSYWKHQMNTWLRFSILGPKLYINTIPVDVGNRPVIGLRLQLEGRRSNRLAIHLQHLTSLPKSLPLADNANAYLSCDSYSCNFHKKVKWSCFSYVCTAPVESDDSLSIVTGAQLQVEKKCLLLRLRFSKVIGATLQKPPEWDQSSNLGGFSSKSTGVLAFIPKEGKRGHPKPGDVTIGSTTYSAALPAPVRTPKLQKYVDITEMMRGPEDTPGYWVVSGARLSAQNGKIYLLVKYSLLNFVMQCETKAS

SEQ ID NO: 428 - protein, 473 aa, Medicago truncatula
MTSSSSSKSPPLIPSRHSPQFTPIQEEHEFDEYRSQSRRTTPTSASTPKHHHHPPTPININKNTKPNHKKKRSETELEDGSVSCNKCRPHSRDKIFILPFDHSNNSNSNSKYSSLLQSPNGIFKSIVSKLTRKSPMSTSTTNNNEEQWKMAVAELSHKLVHATRKRDEALQEASRLMNSMSELEKKLNKLEIYCHTLKSGLEECNIGSSNVVAQKNFHHHVQDNDNVVQHFLVAVSEARSSVRLLSRSLTMQLRHTGSKVYEKVSLLLQPYDIKISFSKNPRSLLFYLEALLNKTFFEDFESIGFQKNACNRILNPMERCESSFASFNMIHGLTWDEVLSKGTRHFSEDFSRFCDRKMSEIVAMLGWNRAWSEPLLQAFFVASKSVWMVHLLANSVHPSLQIFRVDKGVNFDSVYMEDMGGDKSSRLVPNMVRIMVAPGFYVYGSAVKCKVLCRYLTNNLSNNKQDKGLNPSP

SEQ ID NO: 429 - protein, 629 aa, Medicago truncatula
MAVPPSATPASLYVGDLHPDLSDSQLHDAFSDFKTLASVRICRDSSSGKSLCYGYVNFLSPHDAIRAIEVKNHSTLNGKAIRVMWSRRDPDARKSCIGNVFVKNLAESIDNSGLEDMFKKFGNILSSKVVMSEDGKSKGYGFVQFETEESANAAIERLNGYLVGDKQIYVGKFVKKSDRISSGPDTRYTNLYMKNLDLDISETLLREKFSSFGKIISLAVAKDSNGMSKGFGFVNFDNPEDAKRAMETMNGLQLGSKILYVARAQKKAEREQILHQQFEEKRKEQVLKYKGSNIYVKNIDDNVSDEGLRDHFSVCGTITSAKIMRDDKGISKGFGFVCFSTPEEANKAVNSFHGFMFHGKPLYVSLAQRKEDRQAQLQLQYAQQIAGLAGPSTAIVPGGYPPFYYTATGVVSHAPPRAGLVYQPMALRPGWRANGSAPPARSFQQSPTPVVSNNNTRQHRQNRGRMNGHAVSQGNTHSGTYMPQAQQASQSAISSRESSTQQRTGQAKYVPSGRHREMEKGSGLSSSGGSLGPEVLHSMLANATPEQQKEILGEHLYMLVQKIKPNLAAKITGMLLEMDNAELLVLIESPESLSAKVEEAFQVLKNSKAKVSGQDVLHSNFLSAEVAVN

SEQ ID NO: 430 - protein, 323 aa, Medicago truncatula
MAVDFSSIPIIDISPLLAKSDDPKMAEDPGVLDVVAQLDKACTEAGFFYVKGHGIPDSLLKGVRDITRRFFELPYEEKAKIKMTPANGFRGYEKIGENITEGAPDMHEAIDCYREVTKGMYGDLGKVMEGFNQWPQNPPKFKFLMEEYISLCKDLAKKIMRGIALALGGSPYEFEGDRAGDPFWVMRIIGYPGVSSDDIGCGAHTDYGLLTLLNQDDDINALQVRNLSGEWISAPPVPGTFVCNIGDMLKIYSNGLYESTLHRVINNSSKYRVSVVYFYETNFDAAVEPLNTYKTPINGDKKFERAIYGEHLVKKVLTNFVDG

SEQ ID NO: 431 - protein, 135 aa, Medicago truncatula
MNMNMTSITSSIATLVTPLPLFMNTKNKIQSRSSKMTRIRCDVGEEDSSSSTAKIGSRVRVKVPLKVYHVPKVPEVDLTGREGQIKQNVTFWKDNKRISANLPYKVEFVADDIQGPRGPLKFVAHLKDDEFEFLE

SEQ ID NO: 432 - protein, 465 aa, Oryza sativa
MDKSQGVLLSSNVGAGSRPWPELLGSAHWDGLLDPLDLTLRRLILLCGDLCQVTYDSFNSDSHSKYCGTCRFSRSTLLDRTQFPAAGDLSVAAYLYATSDATAFPGSMVYSMSREAWSKESNWIGYVAVSNDAAAAASGQRVIYVAWRGTIRSLEWVDVLKPDLVDHDDILPEGHPGRGRSRVMKGWYLIYSSTDERSPFSKYSARDQMLAAVRELVARYRNESLGVVCTGHSLGASLATLCAFDIVVNGVSKVGDGAHIPVTAVVFGSPQIGNPEFKKQFEEQPNLRALHVRNMPDLIPLYPSGLLGYANVGKTLQVDSKKSPYVKRDTSPGDYHNLQGILHTVAGWNGKDGEFKLQVKRSVALVNKSSGFLKDSNLVPESWWVERNKGMVLGQNGEWQLEGPAEENLPVPPVVTGKIIDDDVAAVATSSSAKEDKKTGKGSKLLSGLIDQLLCVPDTCKAGAA

SEQ ID NO: 433 - protein, 366 aa, Oryza sativa
MDSGAAAVCAEKASEIIKIGQVDDVQELQRRLCSATTVPERYIRDGDDRPDHAVVDDERAQERIPVIDVGELQRGSEDELDNLRLACEQWGFFQVVNHGVEEETMEEMEKAAREFFMLPLEEKEKYPMEPGGIQGYGHAFVFSDDQKLDWCNMLALGVEPAFIRRPNLWPTTPANFSKTLEKYSVEIRELCVRLLEHIAAALGLAPARLNGMFGEAVQAVRMNFYPPCPRPELVLGLSPHSDGSAVTVLQQDAAFAGLQVLRGGGGWVAVHPVPGALVVNVGDTLEVLTNGRYKSVEHRAVASGEHDRMSVVTFYAPAYDVELGPLPELVADGEPRRYRTYNHGEYSRHYVTSRLQGKKTLEFAKI

SEQ ID NO: 434 - protein, 412 aa, Oryza sativa
MEVDHADRDGARRRCREYLLALEEERRKIQVFQRELPLCFDLVTQTIEGMRSQMDAAGSEETVSDQGPPPVLEEFIPLKPSLSLSSSEEESTHADAAKSGKKEEAETSERHSSPPPPPPEAKKVTPDWLQSVQLWSQEEPQQPSSPSPTPTKDLPCKPVALNARKAGGAFQPFEKEKRAELPASSTTAAASSTVVGDSGDKPTDDDTEKHMETDKDNDKDAKDKDKEGQSQPHRKPRRCWAPELHRRFLQALQQLGGSHVATPKQIRELMKVDGLTNDEVKSHLQKYRLHTRRPSSTGQSSAAAGVPAPPAPQFVVVGSIWVPPPEYAAAAAAQQHVQLAAAGNNASGSANPVYAPVAMLPAGLQPHSHRKQHQQQQQGQRHSGSEGRRSGDAGDGSSSSPAVSSSSQTTSA

SEQ ID NO: 435 - protein, 349 aa, Oryza sativa
MRLHGEVSFDEDEEEVVMVPAAALSSSPLNGGAVPVTRLVVGYALTKKKVKSFLQPNLLLLARKKGINLVAIDDTRPLAEQGPFDVILHKITSKEWQQVLEDYHEEHPEVTVLDPPNAINHLNNRQSMLAEVSDLNLSSFYGEVCTPRQLVIMRDPSSIPTAVAMAGLTLPLVAKPLVVDGTSKSHELSLAYDEASLSMLDPPLVLQEFVNHGGILFKVYIIGETIQVVRRFSLPDVNTYDLLNNVGVYRFPRVSCAAASADHADLDPHISELPPRPLLEKLGKELRGRLGLRLFNIDMIRELGTKDRYYIIDINYFPGFGKMPGYEHIFTDFLLNLAQSKYKKCLSGG

SEQ ID NO: 436 - protein, 627 aa, Oryza sativa
MRVMKLGNRPDTFFSSGPVRSVSTDLATDMQILVDGCLFRLHKFPLLSKCMWLQALCVESGDGGGAVELPAFPGGAEAFEACAKFCYGVAVTIGPHNVVAVRCAAARLGMSEAADRGNLAAKLDAFLSSCLLRRWKDALAVLHSTRRYAALCEELGVTSRCVDAVAALAVGDASGAVPAGSSSSSPPWWARDISELGVDLYWRVMVAVKATGTVHAKAIGDTLKAYARRWLPIAAKNHHAAERTAGGGGGGAANAERATKNHRLLVEKIVSLLPAERNAVSCGFLLKLLKAANILGASPASKAELTRRVASQLEDANVSDLLIPAPPPCAGGVLYDVDAVVTILEEFALRQAAASGSPKGSPARAGRHRRSMSAESGELEGARRSTSMAAVSHGAMVRVGRLVDGFLAMVATKDARTPLDKMIAVAEAVPDFARPEHDDLYRAIDTYLRAHPEMDKSSRKKLCRVLNCRKLSEKASMHAAQNELLPLRVVVQVLFFENARAAGLSSGHGNRVAARFPGDGGDVSALLGTGRPRTTEENGKDGQSPAAAGSVAADGDWSVEGLRRAASRVATLKMRLEEEDGEDAGDEAFVHRTRAGLARSASSRVTAAAGRSKRMLSRLWPTSRTFT

SEQ ID NO: 437 - protein, 338 aa, Oryza sativa
MSSSPAHAQRFYCHQCDRTVPIPPPTSPDADVLCPFCGGGFVEELGEDINPNPNPNPSPFLPHHPFFPFASPSFDLRNPSDLAAFFGPPSPSPSPSPAARHFDPSNFLHDHFTGLLSGGATIQIVLEGSSASLPLGGAAAGPGGISLGDYFVGSGLEQLIQQLAENDPNRYGTPPAAKSAVAALPDVAVSADMMAADGGAQCAVCMDDFHLGAAAKQLPCKHVFHKDCILPWLDLHSSCPVCRFELPTDDPHHAHPTLGSHRPAAPASASASPSPAPPPRLAERRFRISLPWPLRAAFGGQAESSNPTNQDPVGGSTDASGSGNNNATGGHRGYDDLD

SEQ ID NO: 438 - protein, 348 aa, Oryza sativa
MAMAMHRFSLCCVVLLVLAPLAAVAWRPWPPRNGSGEVEGIGASKKFEGSSDFVKLQYHMGPVLAADITVHPIWYGRWPAEQKRTIRAFLRSLSPPGSGSGDGGIPSPSVAAWWRTVRLYTDQTSANVSGVVRLGREKCDARASRGGRLTRLDIQSVVRDAVTARTRPLPVDSSGVYLVLTSPEVVVENFCGQVCGFHYFTFPSVVGYTLPYAWVGNSAARCPEVCAYPFAIPSYVGGGRRAEAPPNGDVGVDGMVSVIAHELAELASNPLANAWYAGEDPSFPTEIADLCEGIYGTGGGGAYTGQLLTDGRSGASYNVNGVGGRKFLVQWVWNPILSYCSGPNALDQ

SEQ ID NO: 439 - protein, 420 aa, Oryza sativa
MAGEGSGGEGGAGAFEDEAEPTVTIGEYIEGIEAEELEADLVLGGDDGKECTYGGGYLKRQAVFSCLTCVPAGVAGVCTACSLACHDGHEVVELWTKRKFRCDCGNSKFGSHVCKLCPEKDPENPVNSYNHNFKGSYCTCGRPYPDPEAEKQVEMIQCCICEDWFHEDHIGLNSIEEIPRDEEGEPLYEDFICPKCSPKCYFLKLYPDTIWASNKQSSAPQAETTNSTVMNGNSSLGDIEKSENGALINHLNCEKTSDNENCPKDSVAPEKASLDDSSDGKCKLGMNICSNTPSADSEKKMPFFMSKSWREVICRCETCTDFYAQQGVAYLIDKEDSIEEYEKVAKQKREKKLEQQEGVEANFLNSLDHVQKIEILSGINDMKNELQSFLETFDSSKPVTSEDIRAVFENLAKKKKQRLS

SEQ ID NO: 440 - protein, 390 aa, Oryza sativa
MQSLLSSSVLANPCTTGSPLFPPTAAKLAAAASVPVAAAARSGAIAAVSRRSASGGRCVVAAASSSSPAVTTAEAGEVPATMKAWAYDDYGDGSVLKLNDAAAVPDIADDQVLVRVAAAALNPVDAKRRAGKFKATDSPLPTVPGYDVAGVVVKAGRKVKGLKEGDEVYGNISEKALEGPKQSGSLAEYTAVEEKLLALKPKSLGFAQAAGLPLAIETAHEGLERAGFSAGKSILILGGAGGVGSLAIQLAKHVYGASKVAATASTPKLELLKSLGADVAIDYTKENFEDLPDKYDVVLDAVGQGEKAVKVVKEGGSVVVLTGAVVPPGFRFVVTSDGSVLEKLNPYLESGKVKPLVDPKGPFAFSQVVEAFSYLETGRATGKVVISPIP

SEQ ID NO: 441 - protein, 320 aa, Sorghum bicolor
MRHRLLRRAMPIPPPPQSPRTPGVAGGRLFASLPLPPPLQSRREVHVWYLLPDELNDASLLKMYTELLSPSERKTALSMNGEKLQKGAVLSRALVRTTLSRYTDCKVDPRSFEFKKNKFGKPEILWQSDDSRMEWPLHFNISHTSSLIACGITMDAPIGIDVEDKKRKTAKNILSLARRYFTPSEIDYLAKIPDPDGQQKEFIKLWTLKEAYVKALGRGFSGAPFNKFSIILAANNRIKISVAPKAFNDSDSSCDCLSENWQFAVAELNSSHYMAICTEDDSTSSDSGNGRLPLGLKVWKTIPFVEDILVSGTEAVKLVS

SEQ ID NO: 442 - protein, 553 aa, Sorghum bicolor
MRRSWSCLSCLPMGTAALPIEDRFVPPAGLPAVPASGSEDGGFGKGSIDLGGLEVRQITTFAKVWSTTQGGQDGLGATFFKPSPVPAGFSVLGHYAQPNNRPLFGHVLVGRDTSGTGAVLAAPLDYALVWSSPDGAGHFWLPTAPEGYKAVGVVVTAAADKPSPDEVRCVRSDFTDASEIEDTVLTSDKDGFSAATLRPAVRGIDARGVHAGTFLAQSSATPAGASTTPACLKNNSASYTSAMPDLAQVNSLLAAYAPHVYLHPNESYLPSSVTWFFENDALLYQKGSQTPTPVAADGSNLPQGGGNDGGYWLDLPVDNNQREKVKKGDLAGAKVYVQAKPMLGGTVTDLAVWIFFPFNGPARAKVGLIQSIPLGKIGEHVGDWEHVTLRVSNFSGELLRVYFSQHSAGTWVDASRLEYLADGDGGNRPVAYASQHGHAFYPNAGTVLQGNTSLGIGIRNDCARGSRLDTGAGRCEVVSVEYLGVKEPAWVGFEREWGPREEYDIGREINRAARILPRSVRERLAKLVEKVLVGEGPTGPKMHGNWRNDEKEA

SEQ ID NO: 443 - protein, 126 aa, Sorghum bicolor
MDRSKSYAGGRMQIEPYYGGGGARPDFRSYSYSAGGGGMGTSSYSSSSYSYQYEYGGPAAGAAAGEEVKRSKSKRRWLALADPDMDRKRRVAAYKAYGVEGKVKGSFRKSFKWIKDRYLNLVYGWS

SEQ ID NO: 444 - protein, 232 aa, Sorghum bicolor
MSSLRNAIPRRAHKERSQPEARKKFGLLEKHKDYVVRARAYHIKEATIAKLKEKAAFRNPDEFYFKMINSRTVGGIHRPKPEDNKYTEEELLLLKNKDMGYILQSIQSEKKKIEKLSSTLHELDNKPQNKHVYFAEDREEAKEIQSRIGQSNNMPGLDNIPSRIKKKTASSYRELEERKQRLQKLEKLYADMALQKELKKPGRKRKLKLNEDEETDNQTSQPVYKWRAQRKR

SEQ ID NO: 445 - protein, 610 aa, Sorghum bicolor
MRPEGAARLAWLLLLAAAAAGHGGVQPLSRIAIHRARVALDASAAVRASPELLGTKGEDTAWVNVDFITPHPSDDDWIGVFSPSNFNASTCPGSHGSGPGPVICSAPIKYQFANYSSDFGKSGKGALKFQLINQRQDFSFALFTGGLSNPKLIAVSNAIAFANPKSPVYPRLAQGKSWNEMTVSWTSGYDINEAYPFVEWGIKWSPAVRTAAGTVTFDRDSICGEPARSVGWRDPGFIHTAFLTDLWPNKEYYYKIGHMLPDGNVVWGKLSSFKAPPYPGQKSLQRVVILGDMGKAERDGSNEYANYQPGSLNTTDTLIKDLDNIDIVFHIGDISYANGYISQWDQFTQQVEEITSRVPYMIASGNHERDWPNSGSYFNGTDSGGECGVLAETMYYTPTENRANYWYSTDYGMFRFCVADSEHDWREGTEQYKFIENCLATVDRKKQPWLIFIAHRVLGYSSGYFYGRDGSFAEPMSRQSLQKLWQKYRVDLAFYGHVHNYERTCPVYEEQCMSSEKFHYSGTMNGTIHVVVGGGGSHLSNFTIQVPAWSVYREMDYGFVKLTAFNYSSLLYEYKRSSDGEVYDSFTLHREYRDVLACVKDSCPPTLKST

SEQ ID NO: 446 - protein, 605 aa, Sorghum bicolor
MSGGASLGVRSSGSYGSLPQQQQLGGCQSSPSPSPPLAARKPAKMSLGGAGAGAGGPRVFARICKLAGRRQRMLLLLLVAVAVAFCFLFSSLVSKDEDASPGVETMLVFSDHVRSFVNPGWTSSGRPVAQRGSLTVNGLNTASHMEKQSDSKQQVQELMQSFPPAVMDHHPCENFSLSPPPIDRKRTGPRPCPVCYLPVEQALALRPAKPSLSPVLQSLNYMFEENLIPKESKSGSLFGGFPSLEEREKSYDIKDSMTVHCGFIRGKTPGLSTGFDIDEADRSEMQLCQSTVVASAIFGNYDVMQQPENISKFSKDTVCFFMFLDEETEAAIKNSTTIGHTKRIGLWRVVVVRNLPFTDARRNGKVPKLLLHRLFPNVRYSIWIDGKLKLVRDPYQVLERFLWRKNVSFAISRHYRRFDVFEEAEANKAGGKYDNTSIDYQIEFYKREGLTHYSSAKLPITSDVPEGCVIIREHVPITNLFTCLWFNEVDRFTSRDQLSFSTVRDKIRSRVNWTADMFLDCERRDFVVQSYHRELLEQRQATLRSWPPQRPPIVRVHPRKMLPDNAAKEPWRASATKKLSGKRTRDKRSSSRRTHRTNMKEAIQL

SEQ ID NO: 447 - protein, 895 aa, Sorghum bicolor
MRVLLLLALLLAACAAAAAQAAGGANSNSTSTPFVPRDDILLDCGAKGQGNDTDGRVWTGDAGSKYAPPDNLASVASASGQDPSVPQVPYLTARVSASPFTYSFPLGPGRKFLRLHFYPANYSNRDAADGLFSVSVAIPGGKLTLLSNFSAYQTAAAITYSYLVREFSVNVSSQTLDLTFTPEKGHPNAYAFVNGIEVVSSPDLFDLSIPNMVAGDGSLQQFEIDPGTAMQTMYRLNVGGQAISPSKDTGGYRSWDDDSTYIFGASFGVSYPKDNNVTITYPSNVPEYVAPEDVYGTARSMGPTKEVNMNFNLTWMLQVDAGFLYLIRLHFCEIQYPITMINQRVFNIYINNQTAVKGADVIAWAAVSGATTRIGSPVYQDYVVSTPGVGAMDLWIALHPDPDSKPQIYDAILNGMEVFKLQLINGSLAGLNPIPSVAPANDGTTKKKSTVGPIVGGVVGGLVVLALGYCCLSMICKRRRNAGKDAGMSDGHSGWLPLSLYGNSHTSSSAKSHTTGSYASSLPSNLCRHFSFAEIKAATKNFDESLILGVGGFGKVYRGEIDGGTTKVAIKRGNPLSEQGVHEFQTEIEMLSKLRHRHLVSLIGYCEEKNEMILVYDYMAHGTLREHLYKTQNSPLTWRQRLDICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLPKEEVSLAEWALHCQKKGILDQIVDPYLKGKIAPQCFKKFAETAEKCVSDQGIDRPSMGDVLWNLEFALQMQESAEESGSLGCGMSDEGTPLVMVGKKDPNDPSIESSTTTTTTTSISMGDQSVASMDSDGLTPSAVFSQIMNPKGR

SEQ ID NO: 448 - protein, 221 aa, Glycine max
MEKAESSASTSEPDSDENHHRHPTNHHINPPSGLTPLEFASLIPSVAEHHSYLVGSGQCSSLLAQRVQAPPDAVWSVVRRFDKPQTYKHFIKSCAVKEPFHMAVGVTRDVNVISGLPAATSTERLDLLDDIRCVTGFSIIGGEHRLRNYRSVTTVHSFEDDADDGKIYTVVLESYVVDVPDGNTEEDTRLFADTVVKLNLQKLASVTEGTNRDGDGKSHSR

SEQ ID NO: 449 - protein, 98 aa, Glycine max
MARSFSNVKVLSALVADGFSNTLTRRGYAAATQSATRGGAASISSKIAPKSGEDKVGGGAEKVSWVPDPVTGYYKPENIKEIDVAELRATVLGKKFNH

SEQ ID NO: 450 - protein, 289 aa, Glycine max
MANKYHKLRSISLPSRSHPSTVRVEEELRKIKTWEGTSTISTSKSIHTGLSLLEDLYICLDDLLNMASTQKVISHHRGDKCVEEVLDGSVRILDICGITRDTMLQIKENVQALHSSLRRRKGDSCVEASVAEYKLFTKTMKKNAIKLISSLKQMDGKFGVSPLLDLDHHFAAVIRVLREVILINLSVFQFILSFLTVSSSNSKTSKWSLVAKLMHKGAKPCDGTNDEMQCVEAALSSLLNEGTNDDKIHVAHERLEALEDAIESFENGLESLFRHLIKTRASLLNIISQ

SEQ ID NO: 451 - protein, 437 aa, Glycine max
MVDLDWQTKMVHSNIMPPMSPKLSLPDHNIPIPTLQLPLRQNDITAASSPICAAYDNYLRLPELRALWASKDFPNWANEPILKPALHALEITFRLLATVFSDPRPYINKREWTRRVESLATAQIQIIAMLCEDEEENPETRGKAPVTDINGFTGQSRSYSEESLLPRLATWQKSKDVAQRILNSVDYEMGRCTYTLGLGEANIAGKKIFLFDAVCRPREIHSLETTPFDDYVGNHENKTLHATQQIAECWTRSVKKLLERVTESVEKKALEKAASECHAVERIWKLLTEVGDMNLMMDPEDFLRLKKELGMMRTAGETVAFCFRSRELVEVARVCRNLREKVPEILEVEVDPKGGPGMMEAAMKVYSEKEKGKVHVLQGMQGIEVAMKRFFYAYKQVVTVMMGSSEADNGFTKIFLEPTYFPSLDAAKTFLGYYNQN

SEQ ID NO: 452 - protein, 610 aa, Glycine max
MEIEKSTKGSAEIGEKEEKKKKQHRRGGIRTLPFILANEVCDRFASAGFHGNLISYLTQELNMPLVAASNTLTNFGGTSSFTPLIGAIIADSFAGRFWTITVASLIYELGLISITVSAILPQFRPPPCPTQANCQEATSSQLWILYISLLLTSVGSGGIRPCVVPFSADQIDMTKSGVASRKWNIFNWYFFSMGFASLSALTIVVYIQDNMGWGWGLGIPCIAMLISIVAFVLGSPLYKTVKPEGSPLVRLAQVTVAAIKKRKEALPEDPKLLYHNWELDASISLEGRLLHSDQYKWLDKAAIVTEEEAKDPTTTPKLWKLATVHRVEELKSIIRMLPIWASGILLITSSSHLHSFVIQQARTMDRHLSPSFQISPASMSIFSVLTMMSGVVLYERLFVPFARRFTGNPSGITCLQRMGIGFIINIIATVIAGLMEMKRKSVAAKYHLLDDPKATIPISVFWLVPQYCLHGVAEIFMSVGHLEFLFEQSPESMRSSATALYCITTAIGNYMGTLLVSLVHKYTGKENNWLPDRNLNRGGLDYYYFLVSGIQVVNLVYYFICAWFYTYKSVEEISEKNKEEDLEQANEHVSSDDKLNDGKEEEKRGLTKDE

SEQ ID NO: 453 - protein, 809 aa, Glycine max
MHLLLSKSPLLLIHNSSMLLHRFSPLLLPRFLFRQPPFPSSNFKPLTLKVLSMASSHSSHHIHTNRLASEQSPYLLQHAHNPVDWYPWGEEAFAEARRRDAPIFLSIGYSTCHWCHVMEVESFEDEAVAKLLNDWFVSIKVDREERPDVDKVYMSYVQALYGGGGWPLSVFLSPDLKPLMGGTYFPPDDKYGRPGFKTILRKVKEAWDSKRDMLIKSGSYAIEQLSEAMSASSDSDKLPDGVPADALRLCSEQLSGSYDSKFGGFGSAPKFPRPVEINLMLYHSKKLEDTGKLGVANGSQQMVFFSLQCMAKGGIHDHIGGGFHRYSVDECWHVPHFEKMLYDQGQLANVYLDAFSITKDTFYSYISRDILDYLRRDMIGPEGEIFSAEDADSAETEGAARKKEGAFYIWTSKEVEDLLGEHAALFEEHYYIKQLGNCDLSGMSDPHDEFKGKNVLIERKEPSELASKYGMSVETYQEILGECRHKLFEVRSRRPKPHLDDKVIVSWNGLAISSFARASKILKGEAEGTKFYFPVIGTEPKEYMGIAEKAASFIRKQLYNVETHRLHHSFRHSPSKAPAFLDDYAFLISGLLDLYEFGGGISWLLWAIELQETQDALFLDKTGGGYFNNTGEDASVLLRVKEDHDGAEPSGNSVSAINLIRLASMVAGSKAEHYKRNAEHLLAVFEKRLKDMAMAVPLMCCAADMLRVLSRKQVVVVGERTSEDFENMLAAAHAVYDPNRTVIHIDPNNKDEMEFWEVNNSNVALMAKNNFAVNKVVALVCQNFTCSPSVTDHSSLKALLSKKPSSSFT

SEQ ID NO: 454 - protein, 89 aa, Glycine max
MDGHDSEDPKQSTADMTAFVQNLLQQMQLRFQTMSDSIISKIDEMGDRINELEQSINDLRSEMGVESTPSPVAPAKPKEEESNKEEGSA

SEQ ID NO: 455 - protein, 418 aa, Glycine max
MAKKRSAPSGGRRENRAESSSRRLNSASGRRKLVAFFIVSSIIAIVTYRYRFRQSSPSQGLVTTHANCQHILAENSKVSGNSSQRHYTYPVLGYITPWNSRGYELAKRFNSKFTHLSPIWYDLKSQQTSLVLEGRHNADRGWISELKKAGEALILPRVVLEASPAVLLGKEKQRNKAINLIVTECKEMGYDGIVLESWSRWAAYGILHDPSMRNLALQFVKQLGDALHSISSEKISGQQLQLVYVIGSPSEKLQEHDFGPKDLETLSEAVDGFSLMTYDFSNPHNPGPNAPLKWIQIVLQLLLGTSGNRAQSLAPKILLGINFYGNDFSLSRDADAGGGAIIGRDYLALLEKHWPELQWDKNSGEHFFFYTDDKDIRHVVFYPSLKSISLRLEEARSWGCGISIWEIGQGLDYFFDLL

SEQ ID NO: 456 - protein, 633 aa, Glycine max
MVADEASPFETSDMLATLLASTPLLSESWRLCTTVAATAPRSFMTEQHGGGGVVYVAFPGVEMAAGSDSICRNLVALESIGDVPLFSARRRNKEGDEPVMVHAGMLNLLSTFFEPFQKQMLALMGNSKTKSIVLTGHSIGGATASLCALWLLSYLHQTYSSISVSVLCITFGSPMLGNGSFSRAILRERWGGNFCHVVSKHDIMPRLLFAPITPYTAQINFLLQFWQLSMTAPGFGKLAVPISDQQKELFNFVMSHLDAATQDEEGSAPVLFHPFGSYLFVSSDGAVCVDCATSVIKMLHLMFASVSPACSIEDHLKYGDYVKNLSLQFLNQNNSVQGNIPDSSYEAGLELSVQSSGLGNQESAIEPAKECLKMTRRMGPSPTKNAANLSITLSKFVPYRTEIEWYKAWCHQQVDQMGYYDLFKRRRSTSKMAMKVNMNRHKLARFWNNVIEMWERNELPHDVAVRAKWVNASHFYKLLVEPLDIAEYYGKGMHTTKGHYIQHGREKRYEIFDRWWKDAMGNTEENNERRSKFASLTQDSCFWARVEEARDWLNSVRSESDTTKLAVLWDNIEKFEKYAMELIDNKEVSEDVLAKNSSYSIWMEDLRGLRELKAKVKTFSHHFNPFLDGEVIP

SEQ ID NO: 457 - protein, 620 aa, Glycine max
MAAKTVTPDAVSTLLANPSPDSTSDLPDIVVQVLDLKATGNKYMFTANDGKTKLKAMIPSDMRSQVLSGAIQNLGLIRVLDYTVNDIPNKSDKYLLAIKCEAVSPALEMEIKSEESGSGILLKPKVEGGVKTEGAAAGILLKPKQEVVTKSANQILREQHGNSAPAARMAMTRRVRPLVSLNPYQGNWTIKVSVTSKGNMRTYKNARGDGCVFNVELTDEDGTQIQATMFNNAARKFFDKFVLGKVYYISRGTLKVANKQFKTVQNDYEMTLNENSEVEEVVGEASFVPETKFNFVQIDQLGPHVNKSELVDVIGVVKNVSSTMSIRRKSDNESIPKRDITIADDTKKTVVVSLWNELATTTGEELLDIVDKSPVVAIKSLKVGDFQGVSLSTIGRSVVLVNPDIPEAKNLRSWYDFEGKDAAMDSVGSGSSPISNNGIRSVYTDRIHLSDIISNPSLGDGKPAFFSLRGHITFIKPDQAMWYRACKTCNKKVTESFGSGYWCDGCQKSDEQCSLRYIMVAKVSDGSAETFISVFNQEAEKIVGCSADDLDNLKLQEGEDNPYQMTLKEATWAQHLFRVSVTPNEYNGEKRQRITVRAVVPVDFAAESRFILEELSKMRA

SEQ ID NO: 458 - protein, 530 aa, Glycine max
MMEAKGVRFLAYQSIFSSVGSGDFDGVKKLVEKVKNEEWSSLSDVMSLQNDAGETALYIAAENNLQEIFSFLLSMCDFEVVKIRSKKADMNAFHVAAKRGNLDIVRELLNTWPEVCKLCDSSNTSPLYSAAVQDHLDVVDAILDVDVSCMFIVRKNGKTSLHNAARYGVLRIVKTLIARDPGIVCIKDKKGQTALHMAVKGQCTSVVEEILLADPSILNERDKKGNTALHMATRKCRSQIVSLLLSYSAMDVNAINKQQETAMDLADKLPYGDSALEIKEALAEYGAKHARYVGKEDEAMELKRTVSDIKHEVQSQLIQNETTRRRVSGIAKELKKLHREAVQNTINSVTVVAVLFASIAFLAIFNLPGQYITEEGQEIGKANIADHVSFQVFCLLNSTSLFISLAVVVVQITLVAWDTRAQKQIVSVVNKLMWAACACTCGAFLAIAFEVVGKKTWMAITITLLGVPILVGTLASMCYFVFRQHFGIFRSDSQRRIKRTSGSKSFSWSYSANISDLDEYNSDIEKIYAL

SEQ ID NO: 459 - protein, 231 aa, Glycine max
MASGFGESTGRSPPSPSYFNNNNNSDAANFECNICFELAQDPIITLCGHLFCWPCLYKWLHFHSQSRECPVCKALVEEEKLVPLYGRGKSSTDPRSKSIPGVNIPHRPAGQRPETAPPPETNHFHQHGFGFMGGLGGFVPPPMATTRFGNFALSAAFGGFIPSLFNFQMHGFHDAAMYGGGAGFPHGFANTFHGVHAHGFPLRTHQGQQDYYLKKLLLFVVFCVVLAFIWQ

SEQ ID NO: 460 - protein, 234 aa, Glycine max
MAANDSSTEIDTKKLSNCWGNAQMPFALPTLLSSPPQHLHTSFTTAADNFFRFLHSLASHNSFLNKILSLPSEFHTLCVQIGKQRNVRLVSGHNFAAVLPGDSVAGLVVANGVLNFLNIYNTLLIVRLVLTWFPNTPPSIVSPLSTICDPYLNIFRGLIPPLGGTLDLSPILAFLVLNAFTSTASALPAELPVTEQSKQGLAAPLHSTNLTTSQKKWLTRFQGNRSRTSGADAK

SEQ ID NO: 461 - protein, 890 aa, Glycine max
MAASVDQRPYPGLHNGVVRPLKPGPDIPRPKKLPQPPPPLSDSSSDEEEDTTLNLKDLIRKGTTEVESSIFDPRDDGTSDHWIQRNSSLVRLTGKHPFNSEPPLPRLMHHGFITPVPLHYVRNHGPVPRARWEDWTVEVTGLVTRPTCFTMEQLLHDFPSREFPATLVCAGNRRKEQNMVKQSIGFNWGAAAISTSVWRGVPLRTLLKSCGIYTRTKGALHVCFEGAEDLPGGGGSKYGTSILREVALDPSRDIILAYMQNGEPLSPDHGFPVRMIIPGFIGGRMVKWLKRIIVTTDQSQNYYHYKDNRVLPSHVDAELANAQAWWYKPDYIINELNINSVITTPCHEEILPINSWTTQMPYFIRGYAYSGGGRKVTRVEVTLDGGETWQVCTLDCPEKPNKYGKYWCWCFWSVEVEVLDLLGAREIAVRAWDEALNTQPEKLIWNVMGMMNNCWFRVKTNVCRPHKGEIGIVFEHPTQPGNQSGGWMAKEKHLEKSSESNPTLKKSVSSPFMNTTSKTYTMSEVRRHNNADSAWIIVHGHVYDCTRFLKDHPGGTDSILINAGTDCTEEFEAIHSDKAKQMLEDYRIGELTTTCYNSDSSSSNPSVHGSSDTIPLTPIKEVITPMRSVALNPREKIPCKLISKTSISHDVRLFRFALPSDDLLMGLPVGKHIFLCATVDEKLCMRAYTPTSSVHEVGYFDLVVKVYFKGVHPKFPNGGIMSQHLDSLPIGSVLDVKGPLGHIEYTGRGNFLVHGKPRFATRLAMLAGGTGITPIYQVVQAILKDPEDCTEMHVVYANRTEDDILLKEELDEWAKKYDRLKVWYVIQESIREGWEYSVGFITESILTEHIPNASPDTLALTCGPPPMIQFAVQPNLEKLGYDTQNNLLVF

SEQ ID NO: 462 - protein, 805 aa, Glycine max
MALCTSSFFFTFFFTFFLFLFNLQPSVSQQQFTSFNISHSPWLPAQNKTLLSPNKNFTAGFFPLPNSSNVFTFSIWYSKVPPSANPFVWNATVQVNTSGSLEITPKGELLLNGSPFQSAENATTNSTSNSTQLLLQNDGNLVFGEWSSFKNPTSTVLPNQNFSTGFELHSNNGKFRFIKSQNLVLSSTSDQYYNTPSQLLNMDDNGKMSMQGNSFLTSDYGDPRFRKLVLDDDGNLRIYSFYPEQKNQWVEVWKGIWEMCRIKGKCGPNAICVPKEDLSTSTYCVCPSGFTPAIQNDPEKGCRRKIPLSQNTQFLRLDYVNCSSDGHLNEIKADNFAMCEANCSREKTCLGFGFKYDGSGYCMLVNGTNLQYGFWSPGTEAALFVKVDKSESSVSNFIGMTEVMQTTCPVNISLPLPPKDSNATARNIAIICTLFAAELIAGVAFFWSFLKRYIKYRDMATTLGLELLPAGGPKRFTYSEIKAATKDFSNLIGKGGFGDVYKGELPDHRVVAVKCLKNVTGGDAEFWAEVTIIARMHHLNLVRLWGFCAEKGQRILVYEHIPGGSLDKYLFRVNKSHNNNHLKEQSSSLNPNTPQQERHVLDWSMRYRIALGMARAIAYLHEECLEWVLHCDIKPENILLGDDFCPKISDFGLAKLRKKEDMVTMSRRRGTPGYMAPEWITADPITSKADVYSFGMVLLELVSGIRNFEIQGSVVRSEEWYFPGWAFDKMFKEMRVEEILDGQIRDAYDSRAHFEMVNRMVKTAMWCLQDRPELRPTMGKVAKMLEGTVEITEPKKPTVFFLGEE

SEQ ID NO: 463 - protein, 209 aa, Glycine max
MALSVSSPSCVRVPSCFWKPNGKSCKERTKVSCAAHNDNKNPLVGIGIGVVTSCVMGLTALDADATRIEYYATVAEPLCEYNYVKSGLGYCDIAEGFGDEAPLGELINVHYTARFADGIVFDSSYKRARPLTMRIGVGKVIKGLDQGILGGEGVPPMRIGGKRKLQIPPHLAYGPEPAGCFSGDCNIPANATLLYDINFVEVYSGNRSK

SEQ ID NO: 464 - protein, 397 aa, Glycine max
MQSMSLCASLSSTASHLTSLASVSSSTSPLSRKFSLTFREKNRTPIAPPHKLPFFSARPAPTRVVLVKSQATAPASSEAVKVTPVPSEMKAWVYGEYGGVDVLKLDSNVAVPDVKEDQVLIKVVAAALNPVDAKRRQGKFKATDSPLPTVPGYDVAGVVVKVGSQVKDFKVGDEVYGDVNEKALEGPKQFGSLAEYTAVEEKLLAPKPKNLDFAQAASLPLAIETAYEGLERTGFSPGKSILVLNGSGGVGSLVIQLAKQVYGASRVAATSSTRNLDLLKSLGADLAIDYTKENFEDLPEKFDVVYDAIGQCDRAVKAVKEDGSVVALTGAVTPPGFRFVVTSNGEVLRKLNPYLESGKVKPIVDPKGPFPFDKLAEAFSYLETNRATGKVVIHPIP

SEQ ID NO: 465 - protein, 351 aa, Glycine max
MNLKQYCCFLKDEGLNKIQVSNKKNSRDYPWEMYTLKELLRATNNFHQDNKIGEGGFGSVYFGRTSKSVQIAVKRLKTMTAKAEMEFAVEVEVLGRVRHQNLLGLRGFYAGGDERLIVYDYMPNHSLLTHLHGPLAKECQLDWPRRMSIAIGAAEGLAYLHHESTPHIIHRDIKASNVLLDPEFQAKVADFGFAKLVPDGVTHLTTKVKGTLGYLAPEYAMWGKVSESCDVYSFGILLLEIISAKKPIEKFPGGVKRDIVQWVTPYVNKGLFNNIADPKLKGKFDLEQLKNVTTIALRCTDSSADKRPSMKEVVDWLKNGVGSTWGEENIPTLSIKNGDEGNDKDDKLKNN

SEQ ID NO: 466 - protein, 317 aa, Glycine max
MATLTVPPVPPSPRDDAMQLYRAFKGFGCDTSAVINILAHRDATQRAYIQQEYKAMYSEELSKRLASELSGKLETAVLLWLHDPAGRDATIIRKSLTADNKTLEGATEVICSRTPSQLQYLKQIYHSMFGVYLEHDIQTNTSPGDHQKLLLAYISTPRHEGPEVNREIAQKDAKGLYKAGEKKLGTDEKTFIHIFSERSAAHLAAVSSYYHDMYGHSLKKAVKNETSGAFEHALLTIIQCAVNPGKYFAKVLHKAMKGLGTDDSTLIRVVVTRTEVDMQYIKAAYLKKHKKTLNDEVHSETSSHYRTFLLSLLGPNH

SEQ ID NO: 467 - protein, 503 aa, Glycine max
MATAAVIGLSGGKRLLSSSYHYSDVIEKLSYGSDFGSTHYQIVPTKSLIAAKKSSNYTPTFPASNQQNQSIKALKEHVDDAPTIADSWFQSCNSNDLEVESSEMGYSVEALLLLQKSMLEKQWNLSFEREVLTEHSSKGKKCKKVAVTCSGVSARQRRMNTKRKTAIKTCGAMQLKSKISPELLQHRLKGYVKGIVSEELLSHAEVVNLSERIKVGLSLEEHKSRLKERLGCEPSDDQMAISLKISRTELRARMIECTLAREKLAMSNVRLVMSIAQKYDNLGAEMGDLVQGGLIGLLRGIEKFDSSKGFKISTYVYWWIRQGVSRALVENSRTLRLPAHLHERLSLIRNAKFRLEERGITPTIDRIAKYLNMSQKKVRNATEAISKTISLDREAFPSLNGIQGETHHSYIADDRVENIPWNGVDEWALKDEVNKLINVTLVEREREIIRLYYGLDKEGLTWEDISKRIGLSRERVRQVGLVALEKLKHAARKRQMEAMLLKH

SEQ ID NO: 468 - protein, 348 aa, Glycine max
MCQGLSAPSPPCSALLSFTLLLLLLSVVGPVSAWRPWPQSNKMNISDYAFGDSKKYEGSSEFVKLRYHMGPVLTTNITVHTIWYGKWERSQKKIIREFINSISAANSPHPSVAGWWRTVQLYTDQTGANISKSVRLGEEKNDRFYSHGKSLTRLSIQSVIKSAITGKTRPLPINPRSGLYLLLTADDVYVQDFCTSVCGFHYFTFPSLVGYTLPYAWVGNSAKFCPGQCAYPFSVPAYIPNRKPFKSPNGDVGVDGMISVIGHEMAELATNPLANAWYAGQDPSFPVEIADLCEGIYGTGGGGSYTGQVFDARDGATYNMNGIRRKFLVQWLWSHVLNYCTGPNALDH

SEQ ID NO: 469 - protein, 421 aa, Glycine max
MDINEIDVPSFFLCPISLEIMKDPVTVSTGITYDRESIETWLFSKKNTTCPITKQPLIDYTDLTPNHTLRRLIQSWCTMNASHGIERIPTPKPPVNKNQISKLLKDASHSPLTCLRRLKSIASGSETNKRCMEASGAVEFLASIVINNNSNIDSSNEADSNDGSGFELKTSASDEALSLLHNLHLSEQGLKTLLSFRNGEFIESLTRVMQKGFFESRAYAVFLLKSTSEVAEPVQLLHLRQELFVELVQVLKDQISQKTSKATLQTLIQFSPWGRNRIKAVEADTVPVLVELLLDCKERKPCEMMLVLLELLCQCAEGRAELLSHAAGLAIVSKKILRVSTLANDRAVKIILSLSRFSATPHVVQEMLKLGVVAKLCLVLQVDSGNKAKEKAREILKLHARAWRNSPCIPNNLLNSYTNYV

SEQ ID NO: 470 - protein, 317 aa, Glycine max
MGGRMHTKSDSEVTSNSMEQSSPARSPPRRPLYYVQSPSNHDVEKMSYGSSPMGSPHHHFHYYLSSPIHHSRESSTSRFSASLKNPRNFSSSSSWKKLHPHPNRDVDPDDHDDADHHLKQSSRNLRLYLWFFLLFLLLLTLFSFILWAASKTYKPRIIVKSIVLENLYVQSGNDGTGVPTDMLSLNSTVRILYRNPATFFGVHVTSTPLLISYYQLAIASGQMQKFYQSRKSRRSLAVVVSGHQIPLYGGVSVLGNTKEHLESVALPLNLTFVVRSRAFILGRLVKSKFFRRIRCSVTLHGNKLGKHLNLTDSCVYK

SEQ ID NO: 471 - protein, 278 aa, Glycine max
MGVFSEDPNPNPNPIVIREVWASNLESEFELIRELIDRYPFISMDTEFPGVIFRPHVDPTKPFNHRNRPSDHYRLLKSNVDALNLIQVGLTLTDAAGNLPDLAGNRSIWEFNFRDFDVARDAYAPDSIDLLRRQGIDFARNTADGVDSTCFAELMMSSGLVCNDAVSWVTFHSAYDFGYLVKILTRRNLPTRLEEFLKTVKVFFGDNVYDVKHMMRFCDTLYGGLDRVARTLNVDRAVGKCHQAGSDSLLTWHAFQKIVDIYFVKEEHRKHAGVLFGL

SEQ ID NO: 472 - protein, 381 aa, Glycine max
MFLSRSILFVFVFSACLLLIPANGIRSFARTNGYETEVEEVDPFAQFREAPEYRNQRKCTLIDTTNAQLVCDPSLVHVAMTIDWHYLRGSIAAVHSVVKHTSCPLNLFFHFIASDARLDSKDVFERIVHTSFPSLRFKVYVFRESLVDNLISPSIREALDNPLNYARSYLPDLLDQCIERVIYLDSDVIVVDDVQELWKVSLTGSRVIGAPEYCHANFTRYFSYEFWSSAEFSEVFQGKRPCYFNTGVMVMDLVRWRAGDYTRKIEKWMEIQKERRIYKLGSLPPFLLAFGGNVEAIEHRWNQHGLGGDNVRNSCRTLHPGPVSLLHWSGKGKPWTRLDAKMPCSVDFLWAPYDLYIPHHHTYHHYHHHQRIAIGSTHSSF

SEQ ID NO: 473 - protein, 360 aa, Glycine max
MALWMEKGSEPLTETEKADLEAIAALKESAAFEFKEKGNQYVKMGKKHYSDAIDYYTRAIDQKALSDSETSILFANRAHVNLLLGNLRRALTDSNEALKLCPSNIKAIYRAAKASLSLNMLAEAREYCLKGLQFDPNNEDLKKLDRQIGLKISEKEKHEAEASKAVAETKKLVSAIENRGLKIGKAMYLELTGLRKPVLDKSNILHWPVLLLYAEVMSSDFIEDFCETDMFSVHLDMIFSEDQPLSWDVENNYKREFIELYYETGSGLCLSKEKLLHCLLEGTAAAHREGVGDEEKDTVEDYKQHMGSPKWIKVNERRTLHDVLKEPNFIIPGIPVFYVVSKRSSFYGKFKAGKWAPPSI

SEQ ID NO: 474 - protein, 339 aa, Glycine max
MTMAGALSLSQFPVRGSVSLPKRRIPRRSFCIRGMSEISSTFSVSTQQEEPTSNASSVTIAPPPNFKPPEPKRFAIRPDKTSEVFGALLPLLFRFATGVFVSGYSFSIVSKDEIPPDEYALELNGVTIKETAKLGPRPEKPIEIYEFETCPFCRKVREIVAILDLDVLFYPCPRNGPNFRQKVLEMGGKLQFPYMVDPNTGASMYESDDIIRYLVDKYGDGNVPLSLSLGFLTTLTAGLGMLSRISKGTTYTPAKFPPKPLKLWAYGGSPFCKLVREVLVELELPHLLVCCARGSPKRNILYQKTGTFQVFDFSNPYTGIEMFESAEIIEYLRATYALQ

SEQ ID NO: 475 - protein, 276 aa, Glycine max
MDSQVAVALALSLVGGVSTSIGALFVIVNKAPSLKMLGLLQGFAAGLMLSISFFDLAHNALNSLGFLKGNLWFFAGVIFFAVVASFIPEPTLTPTSDVKGRKKNGDEGGKDIMKKHRRQVLFSGIVTAVGISLHNFPEGMAVFLGSLKGLRVGINLALAIALHNIPEGVAVALPVYFATQSKWQAFKLASLSGFAEPLGVIIVAYLFPSSLSPEILEGLLGSVGGVMAFLTLHEMLPLAFDYAGQKQSVKAVFLGMAFMSASLYFLSISLPEDLSL

SEQ ID NO: 476 - protein, 386 aa, Glycine max
MFSSLHAKTIMKTPKRHSPPPNSSLRVESDSGEIVTRFKNGRRRRIKIKRMKYTCQTKIRVRNDAGAGGVSQLLAVDSEGEKREIHENVEISLSLASSSSEEEERLSSKQNDGVLSYGSASVIGSRKEMEDAVSEEIGFAAKCDFFAVYDGHGGAQVAEACRERLYRLVAEEMERSASHVEWDWRGVMEGCFRKMDCEVAGNAAVRTVGSTAVVAVVAAAEVVVANCGDCRAVLGRGGEAVDLSSDHKPDRPDELIRIEEAGGRVINWNGQRVLGVLATSRSIGDQYLRPYVISKPEVTVTKRSSKDEFLILASDGLWDVMSSEVACQVVRKCFHGQIRRVCDGVGNHQNRATEAAGLLAEIALAKGSRDNTSVIVVELRGSVTTD

SEQ ID NO: 477 - protein, 410 aa, Glycine max
MGDFTVALNPPKTFRSDNLLSTTNRISPAARGFQTSLAFKPRVFRGIRASVMPREGQPQQQQQQASSLGDALVNSPRRNDVVEAIGRTASLSNCLSETNLHATVPGLESKTRGKVRDIYDAGDYLVLVTTDRQSAFDRILASIPFKGQVLNQTSLWWFERTKHIVSNAVVSAPDNNVTIARKCSVFPVEFVARGFVTGSTDTSLWTVYNKGVRNYCGNVIPDGMVKNQKLPKNILTPTTKAADHDVPITPDEIIERGLMTRADYVEASEKALSLFEYGQQVALEHGLILVDTKYEFGKANDGSIMLIDEVHTPDSSRYWIANSYLERFQNGLEPENIDKEFLRLWFKSHCNPYEDEVLPDAPEDLVCELAWRYIFLYETITKSKFEVPLTEEPIHDRISRNVASALSSLK

SEQ ID NO: 478 - protein, 366 aa, Glycine max
MDAEADPPQNPITRHKCLACYKQYKKKEHLIEHMKTSYHSVHQPRCGVCQKHCKSFESLREHLTGPLPRGICSKIFSQQGCQLCLALFDSPGSLIDHRKICRISAPTCPGTSALPYIDSQFDCQDFSDENHAGEGPGGAVAMDCEMVGGGSDGSLELCARVCLVDEDERLIFHTYVQPEIPVTNYRYDITGLTEEHLRNAMPLKEVREKLLQILHNGESIGKVRLDGGKARLLVGHDLAHDLDCLKMNYPDHMLRDTAKYRPLMKTNLVSHSLKYLTRTYLGYDIQSGTHDPYEDCISVMRLYKRIRSQLHPEEDHGTMTLSNNIVGMPDSWISRELDNLTPDELYAMSRSDYKCWCLDLIPRLSA

SEQ ID NO: 479 - protein, 90 aa, Glycine max
MAGCDKEDYFSAPNAETTSEGKYGRLAPKKKPLISKDNERAFFDSADWALCKQGAGVNQQSTATVETLRPKLQRTPHQQLPPRRPACTSG

SEQ ID NO: 480 - protein, 213 aa, Glycine max
MQMAILLRGGALGDSSFRLCSLTSTSSLHVSQNVAIPTSSSSPILPLIASKFKTASRNRITCSAVQESSPSTAATTAETKEEVKEAPKAAAPAKKPPAKAPAKPLPQMMEEDVIPSLKAIFEAQEDFSNIELVFKDNKLEGSFLKKGNPYSFWAFFPTGNLIGPKGFSLSSYNSRASTVEPFLVDEKKITARHIIFWVEKRLAAQGIIPVWKD

SEQ ID NO: 481 - protein, 775 aa, Glycine max
MATLSDIGVAAGLNILSAFIFFVAFAILRLQPFNDRVYFPKWYLKGLRTDPVHGGAFVRKFVNLDWRSYLRFLNWMPAALRMPELELIDHAGLDSVVYLRIYLVGLKIFVPIAFLAWAVLVPVNATSTGLESAGLDNITSSDIDKLSISNVHSTSERFWAHILVAYAFTFWTCYILLKEYEKVASMRLQFLAAEKRRPDQFTVLVRNIPPDPDESVSELVEHFFLVNHPDNYLSHQVVYNANKLAKLVKKKKKLQNWLVYYQNKVERTSERPQIKTGFLGLCGNKVDAIDHHNTEIDKLSKEIALERDNVSNDPKSIMPAAFVSFKTRWGAAVCAQTQQTRNPTMWLTEWAPEPRDIYWSNLAIPYVSLTVRRLIMAVAFFFLTFFFMIPIAIVQGLASIDGIQKRAPWLNPLIEIPFIKSFIQGFLPGIALKLFLIFLPTILMIMSKFEGFGSISSLERRAASRYYLFNFVNIFLGNILTGTAFEQLDSFIHQAANEYPITIGTAIPLKASFFITYIMVDGWAGIAAEVLMLKPLIIYHLKNFFLVKTEKDREEAMDPGSIGFNTGEPRIQLYFLLGLVYASVTPTVLPFIIVFFGLAYVVFRHQIINVYNQEYESGAAFWPDVHFRVIIALIVSQIVLMGLLTTKKAASSTPFLIVLPVLTIWFHIYCKGRFEPAFVRYPLQEAMMKDTLERATDPNFNLKAYLQNAYVHPVFKASLFDEDEDEEVMSLKLETESLTVPTKRQSRRNTPLPSRISGASSPSLPDHGIRNHPEP

SEQ ID NO: 482 - protein, 342 aa, Glycine max
MAAESGGTPTNFDLPEEVVQVLPSDPFQQLDVARKITSIALSTRVNTLESELSSLRAQIADKDNLIADLQSQLDSLDASLSQIADKLLQTEQDKESLLQENASLSNTVKKLNRDVSKLEVFRKTLMQSLQEEDDNSGAAPDIVAKIQSQASLTSTSQIGDNDVSLPPSVSSSTGNSFAKDHESDAIRPRVSQNLLLASQGSTPRITPPGSPPSLSASVSPTRTSKPVSPQRHSISFATTRGMYDDRSSMFSSMSLTHGSISSSDAGTGSQTGRTRVDGKEFFRQVRNRLSYEQFGAFLANVKELNSHKQTKEETLRKADEIFGPENKDLYTIFEGLINRNLH

SEQ ID NO: 483 - protein, 843 aa, Glycine max
MTITLSPSLSVPHPSPFSLTPTTTLRQLFFTNFTPSPRRRLQLQARAGKPNVLIPINPSVAVEKGKYSYDVETLINRITALPPRGSIARCLDPFKNKLSLNDFALVFKEFAQRGDWQRSLRLFKYMQRQIWCKPNEHIYTIMITLLGREGLLDKCREVFDEMPSNGVARTVYVYTAVINAYGRNGQFHASLELLNGMKQERVSPSILTYNTVINACARGGLDWEGLLGLFAEMRHEGIQPDVITYNTLLGACAHRGLGDEAEMVFRTMNESGIVPDINTYSYLVQTFGKLNRLEKVSELLREMESGGNLPDITSYNVLLEAYAELGSIKEAMDVFRQMQAAGCVANAATYSVLLNLYGKHGRYDDVRDIFLEMKVSNTDPDAGTYNILIQVFGEGGYFKEVVTLFHDMVEENVEPNMETYEGLIFACGKGGLYEDAKKILLHMNEKGIAALYEEALVVFNTMNEVGSNPTVETYNSFIHAFARGGLYKEAEAILSRMNESGLKRDVHSFNGVIKAFRQGGQYEEAVKSYVEMEKANCEPNELTLEVVLSVYCSAGLVDESEEQFQEIKASGILPSVMCYCLMLALYAKNDRLNDAYNLIDEMITMRVSDIHQGIGQMIKGDFDDESNWQIVEYVFDKLNSEGCGLGMRFYNALLEALWWMFQRERAARVLNEASKRGLFPELFRKSKLVWSVDVHRMSEGGALTALSVWLNNMHEMSRTGNDLPELATVVVVRGHMEKSTEAQDFPIAKAAISFLQDNVPSSFTFPGWNKGRIVCQQSQLRRILSGTESSSSRKKMDKLVSLSNTPLTTAGVITSKSDVQSGKANDVDSRTDSTRTELLTSAI

SEQ ID NO: 484 - protein, 184 aa, Glycine max
MEERVVPKRPREEETLEHKDASLDSYELLESSSKRHMPYNHILSLLESEEEDSTQDLSPLITALQQEITNCANDSDTLLSQHNLTNTTTTTNNNLESCSSSTTQYSSNMVEEHDDKEGVMRHLLEASDDELGIPNKEDESLDHGEDGFNFNGGDMFSSFCDGLLWDLEDEAANYYDLLQSQLFL

SEQ ID NO: 485 - protein, 369 aa, Solanum lycopersicum
MAGEFSSLVNKIKPYLAMVSLQFGYAGMYIVTMMCFKRGMSHWILVVYRHAFATIAVAPFAIVLERKIRPKMTRRVFIKIVALGFLEPVIDQNLYYLGLKSTTATYASAFVNLLPAVTFILAVVFRIEKVNLKKKSSMAKVIGTAITVAGAMVMTLYKGPMFNLVPRHGGAHHEASVAAPENWVAGTIELIACIVGWSGFFIVQSMTLKEYPAELSLAAWVCVMGVVEGGIVALIMERDWNAWVIGFDSRLLAAAYSGIVCSGIAYYVQSVVNKVKGPVFVTAFSPLSMVITSILAAIILAESVHLGSLIGAIIIVMGLYSVVWGKSKEGKINDITSKDQELPVVDIKERSTIVDDNINEKKTSIYQEH

SEQ ID NO: 486 - protein, 179 aa, Solanum lycopersicum
MSRHPTIKWAQRSDKLFITVELPDAKNVKLKLEPEGKFLFSATAGADNVPYEVDLDLFDKINVDESKSSTTSRSIVYLVKKAEDKWWSRLVKQEGLRPVFLKVDWDKWVDEDEEDSKPEPDMDFGDMDFSKLNMGEGPSDFDVDVPEGDDDSDTEEIEEEENSEPKAAVPPSTEPGVKA

SEQ ID NO: 487 - protein, 366 aa, Solanum lycopersicum
MVLSKKLIFFVLFLSISLFLFPASAIRGFVEKPRNIKIDGYLDYVESPEYRNSRECPVLDTNMLICDPNLIHVAMTLDVKYFRGSVAAVHSVLKHSSCPENVYFHFVASKDKDFQDLRKMVKSIFPSLSFKVYSFNEFRVKKLISSSIRQALDNPLNYARTYLAEIIQPCVERVIYLDSDVVLVDDIQKLWSISLTGSKIIGAPEYCQANFRTYFTNNFWSDPKLSNVFQGKKPCYFNTGVMVMDLGKWRKGDYTVKIEKWMKIQKEKRIYELGSLPPFMLVFGGEIERIDHRWNQHGLGGDNLVNSCRTLHPGPVSLLHWSGKGKPWVRLDQGSPCPVDLLWMPYDLYRLSSIDSLGDQERRAMI

SEQ ID NO: 488 - protein, 342 aa, Solanum lycopersicum
MAEDICFFAKDSIIIKPAKKSPALLRMVVVAFTLIFGIYICSICLKQTSLENTSKYLNIEVMEKPCHNYDMDQSQIPYVHYPKPKTFSRAECSCNPVRRFAILSMQRSGSGWFETLLNSHMNVSSNGEIFSVKYRRENASSILRTLDTVYNLDFFTSASKNHCSAAVGFKWMLNQGLIEHYKEVVEYFNRKGVSVIFLFRKNLLRRMVSVLSNSHDRYAKLLNGTHKSHVHSHEEAGTLAKYKPEINTTLLITDLKRMEVSATEALDHFNSTRHMILYYEDIVRNQAKLVDVLEFLRLPKMDLSSRQVKIHNGALWKHIKNWDDVNKTLSGTAYEKFLRGDY

SEQ ID NO: 489 - protein, 71 aa, Solanum lycopersicum
MNVVVFLCRPTIFIEIIQRIGCMLKDEKGQVYQKGGCGGFGKGNFSELFRSIEEYEKMLEAKHVNQVAAVE

SEQ ID NO: 490 - protein, 697 aa, Solanum lycopersicum
MSRPLHRGVSGGGRLSVNGPDFWDDSQMKDKIEKEDLERNRSPGDLTYSPTKFLCRILFPDNSPSKHNLGENGLLSDPFSPGTGRNRLKYALVLIRLSLVVIILLALTGSFWWTISITSSSRGHIYHGYRQLQEQVVSDLRDIGQLSLGATNVKDIEYCPPESENFIPCFNVSENLDLGLSKGEEVDRHCGPGSRQNCLVLPPVNYKIPLRWPTGRDVIWHANVNITAQEVLSSGSMTKRLMMLEEEQISFRSDSAMFDSIEDYSHQIAEMIGLRNESNFVRAGVRTILDIGCGYGSFGAHLFSSQLLTMCVANYEASGSQVQLTLERGLPAMIGSFNSKQLPYPSLSFDMIHCAECHVDWDQKDGIFLVEVDRLLRPGGYFVWTSTITNTQRSVRNKVSLKKWNFVQNFAESMCWKLLAQQDETAVWKKTSLKKCYFARRPGVGPSICSKGQDIESPYYRPLQACIAGTQSRRWIPIEERTKWPSRAKLNSSELKIHGLLSEALAEDSLNWNSAVNNYWSLLSPLIFSDHPKRPGDDDPSPPYNMLRNVLDMNAHFGGLNAALLDARKSVWVMNVIPTSGPNYLPLILDRGFVGVLHDWCEAFPTYPRTYDLVHANGLLSMEFGQHIRCPMFDLFIEMDRVLRPEGWVILRDTVPLIELARSHAARLKWDARVIEVESSDEKLLICQKPFSRRQAS

SEQ ID NO: 491 - protein, 319 aa, Solanum lycopersicum
MLMIQSTISLPLQKSVLVPAKIATSGSKNGCFLDLNGRCGSKSASYHFPRRPIKGNSIQLKIYARKSESLPILLSEKVDELPEMLLNGGDITISSGEILSLSAFSCGSIFWLTSGQVALASEGVRVNMVYEVGELFELGIQLTYLLLLLALLGVGSFFVIRQVLVRRELDLSAKELQEQVRSGDASATELFELGAVMLRRKFYPAATKYLLQAVEKWDGDDQDLAQVYNALGVSYVLDGKIDKGIAQFENAVKVQPGYVTAWNNLGDAYEKTKDLTSALNAFEEVLLFDPNNKIARPRRDALKDKVTMYKGVSVKSKKS

SEQ ID NO: 492 - protein, 1017 aa, Solanum lycopersicum
MEEENKQSPLIPPLPRDPRGSLEVFNPSTYSSRSTNPVFRSQPSWKNWTAADPITSSTIPETEEKTEQIAIPKSSNENEQIATSWMAIAPASTKLASPITQKSITGGEKVNSKAAVDEVGAAAQRAAEWGLVLKTDDETGKLQGVKVRTSGDDTNGKTETSRRDSGNSGRSSGEFSDDGAGKERGIPRVSEDLRDALSTFQQTFVVSDATKPDYPILYASAGFFKMTGYTSKEVIGRNCRFMQGSGTDPEDVATIREALQSGSTYCGRLLNYKKDGTPFWNLLTIAPIKDDAGKVLKFIGMQVEVSKHTEGSKEKTVRPNGLPESLIRYDVRQKEMASNSVNELLEEIKNPRRARALSESTNNRPTFMRKSEGDQVEQDKQDTHKLNLVNKAPARRHSHAGTRTTTMKMEKINEVPEKKPKKSARLSFMGIMKKKRSSTTMTTDDDDFEARMTMDNDDDDDDESDNDGRPVSVDDKVRKKEMRKGIDLATTLERIEKNFVITDPRLPDNPIIFASDSFLELTEYSREEILGRNCRFLQGPETDPATVKKIRQAIDNQTDVTVQLINYTKTGKKFWNLFHLQPMRDQKGEVQYFIGVQLDGSQHVEPLQNSIPEDKATESAKLIKETAGNVDEAVRELPDANSKPEDLWRNHSKVVQPKPHRKDSPSWKAIQKILESGEPIGLKHFKPIKPLGSGDTGSVHLVELCGTDQHFAMKAMDKSIMLNRNKVHRACAEREILDMLDHPFLPALYASFQTKTHICLITDYYPGGELFMLLDRQQTKVLKEDAARFYAAEVVVALEYLHCQGIIYRDLKPENVLLQSGGHVSLTDFDLSCLTSCKPQLLVPEINEKKKHQKGQHNPIFMAEPMRASNSFVGTEEYIAPEIITGAGHTSAVDWWALGILLYEMLYGYTPFRGKTRQKTFSNILHKDLKFPGSIQSSLHAKQLMYRLLHRDPKNRLGSREGANEIKQHPFFRGVNWALIRCMNPPKLDSAPFLGTESEKEGKDINPEMEDLQTNVF

SEQ ID NO: 493 - protein, 387 aa, Solanum lycopersicum
MKMGCFGFDFSNFQSITVFFLLLMLGLSFSPNGCLGIRSFPEERRFIEAPEYRNGVQCPVTAETQDMVHIAMTLDSEYLRGSMAAVHSVLRHSSCPEHIFFHFIAAEFDPSSPRVLTQLVRSIFPSLDFNVYIFREDTVLNLISSSIRHALENPLNYARNYLGDMLDPSVTRVIYLDSDIVLVDDIEKLWKTPLSGSRIIGAPEYCHANFTKYFTDSFWSDPDLPQVFGSRNPCYFNTGVMVMDLQKWREGNYRKKIEKWMELQRQRRIYELGSLPPFLLVFGGLVEPINHRWNQHGLGGDNVMGSCRSLHPGPVSLLHWSGKGKPWARLDEKRPCPLDYLWEPYDLYKPKPKSRPNYQRSKMRLYQYNNLDFSTSNILFGYSNYFI

SEQ ID NO: 494 - protein, 337 aa, Solanum lycopersicum
MSGEERPSSLVVDPLLKDLSEKKQNFRRNVVSLAAELKEVRSRLAYQEQSFVRETLTRQEAESKAKKMEEEINKLQETLEEKNGELQFSALNTEKYVKQLDDLKSQLSATQATADASAASAESAQLQCLVLLKELDEKNSSLKEHEVRVNKLGEQLDLLQKDLQARESSQRQLKDEVVRIEHDIMQALAKSGANTDCELRKVLDEVSPKNIEKMNKLLTDKDEELAKLRYEIRIMSAHWKLKTKELESQLEKHRRADQELKKRIMKLEFCLQETRSQTRKLQRMGERRDKAIKELRDQLSVKQVGTSSNNNQNFWDTSGFKVVVSMSMLMLVLFSKR

SEQ ID NO: 495 - protein, 604 aa, Solanum lycopersicum
MGIEGEVPESGGGIRRRNCVCTKDDFLPEESFKSWGNYTNALRQTPTRLIERALTRSNDEAELEAKSRSHHEMKKTLTWWDLIWFGMGAVIGAGIFVLTGLEASQDAGPAVVLSYAVSGVSALLSVFCYTEFAVEIPVAGGSFAYLRVELGDFVAFIAAGNILLEYVIGGAAVARSWTSYFATLLNFKPEKFLITAHGLAKGYNQLDPIAVAVCFIICIIAIRSTKGSSRLNYVASIIHIVVIVFIIICGLIKADTKNYTPFTPFGVRGIFKASAVLFFAYVGFDAVSTMAEETKDPARDIPIGLVGSMVITTTVYCLLAITLCLMQPYQSIDPNAPFSVAFKAVGWSWAQYIVAAGALKGMTSVLLVGAVGQARYLTHIARTHMMPPWFSYVDEKTGTPVNATAVMMSATAIIAFFTKLEILSNLLSISTLFIFMLVALALLVRRYYVSGVTTNANRNKLIICILLILGSSIATAAYWGLSEKGWIGYCFTVPIWVSATAGICIFIPQARNPKLWGVPLVPWLPSLSIAINIFLLGSIDKDSFIRFAGWTGFLLAYYFFFGLHASYDTAKEFEKSKGWKNNIEEGKGTSNVVVSKDVPIAPGN

SEQ ID NO: 496 - protein, 694 aa, Solanum lycopersicum
MAPRLNFSDWWGKDKERGTPVIVKMENPNFSIVEIDGPDAAFKPIEKSRGKNAKQVTWVLLLKANQAVGCVAWLATILWGLIGTIKNRLILRKGVSVASEKLGKSNLLFRIIKVCLGVSLVMLAFEVIAYFKGWHYFQNPNLYIPHTSDVLGLFHIIYVAWLDFRADYIAPSVQKLSTFCTVLFLIQSLDRLVLCLGCFYIKCKKIKPRIEGDPFKSDDLEGSNNGYYPMVLVQIPMCNEREVYEMSISAVCQLDWPKDRLLIQILDDSDNECIQELIKSEVAKWNQKGVNIIYRHRLVRTGYKAGNLKSAMSCDYVKDYEFVAIFDADFQPTPDFLKQTVPHFKDNPELGLVQTRWAFVNKDENLLTRLQNINLCFHFEVEQQVNGVFLNFFGFNGTAGIWRIKALEESGGWLERTTVEDMDIAVRAHLNGWKFIYLNDVRVLCEVPESFEAYRKQQHRWHSGPMQLFRVCLPAIVSSKISIWKKANLILLFFLLRKLILPFYSFTLFCVVLPLTMFIPEAKLPFWVVCYIPILMTLLNILPAPKSIPFIAPYLLFENTMSVTKFNAMVSGLFQLGSSYEWVVTKKAGRSSEPDLLAAAEKDLKAFGAPQISRGASESELSELNRLNKQKDETSTPVKKSNKIYRKELALSFLLLTASARSLLSAHGLHFYFLLFQGVTFLLVGLDLIGEQIS

SEQ ID NO: 497 - protein, 318 aa, Solanum lycopersicum
MATHSNLKNALIAFLAPLPSLLFYLSFLRHYHEDHPIYNWCYHHPLLFANVLFFFNVNILFYAISYIQSSHWMIDLFWTVIPVMLVHFYANHPLAQYNVWRSKVVILLTWIWSIRLTHNYFRRENWQWGHRQDWRFTDMSHQYGKNWWWISFFFVYFSQQIFLIGICLPMYVVHSEDKPWNIWDFIAVFICLSAIIIAYYADTELYNFVSRNQKLKELGKPMVPNLDEGLWRYSRHPNYFGEQLWWWGLVLFAWNLGQTWTFVGALANSLCLAHVTVLVENRMLKQAYRAEAYKLYQRTTSVWIPWFKSSAKGKDKET

SEQ ID NO: 498 - protein, 143 aa, Solanum lycopersicum
MDFIILLIAILALSSTPITIISGSVTNHTYSTTNSYTNVALSARKVVFPPPRQLGKDNSDDDDLICKTCKRLSEHRTCCFNYFCVDLFTNRFNCGSCGLVCIVGTRCCGGICVDIKKDNGNCGKCNNVCSPGQNCSFGLCVSA

SEQ ID NO: 499 - protein, 283 aa, Solanum lycopersicum
MEDLPGFRFHPTEEELLEFYLKNKILGRTSRCDVIGLLNIYRHDPWDLPGLSTIGEREWYFFVARDRKHGNGGRPNRTTEKGFWKATGSDKKIIGLSNPKNIIGLKKTLVFYTGRAPRGSKTDWVMNEFRLPDTVSWPQDIVLCKIYRKATSLKVLEQRAAIEEEMKHVHSSPCSTTLQTMDAMSFGNEHHELTDKSPDLFTSISKDEVDDDRLSVAENKVSAETKEKSNCFRPKLLNGQDSLAELQVPKFSMDFSQDPVWMQLRSPWLDNFILTPSAFVHNF

SEQ ID NO: 500 - protein, 229 aa, Solanum lycopersicum
MAKLILQIFTISLFLSLVAFRATGEEDNYIFGKSINKKPTRLRKEKISHFRFFWHDILSGSKPTSMMIIPPPKNTTTGFGQMNMIDNALTLGPKLSSKIVGRAQGFYGAASLNDVGLMMVMNFAFIEGKYNESTFTILGRNPVFEKVREMAVIGGSGLFRFARGYVQASTHSWDFKTGDATVQYDAYVFALLRFTNFIYFHRVNLCDLVYTKFKKYKNIFCIIAFQNYS

SEQ ID NO: 501 - protein, 496 aa, Solanum lycopersicum
MANKVFCPKLLKNLGFHVRRLNSAPSPLSAVPPLNFTGDFNAVEPAQQINTTLHHHHDHHNIINFDDVKELFYGVPTTKLIRSSMTLQMAAIDPMVDLGMWVMNSKLMEMPIFREVILGFVKNTFYEHFCAGKDLTEARRTVTNLSDSGLKAMLDYGVEHATDNESCEQSTAAFIQTIESTKSLPESSASFVVAKITAICTPRLLKRMSDLLRWEQKDPSFNLPWKRESLPLFAESSPVYHTCSKPEPLSVEEERDLQLAHERLRKICEKCLEHEVPLLIDAEDTTIQPAIDYFAYSAAIKYHKDDQPLIFGTIQAYLKDAKERMVIAKKAAEKMGVPMGFKLVRGAYMCSEKELASTLGFNSPIHDSIEQTHACFNSCAEFMIEEIANGSGAVVLATHNIESGKLAATKAIDLGIKDERQNLQFAQLYGMADGLSFGLRNAGFQVSKYLPFGPVEQIMHYLMRRAEENRGMLSTSAFDRQLMRKELSRRFEVATS

SEQ ID NO: 502 - protein, 551 aa, Solanum lycopersicum
MKDQNLDLFDPRTAVMDPEYSPTHTGEPDFAFAFDDVNFSDRILRIEILGDSIAGGSSSDGGCSSLADWARNRKRRREDFRKENALDITACPEDQIICCNQIDSEDADNENQDEAVVAMIEETNSGDEAANSDDSTWNCDSPRVMRVKTLNISSPILAAKSPFFYKLFSNGMRESEQRQVTLRINASEEAALTELLKFMYRNMLTTNTAPGLLDVLMAADKFEVASCMKYCSRLLCNLPMTPESALLYLELPSSVLMADAVRPLTDAAKQFLAARYKDITKFQEEVMKLPLAGIEAILSSDDLQVASEDAVYDFVLKWTRAHYPLIEERREILSSRLGRCIRFPFMSCRKLRKVLTCNDFEHEFASKLVLEALFFKAEAPHRQRTQAAEESASTSRRFVERAYKYRPVKVVEFELPRQQCIVYLDLKREECANLFPSGRVYSQAFHLGGQGFFLSAHCNMDQQSSFHCFGLFLGMQEKGSVSFTVDYEFAARTTLAEEYVSKYKGNYTFTGGKAVGYRNLFAIPWTSFMAEDSLYFIKGVLHLRAELTIRP

SEQ ID NO: 503 - protein, 347 aa, Solanum lycopersicum
MGDSSGSVSVDMETISVTGKEHLVKTGRGYISVAVFGDQDKPALITYPDLALNYMSCFQGLFYCPEAFSLLLHNFCIYHISPPGHELGAAVMSLDDPVLSVDDLADQIVEVLDYFRLGKVMCMGVTAGAYILTLFAVKYTQRVMGLILVSPLCKAPSWTEWLCNKVMTNLLYYCGMCTLVKELLLLRYFSKEVRGSVEVPESDVVQACRRLLGERQSPNVLRLLEAMNERPDITQGLRKLKCRSLIFVGESSPFHSEALHMTSKLDRRLSALVEVQACGSMVTEEQPEAMLVPLEYFLMGFGFYRPSQCNVSPRSPLSPTSISPELFSPESMGLKLKPIKTRFSEEV

SEQ ID NO: 504 - protein, 446 aa, Solanum lycopersicum
MSHQQEDDADYMANEYDMEAMDDDMDDEFHGRDVGGSDSDADDYDFTNNKMQDTSAAEARRGRDIQGIPWERLSITREKYRQTRLEQYKNYENIPQSGEASEKDCLATKKEVSYYDFRRNSRSVKSTILHFQLRNLVWATSKHDVYLMSHFSVIHWSSLTCSKSEVLNVSGHVAPCEKHPGSLLEGFTQTQVSTLTVKDKLLVAGGFQGELICKYVDRPGVCFCSRTTYDDNAITNAVEIYNTSSGALHFIASNNDSGVRDFDMEKFQLSKHFRFPWPVNHASLSPDGKLIAIVGDNPEGLLVDSRNAKVVSPLSGHIDYSFASAWHPDGLTFATGNQDKTCRVWDIRNLSKSVVALKGNLGAIRSIRYTSDGRFMAMAEPADFVHVFDVKNGYEQEQEIDFFGEISGLSFSPDTESLFVGVWDRTYGSLLEFGRRHNYSYLDTIM

SEQ ID NO: 505 - protein, 509 aa, Solanum lycopersicum
MKHQKKKKRSKACKKVGVGNGSLPSGNSNDGGESVVTALTEAFTSVSMEEATCAYEEANGDLNKAMEILGDMVERKEEDKITTCSSSSGNVGSSLDSSNSEVFVGGHSWQNSVQRKAKVKKLVAATGTVSTMIGKDYVRTTTKKSCSKLKGLHDETSSNEDVEQFLYSMLGEDSDLSLAVVRDVLCQCGYEVEKALSVLLELSASSNEKPKLSDCSANWKEEAVFLHSSDGLTDWTSDSTSHSSESEVLDNVWFYGPPGRNSLKVPAGNSEHSSSSTVGNSGSVLPQDILESLFCMPTPKSVEHEPTTMNWKNVVKKMTSLGQRSGSCPNDIPPLQHTHAEGAEYQLFRETAKQHWESMRSHYQKAATAFSNGQKGHAAYLADQGRLHNRKAREADAKASQDIFAARNKNIENMITIDLHGQHVKPAMRLLKLHLLFGAFVRSVRLFRVITGCGAHGVGKSKLKNSVVELLKKEHIEWTEENRGTLLIKLDGRMNFSFVDTDDNDEDDN

SEQ ID NO: 506 - protein, 373 aa, Solanum lycopersicum
MTEVKKDEENHHQHLCDFCGNNTALLYCRADSAKLCFTCDREVHSTNQLFTKHTRWLLCNHCDSSPASILCCTETSVLCQNCDWESHNKLLSLHERRPLEGFTGCPSVSELLSILGFEDLGKKELLCGGDDGAYGFSDWVIWDAPSVVTLDDLIANNNESRHNYQAIGVPPLPKNRNAACGKHKEEILGQLRELSKLEPNSGDDQDENVPTTGFQSMEPVQNCPLRYKGSGFMQRSDQHVVPSSEGSAFHWHGDTGEFVDQGFSSSLTDCFIETKCLLPDRDSDVCDASGGGNEEQSHHPPTTETFQMVPKVVHRELNSQERETAVSRYKEKKKTRRYEKHIRYESRKARAETRTRIKGRFAKMDYRDSSVHQ

SEQ ID NO: 507 - protein, 510 aa, Solanum lycopersicum
MDHSTGKPGFFRNVLVRLCLFCVVIVCCRFAYVVTLKGETCDLGDFCFFSLPENVNVIAGVGKLTESVSAVMTTENAVKSAPAKPKLPDLWANKEFQKSAQFYSSVFEDLVAEGFLSPNSKTLCVETPMGSDVFALREIGVADSVGIYKKGSKPLVITGKAVKQPFEDDTFDLIFSGAGMIDKSLKPGDFAAEICRTLKPEGYLVVHTGSNDTYSFNSFLHLFNCCTLIKSRNIDGFDSTIREIIMKKDIFVEEKVSDSKNNCGHVPDYKMKLIRKAEPLIKEEPKKPWITLKKNAQSIKYLSSMADISFKQRYVYVDVGSRSYGSSIVSWFKKQYPKQNKTFDIYAVEADKTFHGQYKEKKGVTLLPYAAWVRNETLSFEINQDPGHKDVSKGRGMGRIQPVESSSEGASEVDLIQGFDFAEWLMSAVSEKDYVVMKMDVEGTEFDLIPRLIETGAICLIDEVFLECHYNRWQKCCPGERSSKYPNTYSQCLDLFTSLRESGVLVHQWW

SEQ ID NO: 508 - protein, 471 aa, Solanum lycopersicum
MTVEVQCEATQVAEVVVPQEELVAANKVVEEVEVNEKVKEDEEEESKPNTIEKSSSYREESNFLSDLKENEKKALNELKSIVEEAIVGNTLFKKEETNKSLEEEGKNEENPDANIEEKEGDLDVVEVDREISIWGVPILPSKGDEKTNVVLLKFLRARDYKVNESFEMLKKTLQWRKDFNIQSILEEDLGSDLAPAAYMSGVDNQGHPICYNIFGVLEDEEIYNKTFGTEEKRNQFLRWRVQLMEKGIQQLDFKAGGVSSLLQINDLKNSPGPSKKEVRVATKQAVDLLQDNYPEFVAKNIFINVPFWYYAVHSLLSPFLTQRTKSKFVFARPAKVTETLLKYIPIHEIPIQYGGLKRENDFEFSASDCEASEILLKAGSIETIEIPAVDVESTFIWDVTIVGGEVSYKEEFVPEDETSYTIIIQKDKKVSSTIRNTFKNTEAGKVVLTIKNTSSKKKKAFYRHKITKSTI

SEQ ID NO: 509 - protein, 227 aa, Solanum lycopersicum
MAETEPEVAAAVPAVEAVVEAEKEDTSAQDMDVEAQAADDTEENGGSKRPREEENEVEKEDATKKLKVDKSVEEERFENLDGSKTVDEEKKDVSGPISVGPKNFGSSVEVFNYFYKLLHSWSPNLNLNKYEYIVLLDLLKKGHLEPDRKIGTGVRAFQIRFHPQYKSRCFFIIREDDSVDDFSFRKCIDHISPLPENMQVKHEANRDLARGGKGGGRGRGRGGKPRY

SEQ ID NO: 510 - protein, 300 aa, Solanum lycopersicum
MNNDTPSMIHDPLIDSTGDGGYALSGKIMLSAIVILFTVVVFMVGLHLYARWYLVSQRRRELLRRRRVNHRRTHIVFYVDNPGSGLSDANRGLEQAVLSSLPVFVYSDKTHPEPLECAVCLSEFEENEKGRVLPKCNHSFHSECIDMWFHSHSTCPLCRSPVEAVLIEPDNNRVEVAVTVNEPGSSSGCEENGSHHSNMTPLGCRRKGLDLTGVRIEVPRRNDFEADLEMGVRVSSPAIQSRSPASRLMSLRRILSMNRKTPTGTSHSPSGSCAADFDIETGGSSGGGKIQVGGERITTP

SEQ ID NO: 511 - protein, 515 aa, Solanum lycopersicum
MNEPCFPEENSSISCIMNHLPNKRRRRRKEIVQQTPTNSSAGGGGNDEFGSENQGAVKTKELKQILTSLLLLEEQEKSEFAKEEEEDKHLLEANHKKTTKVMWDYYSNVQQHHSDLEQLDGVRKRKGRGNSAALTATACALASAAAEEEGVSSNKSTDKGAPHRRLWVKNRSKAWWDQCNSPDFPEEEFKKAFRMGKDTFELICNELTSVVAKENTMLRDAVPVKQRVAVCIWRLATGEPLRLVSKRFGLGISTCHKLVLEVCTAIRTVLMPKYLQWPDEKKMRDIKDEYEDMSGITNVVGSMYTTHIPIIAPKISVAAYFNKRHTERNQKTSYSITVQGVVDPRGVFTDVCIGWPGSMPDDQVLEKSALFQRANTGLLNNVWIVGSSGYPLMDWVLVPYTQQQLTWTQHAFNEKIGEVQRVAKEAFVRLKRRWSCLQKRTEVKLQDLPVVLGACCVLHNICQMRNEEMDPELNFELIDDEMLPEIQLRSTNARLARDAIAHNLLHHNHAGTSLL

SEQ ID NO: 512 - protein, 403 aa, Solanum lycopersicum
MEPPNPQQFQQFLSSVLSQRGPAALPYAEDVKWLIRQHLLSLIDMYPSLQPKTASFTHNDGRTVNLLQAVGTVPMVYLDRTYNIPVIIWLMESYPRHPPLVFVNPTRDMVIKKPHPFVNPSGIVSIPYLQNWIYPSSNLVELVRNLSHFFGRDPPLYAKVQAHPSNPNPSPRPTPTPNPHPPPSTSFPNHSSPVGSYGIRPAIPPRPVQQPPYGAVKHDDPEEVFKRNATDKLLVDLHNDIVGLRNAQEKDMDGLFNAQGVLKQREEQLKQGLKEMQDEKEGLEQQLQMVLMNSDVLEGWLRENEGKATNLGNVDVDTAFEPCDSLSKQMLDCTASDLALEDVIYSLDKAIQGGAIPFDQYLRNIRLLSREQFFHRATASKVRAAQMQAQVANMAARTSQYAL

SEQ ID NO: 513 - protein, 283 aa, Solanum lycopersicum
MASLDMTLDDMIKSRRNTERGGRGQGRARRGRGAGGSFRGGSFRGGRTTGAPRRGPLGVNARPSAYTIAKTFRRTKNLPWQNGLFEDSLRAAGLSSVLESGTKLYVSNLDVGVTNEDIRELFSEMGELVRFAIHYDKNGRPSGAAEVVFARRSDAFQALKRYNNVQLDGKPMKIEIVGSNPEIPLSARVNVVGGTNRRRTVVMAPGGPARGRGAATSRGSSQRGRGGLRNAPGRGRGGGGGRGWGRGRGRGGRGSSSRGADKSAEDLDKELDSYHANADAMQT

SEQ ID NO: 514 - protein, 410 aa, Solanum lycopersicum
MIFPLLKPHYHKVSIFIKKMRAVSVFGGVFLVLAVYCGLDPFKHSAISEFPNFESFKVEMPAWSEIPVEKDSQNLLQKSEVKFLDQIQGPESIVFDPQGRGPYTGIADGRVVFWDGEKWNDFAYTSANRSGLCDPKPSALSYRKYEHICGRPLGLRFDKRTGDLYIADAYLGLMKVGPEGGLAESLTTEAEGVPIGFANDLDVDDDGNVYFTDSSTKYQRRNFIQLVFSGEDSGKVLKYNPRTKETTILIRNLQFPNGLSLSKDGSFFIFCEGSKGRLRKYWLKGEKAGTSEVIAILPGYPDNVRANERNEFWVAIHCRRTIYSYINGIYPRLRQFLLKLPISAKLQYLIHIGGRFTAVVVKYSPEGKLLQILEDRQGKVVRAVSEVEERDGKLWMGSVLMSFISVYQLE

SEQ ID NO: 515 - protein, 614 aa, Solanum lycopersicum
MAKMVSPDAISTILANPSPDSSSDLPEIIVQVVDLKPTGNRYMFSANDGKMKIKGILQSSLSSEVISGSIQNLGLIRVIDYTLNDIPTKNEKYLIVTKCEAVSPALEVEYKAEVKSEDTGIVLKPRQEETGIVLKPKQEYQTKSAAQIVHEQSGNMAPTARMAMTRRIQPLVSLNPYQGNWTIKVRVTSKGNMRTYKNARGEGCVFNVELTDEDGTQIQATMFNEAAKKFFDKFELGKVYYISKGTLRVANKQFKTVQNDYEMTLNENSQVEEASNEEAFIPEIKFNFVPIDELGPYVNGRELVDVIGVVQSVSPTMSIRRKSNNETVPKRDITIADETKKTVVVSLWNDLATHVGQELLDMADKSPVVAIKSLKVGDFQGLSLSALSKSNIVVNPDLPEAKKLRSWYDSEGKETSLASIGSGMSPSTKSGARSMYTDRVSLLHITSNLSLGEEKPVFFSLKAYISFIKPDQTMWYRACKTCNKKVTEAFGSGYWCEGCQKNDAECSLRYIMALRVSDASGEAWLSTFNDQAEKILGCSADELDKLKSEEGETAYQMKLKEATWVPHLFRVSVAQQEYNNEKRQRITVRAIAPVDYEAESKYLLEEMSKMNIAI

SEQ ID NO: 516 - protein, 496 aa, Solanum lycopersicum
MEGAATAQALSRIGLAGLAVMGQNLALNIAEKGFPISVYNRTTSKVDETLDRAQNEGQLPLIGQYNPRDFVLSIQRPRSVIILVKAGSPVDQTIAALSEYMEPGDTIIDGGNEWYENTERRIDEASSKGLLYLGMGVSGGEEGARNGPSLMPGGSYGAYTNIKDILEKVAAQVEDGPCVTYIGEGGSGNFVKMVHNGIEYGDMQLISEAYDVLKNAGGLSNSELADIFAEWNRGELESFLIEITADIFNVKDELTGNGELVDKILDKTGMKGTGKWTVQQAAELSIAAPTIAASLDSRYMSGLKDERVEASEIFRKEGLKEEISSDINGISSVDKKRLIDDVRQALYASKICSYAQGMNLLRAKSSEKGWNLNLGEMARIWKGGCIIRAVFLDRIKKAYQRNPNLANLMVDTEFAREMVQRQAAWRRVVGLAVQKGISVPGMSASLQYFDTYRRSRLPANLVQAQRDYFGAHTYERVDKPGAYHTEWAKLARKARV

SEQ ID NO: 517 - protein, 536 aa, Solanum lycopersicum
MGSLFLQKGVLVWLFLFSLRFICGTKAQGTVFIDGKIAIGRIDRHFICATLDWWPPEKCDYGTCAWDYSSFLNLDLNNIIFLNAIKAFSPLKIRLGGTLQDKVIYQTEDHQQPCVSFVRNTTEMFGFTPGCLPLSRWDELNAFFNKSGASIIFGLNALYGRSVHPDSLSVGAWDPSNAESLIRYTVKKGYDIHGWELGNELSGSGVGTRVAADQYASDTIALHKIVKDAYENSETKPLVLAPGGFFDEGWFRELVNKAGASFDVATHHIYNLGPGRDEHLLEKILDPSYLDGEADTFSKLQNILKTSGSSVVAWVGEAGGAYNSGRNHVTNAFAFSFWYLDQLGMSAAYDTKTYCRQTLIGGNYGLLNTTTFEPNPDYYSALLWHRLMGRNVLATSFSGTKKLRAYAHCAKQSQGITLLLINLDGNTTIHPRVDFNGTMLHQQKHRHHHNHRKSSIKLPRSNKVASNTREEYHLTAKDGNLQSQTMLLNGKALIVDSSGNIPTFEPIYVNSTEAITVAPLSIVFVHIPYVLLPACS

SEQ ID NO: 518 - protein, 440 aa, Solanum lycopersicum
MAAAKRFLDNSNPDPKQPNYKRMRSSTIPSVIKEAMKANFLENVSSALEPMLRRVVVEEVEKGLRRYSCRSLTRSPSLRIKALEPSNLRLIFNKKLSKPIFTSSKVVAGDGQSLQILLVDTSGEGMVPTTLPYPIKVELVVLDGDFPSGETETNWSREEFDKRVVKERTGKRPLLTGELNFTMREGVVPVGEIEFTDNSSWIRSRKFRIGAKVVQIGNNQTSVRIIEAVTESFVVKDHRGELYKKHYPPALGDEVWRLEKIGKDGTFRKKLSSKGINTVQDFLKLATIDTQQIRTILGTGMSDKMWEVTYKHAKTCEMGSKLFMARGSNYVLILTPICEVVRAVIDGQIYPTHDLTGIQKAYIQNLVKEAYTNWSSLEEVDGLVNEPALLTQGEPMVDQYPNVHQQQQPMIRSYQRNTILTDASEQLIEYNDWIGNPNYI

SEQ ID NO: 519 - protein, 501 aa, Solanum lycopersicum
MDFFYKAKAVKLKSHLDKYLVADDDQENIRQSRNGSSRKARWLVELVEAENSHFIRLKSGSGKYLTASDEPFLLGMTGKKVIQTLPEEMKDLRIEWEVIRDGFQVKLRGFGGKYLRANGGMPPWRNKVTHDNPYSGSTQNWILWNVEPIDVPENESLTEYLTMVSSFSSISDELLSLDLGSPTSVHSSFSFSPRRAKISLPKRSAMELFHKAKAVRLQSHHEKYLTAEEDEESVTQDRNGASKNAKWTVEFVEKTENVIRLKSCYGKYLTASNQPFLLGMTGRKVLQTLPNRLDSSIEWEPIREGHQVKLRTRYGQFLRGNGGLPPWRNSVTHDIPHRTKTQDWVLWDVHVVEILAHSTAETVAETTVVGGNSDSFASESSSATTTGSSKSYSFSRQESSDSLISSPPKLVDGRLIYYHVTDEFGEIDEGAEGLCITFKGNSVEDLKKRLEEETGLEDITVCTRSALNGKLYPLRLQLPPNNANMNVIILPSSSKEASDIA

SEQ ID NO: 520 - protein, 190 aa, Solanum lycopersicum
MSVISKLTLLIISIACIFQVSSLSADGSSLVPLIIDQMISSNPANTFLDPFKVLEQIPFGLENTLLARVDWKETAKGHVISVEVPGLKKDDIKIEIEENRVLRVSGERKKEEEKNDEENHWHCVERSYGKFWRQFRLPENADIDTMKAKLENGVLTISFAKLSADRIKGPKVVSIESKQQGKESSVREEL

SEQ ID NO: 521 - protein, 338 aa, Solanum lycopersicum
MRMGVENVVGYEREVEEEEEEREMEMVVAHGSPQQQMKLVVVGYALTSKKTKSFLQPKLVGLARNKGILFVAIDQSKPLSDQGPFDIVLHKLSGSKWSRILEDYRQTHPHVAVLDPPDAIQQVYNRQYMLEEVADLNLSDSYGKVGVPRQLVIEKDPSSISDAVDKAGLSLPLVAKPLVAKSHELSLAYDMVSLQKLEPPLVLQEFINHGGVLFKVFIVGEAVKVVRRFSLPDVSKLELSNNAGVFHFPRVSCVAASAEEADLDPSVGELPPRPLLERLAKELRRRLGLRLFNLDIIREHGTKDRYYVIDINYFPGYGKMPEYEHIFTDFLLSLMKQK

SEQ ID NO: 522 - protein, 1161 aa, Solanum lycopersicum
MGLIDSQSLSSSPVKITVTSSPTGGCHGLTSPIRRHSLSTNPNSPLSGKGLRGSSGGRYLSMSKESTDEFVAYTVHIPPTPDNRTVVDSQNSPIGVGSSRKSYGYGNPSDGYIKDTIFTGGFNSATKAHVRKSSEDEPMVMKCKTMCQMEGCDEKKAEEKCECGFVICRECYLDCVGIDGGYCPGCKESYKGISDDESDEPRSEAKDQANPLPSRGRGGRMEKNFSLVQSFKNPNQDFDHTRWLFETKGTYGYGNALWPSDGHEFGRGIDRSENPPDFSDRRNRPLTRKVGISAAIISPYRLLMVLRLGALACFLTWRISHPNHDALWLWIMSVVCEVWFAISWLLDQLPKLCPVKRITDLSVLKERFESSGPNLRNPKGLSDLPGIDVFVSTADAEKEPPLVTANTILSILAVDYPVEKVACYLSDDGGSLVTFEALAEAASFARIWVPFCKKHKIEPRNPESYFGQKRDPLKNKVKLDFVRDRRRVKREYDEFKVRINALPESIRRRSDAYNTQQELRAKRKQVELGEDLSEPIKVPKATWMSDGTHWHGTWSSAEEGHSRGDHEGIIQIMLVPPNAEPLYGNEVDEKNMIDTTVVDVRLPMLVYVSREKRPGFDHNKKAGAMNALVRASAIMSNGAFILNLDCDHYIYNSLAMREGMCFMLDKGGDRICYVQFPQRFEGVDPNDRYANHNTVFFDVGMRALDGLQGPMYVGTGCIFRRIALYGFSPPRATEHRGWFGSRKTRKLLRKPNIQKDQEDDEMFLPMIGNKDDEEEVSRSLLTKQFGNSIPLVDSIAVAEFGGRLLHELRGKGCQGRPAGSLAVHREPLDASALAEAVGVISCYYEDKTEWGNRVGWIYGSITEDVVTGYRMHNRGWRSIYCVTKRDAFRGTAPINLTDRLIQVLRWATGSVEIFFSRNNALFASPRMKFLQRVAYFNVGMYPFTSIFLLVYCLLPALSLFSGKFIVQSLNVTFLVFLLAITITLSMLALLEIKWSGITLHDWWRNEQFWLIGGTSAHPAAVIQGLLKVIAGVDISFTLTSKSATPDDGEDEFAELYEFRWTVLMIPPITIILINMIAIAVGTFRTVYSPFPQWSKLLGGVFFSFWVLSHLYPFAKGLMGKRGKIPTIVFLWSALICIVISLLAVYVYPPSGHQDFSSFQFP

SEQ ID NO: 523 - protein, 701 aa, Solanum lycopersicum
MAYQGGNLKSTAINGVKMYTVAGQHRSVATWLPPKKLRALRKDPGYMQRVDLIQDLKFETATTRIKVTPDGEYLIASGIYPPQVKVYELRELSLKFERHLVSEIVNFQVLGDDYSKIAFLCADRSVCLHAKYGSHYKLRIPRMGRDIIYDSWSCDLLCAASSPDLYRINLEQGRFLSSLCTRSPALNVVSRSKVHGLVACGGEDGALECFDMRVRSSVGRINAVAPAGGGDQEVTAIEFEGDGGYLMAVGSSDGKVLVYDLRSSQPMRIKDHMYGSPILNIKWHKTLNTERTKLITADSHIVRVWDPETGEGMTSIEPTGGRINDLCAFTGSGLMLLALDSSQIPSYFIPSLGPAPKWCSYLENLTEELEEQPQTTIYDDYKFLTKEDLEKLNLTNLIGTNLLRAYMHGYFIDYRLYKKAHAASNPFAYDEYIEQRKKEKFEKERDSRITIKRRLPKVNRTLVEQLLENEEAENVKEDVDDVDAKKTSKKKKGLTMDVLEDERFKRIIENKDFEIEEDSHEYRALHPMPSLKRPSLVEEHFEPVMEGEEASDSDAQSSEDEQENDRNTRKKARVPRMYEVKDDRHAEAFSNHISLAKEDALSLGERVAGLSNGRASHDMNNIKVGPGGSREVSFFSRSSAKYVEDDGEKETRTEKRRGVQSLKLKPERSGFQGSGSRGRGRGGRGRGMGRGRGRGRGRGRG

SEQ ID NO: 524 - protein, 196 aa, Solanum lycopersicum
MASEPAKVVPPTEAPVVEPEKAAPPPTTWPTDYFAVADVVLRLLVFASAVVSVVVMSTSKETKMLPNPRPAKFTHSPALIYFVAALSVAGFFSLITTLGSLYSLIKPGCCAKIISHFIVIDVLLLGIVASATGAAGSVTYVGLKGNTHVRWGKVCTLYGKFCRYVGASIGVSLFASVMLVLLVLLSVYSLSKKIPK

SEQ ID NO: 525 - protein, 1705 aa, Solanum lycopersicum
MQKRGSYPVFQSGHGFHRNSPEFSKRRIPNFTIQLRATPVNWKLNWQHLNSLITKLPFTPENPSVVDSSYIVGTLSYVEWCQTLEVMVKLWELRLSGEHCFNPILKAKVELPSDKEELNERIEGVFLEKLNRLINGVLVQKWQKKLGFVIDEIGKISLLLKKPNRIGVYQELCKKKKGIEGERDLILSRIDEYKNGIKCIIDNLEDSKNYEDVKVFDFGEGIDWNRIHFIMMRECRRLDDGLPIYGFRQQILQQILSHQVTVLVGETGSGKSTQLVQFLADSGIAGDGSIVCTQPRKLAANSLASRVREESQGCYDDCSISCNPPHSSDQQLDSKVIFMTDHCLLQHYMGDKNLSNISCIIVDEAHERSLNTDLLLALIKKLLHQRFDLRLIIMSATVDANQLAGYFFGCGTFHVAGRTFPVDIKYVPCEDNAHYAVGAIASYVHDVIKMVTEIDRTEGVGAILAFLTSQSEVEWACEQFKAPLAIALPLHGKLSYDDQNRVFLSYPGKRKVIFTTNLAETSLTIPGVKYVVDSGMVKESRFEPGSGMNVLRICSVSQSSANQRAGRAGRTEPGKCFRLYSQSDFEDMPRHQEPEIRKVHLGVAVLRILALGIKNVQDFDFIDAPSPKAIEMATRNLVQLGAVTQRDDASYELTEGGLKLVKLGIEPRLGKMILSCFDQRLGKEGVVLAAVMANSSSIFCRVGSEGDKLKSDCHKVQFCHPSGDLFTLLSVYREWEIVPREKKNSWCWDNSINAKSMRRCHETVLEMEACLQNDLNMILASYWCWHPQVHNKCDEVLQSIILSSLAENVAVYSGYDQLGYEVALTGKCVQLHPSCSLLNFGQRPRWVVFGDVLASANEYLVCVTAFEFSSLVSLTPAPLFDFLKMDARKLEKKVLTGFGVLLLKRFCGKFNSSINNLVSRIRTSCKDERIGIQVNVDENEVLLYASSRDMECVTLQVNDALEYESKLLRNECLEKCLFNGGSASVALFGAGAVIKHLELEKRCLTVDIFPSNGNAIDDKELLMCLERATSGNICMVHKYYNMGQDKVENKWGTVKFLTPDAAEQATSLNKVEFNGGFLKMVPSRSINCSDQKMFRSVLKAKVSWPRRYSKGVGFLRCDPMDVPLILDDLSDLMIGGNVIRCEASDKNPNNIVIARLDKDMAETEILEVLRATTNRRVLDFFLVRGDSVEDPPIATCEEALRKEISPFMPKKVPFVNSVRVQVFQPKLTEYFAKATITFDGSLHLEAAKALEQIDGMVLPGCLPWQKIRCERLFHSSVSCPAAVYHVIRNQLDFLLASLRQRKVGKCELQRNDNGSYTVRISATATKVVADLRRPLEQLMKGKIVDHVDITPKVVRLLFSREGNNIMRTIQRETGTYIYFDKHSLLVSIFGSLDNVDRARQRFIDSLLALHENKQLEVHLRGGHLPHDLMKRVVQTFGPDLSALKEKVPGAEFSLNTKRHCIYMNGTKDMKQNVEDIISEIAQRSFPTQTTGDDADCPVCLCGLEDPYKLEACCHLFCRTCLLEQCESAIKSREGFPICCLHQGCAEPILLADLKSLLSIEKLEELFRASLGAFVAANGSTYRFCPSPDCPSVYRIADPDMVGAPFACGACYVETCTSCHMEYHPYLSCEMYQKVKNDPDCSLEEWSKGKENVKKCPVCRCTIEKVDGCNHIECKCGNHVCWVCLRFFDTSDNCYDHLRSVHRSIT

SEQ ID NO: 526 - protein, 382 aa, Arabidopsis thaliana
MELPLLSYASSASFSRTGLCSSSSSSSTSIYEFPERRRSLKLRFNGGERSRSVIASAERSSEGIEKTTDTVGGGGGGGAGRFAGTAMEVTTLDRGFANSTTVDFPIWDKIGAVVRLTYGIGIYGAMAVAGRFICSVTGIDSSGGFDPSLDALLAGLGYATPPIMALLFILDDEVVKLSPHARAIRDVEDEELRSFFFGMSPWQFILIVAASSIGEELFYRVAVQGALSDIFLKGTQLMTDSRGMASLTGVFPPFVPFAEVFAAVITATLTGSLYFLAASPKDPTYIVAPVLRSRRDDFKKLLSAWYEKRQMKKIYSPLLEGLLALYLGIEWVQTDNILAPMMTHGIYSAVILGHGLWKIHDHRRRLRRRIEHIRSEATDKLI

SEQ ID NO: 527 - protein, 852 aa, Arabidopsis thaliana
MRDFVIVFGSSSAITNPHHHHRRCYATAPESNRKTKSNSSFTKLLPSLPQQHSPSPASVSATHSLSSHFSNVVRWIPDGSLEYYADFASKLAEDGRIEDVALIAETLAAESGANVARFASMVDYDLLSKGISSNLRQGKIESVVYTLKRIEKVGIAPLDLVDDSSVKLMRKQFRAMANSVQVEKAIDLMEILAGLGFKIKELVDPFDVVKSCVEISNPQLAIRYACLLPHTELLLCRIIHGFGKKGDMVSVMTAYEACKQILDTPNMYICRTMIDVCGLCGDYVKSRYIYEDLLKENIKPNIYVINSLMNVNSHDLGYTLKVYKNMQILDVTADMTSYNILLKTCCLAGRVDLAQDIYKEAKRMESSGLLKLDAFTYCTIIKVFADAKMWKWALKVKDDMKSVGVTPNTHTWSSLISACANAGLVEQANHLFEEMLASGCEPNSQCFNILLHACVEACQYDRAFRLFQSWKGSSVNESLYADDIVSKGRTSSPNILKNNGPGSLVNRNSNSPYIQASKRFCFKPTTATYNILLKACGTDYYRGKELMDEMKSLGLSPNQITWSTLIDMCGGSGDVEGAVRILRTMHSAGTRPDVVAYTTAIKICAENKCLKLAFSLFEEMRRYQIKPNWVTYNTLLKARSKYGSLLEVRQCLAIYQDMRNAGYKPNDHFLKELIEEWCEGVIQENGQSQDKISDQEGDNAGRPVSLLIEKVATHMQERTAGNLAIDLQGLTKIEARLVVLAVLRMIKEDYMRGDVVIDDVLIIIGTDEANTVSGKQEITVQEALVKLLRDELSLVVLPAGQRNIIQDAHCVDDADQENTKSFVSISSTRRPAILERLMVTKASLYQWLQRRK

SEQ ID NO: 528 - protein, 212 aa, Brassica juncea
GGSLPMRKTALPLRTRGGNAAGARMSATAAGSYAMALADVAKRNDTLELTSADVEKLEKVFSDPQVLNFFANPTVELEKKRLVIDEIVKSSALQSHTSNFLNILVDANRINIVRDIVKEFEMVYNKITDTQLAEVRSVVKLEPPQLAQIAKQVQKLTGAKNVRVKTVLDPSLVAGFTIRYGDSGSKLIDMSVKKQLEDIAAQLELGEIQLAA

SEQ ID NO: 529 - protein, 156 aa, Brassica juncea
GALSDMFLRGTQLMTDSRGMASLTGVFPPFVPFAQAFAAVITATLTGSLYFLAASPKDPIYIVAPVLRSRRDDFKKLLSAWYEKRQMKKIYSPLLEGLLAFYLGIEWVQTDNILAPMMTHGIYSTVILGHGLWKIHDHRRRLRRRIERLRSETADE

SEQ ID NO: 530 - protein, 188 aa, Brassica juncea
ALSSLLNHPEELSKAREEIDSKVGFNRLVEESDISSLPCLQNIVSETFRLYPAGPLMVPHVASEDCKVGGYDMPQGTTLLVNLWAMHRDPQLWDDPETFKPERFEKEGEAHKLMTFGLGRRACPGSGLAQRLVSLTLASLIQCFEWERIGEEGVDMTEAGGVTMHKAKPLVAMCRARTFVGKILHQNA

SEQ ID NO: 531 - protein, 447 aa, Brachypodium distachyon
MAKIQPLPASAGAASPSDEAACTTTTTYTVWMKSLVFNGNGCTVYGADGAVAFRVDNYGCRGGREACFFMDRAGKALIAVRRRGFGAFRRWEVSRCCHGAAGAEDEDETETAAPWFAVRRGKGGAPMVAMHGGAGPCYRVDAEGGKKEKKNKAGYRVVGAVDGAVAAEVARKTTAAGVPLGDDVLSLTVGPGTDRLLALGLVVVSAAAADAVAYAVIVLNQRLPRFASLLWTRAQLRVCADGGANRLFDGMPELHPGEDPDEVRARYKPDAIKGDMDSIRPEVKEFYSNLGAKIVDESHDQDTTDLHKCISFITRNPPGPDKANLCILVLGALGGRFDHEMGNINVLYRFSNIKIILLSDESLIFLLPKTHNHEILVDQSIEGPHCGLIPMGMPSSSSTTTGLRWNLDNTSMSYGGLVSTSNIVDDKKVMVTSDSDLIWTISLRNHT

SEQ ID NO: 532 - protein, 613 aa, Brachypodium distachyon
MASGDPFAAAGDVTGDSSSSSPTTARLLEALAALSQVFESGDPASSGAATAAVVEIFGGSADADAGGDAARPDTANMVSEQLLREVHAFLSCPSSNQMAIDALSLELPKPVAKLGARMGNCRDIAKTIIELLVSNCNPRDMLSILCEALDTPLAFNGSAYFVLILDMLARVLIMIQRRHIEQVKVVLPAVLRVMHAIISECDEEHGTTAVDLFNAALQIGNAIQEMCKTMVNHKKEELCLILGLYSLQNIALISESKHQHILSACGSLVLQHFKIVTFCGFTYLGLLTGNEVTSATNKLSKEEDADFLGCFSFTVEGASLLAVWTYMHDDMSKYAGAELESAIKEVQDNYIRKWEAINMFRYVLSSVNYPWVIKSYSIDLLLTLVDENCIEETKDHEDFLYSTQFFATLKAIESVMIAAPDPLMRKKAFATLKKVISVVPSSQRFDILQSLIKNSMFPSLTAIHLDLVKNEVVRESSRAKDLIESDQSQDAGDSPHWASQSLELVELILRPPEGGPPCLPDHSEQVLSALNLLRLILIIDSRGSRSLKLFRQETTRKVYSEWLIPLRPVVAGVQSEMEKDDSEGANQMMCMLNPVQLVLHRCIELVEEKMKGS

SEQ ID NO: 533 - protein, 240 aa, Brassica napus
MFLLKTWRSTAFGIYGYMNFTKNGFLDHSKKFKPEDMQIQIQGKNCVVTGANSGIGYAAAEGLASRGATVYMVCRNKERGEEALSKIQNSTGNQNVYLEVCDLSSVNDIKSFASSFASKDVPVHVLVNNAGLLENKRTTTPEGFELNFAVNVLGTYTMTELMLPLLEKASPDSKVITVSSGGMYTSPLTTDLQFSGEKFDGVLQYARNKRIQAALTEKWADKPKNIGIGFYSLHPVWADT

SEQ ID NO: 534 - protein, 271 aa, Brassica napus
VKVIKGDVSSSEISLLKKLNHSNIIRLSGFCIREGASYLVYEYSENGSVSDWLHSSNKKKSLTWRQRVEICRDIAEALDYLHNYVTPPHIHKNLESNNVLLDSNFKAKISNFGVARILDEGDLDLQLTRHVEGTQGYLAPEYVENGVITPKLDVFAFGVVVLELLSGKEAVTTVDKEEKEEMLLCREINNVLGGENVREKLKEFMDSSLGDEYPLELAFTMAQLAKSCVAPDINSRPSIAQVLTTLLMIVSSSIDWEPSHDLLHDSGSLGN

SEQ ID NO: 535 - protein, 485 aa, Brassica napus
ASSNRRMPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARDNAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEIAAINMMRDGRTELTTDDLLQAAQIEERGMLDRKDRSSETWRQVAINEAAMAVVAVNFPDLKNIEFLTINPRAGRELGYVRVKMDHIKFKEGMLSRQSLLDHITVQLAPRAADELWYGEDQLSTIWAETSDNARSAARSLVLGGLSEKHHGLNNFWMADRINDIDVEALRILNMCYDRAKEILQKNRTLMDEVVDKLVQKKSLSKQEFFTLVELYGSIKPMPPSILELRKIKRLQLQEAVMKQDMTSARNS

SEQ ID NO: 536 - protein, 347 aa, Brassica napus
VQELIKSKPNKVPERFIREANERGVLVSHKTHLHHHIPVVDLSKLSKPHTDDDFLFEILKLSQACEDWGFFQVINHGIEVGVVEDIEKVAKEFFEMPLEEKKKYPMEPGTVQGYGQAFIFSEDQKLDWCNMFALGVHPPSIRNPKLWPSKPARFSENLEGYSKEIRKLCKRLLKYIAISLDLKEERFEEMFGEAVQAVRMNYYPPCSRPDLVMGLSPHSDGSALTVLQQSKNSCVGLQILKDNTWVPVLPLPNALVINIGDTVEVLTNGKYKSVEHRAVTNRERERLTIVTFYAPNYEVKIEPMGELVDDETNPCKYRSYNHGDYSYHYVSNKLQGKKSLDFAKILN

SEQ ID NO: 537 - protein, 506 aa, Medicago truncatula
ELEEEALRPPDLSNLQRRIKEIVRVLSNFKALRQDGATRKDYVDQLKTDIRSYYGYNEFLIGALVEMFPVVELMELIEAFEKPRPICLRTNTLKTRRRDLADVLINRGVNLDPLSKWSKVGLVVYDSQVPIGATPEYMAGFYMLQSASSFLPVMALAPQEKERIVDMAAAPGGKTTYIAALMKNSGIIFANEMKVPRLKSLTANLHRMGVSNTVVSNYDGKELPKVLGFNSVDRVLLDAPCSGTGVISKDESVKTSKNLEDIKKCAHLQKELLLAAIDMVDSYSKSGGYVVYSTCSIMVAENEAVIDYVLKRRDVKLVPCGLDFGRPGFTKFREQRFHPSLDKTRRFYPHVHNMDGFFVAKLKKMSHPKPARTSETFEKDEKETELVIDDDKPSNGVEENGKHSFELESKKRKKDKFPSKPSNDVKANVKEASEPESKKRKKDKFPSKPSNDVKANVTETSEPKPKRVKRKPPSREEISKAREEKRLALIEKKRKSGKQQRGKNDE

SEQ ID NO: 538 - protein, 512 aa, Medicago truncatula
MMLVCHLHLLCNIHSYLLVFLLIIKRNSNQVHNKLIYNVIAGEHYIFETIKLDDIATLVYTSGTTGNPKGVMLTHQNLLHQIKHLSDVVPTTEAGDKFLSMLPPWHAYERACEYLVFSRGLEHIYTTVRNLKDDLGRYKPHLMVSVPLVFETLYSGIMKQISTSSLVRKLVALTFIRVSLGYMECKRIYEGKCLTKNQKAPSYLYAMLDWLWARIMATILYPVHMLANKLVYSKIRSTIGISTAAISGGGSLPSHVDKFFEAIGLNLQNGYGLTETSPVIAARRLGCDVIGSVGYPLKHTEFKVVDSETGEVLPPGSKGILKVRGPQLMKGYYKNPLATNRVIDSDGWLNTGDIGWIAAHHSTGRSRNSGGVIVVEGRAKDTIVLSSGENVEPGELEEAATRSNLIQQIVVIGQDKRRLGAIIVPNKEEVLKAAKELSIIDSNSSDVSQEKVTSLIYNELRTWTSGFPFQIGPILLVNDPFTIDNGLMTPTMKVRRDRVVAQYRDQIENLYK

SEQ ID NO: 539 - protein, 613 aa, Medicago truncatula
MAVPPSATPASLYVGDLHPDLSDSQLHDAFSDFKTLASVRICRDSSSGKSLCYGYVNFLSPHDAIRAIEVKNHSTLNGKAIRVMWSRRDPDARKSCIGNVFVKNLAESIDNSGLEDMFKKFGNILSSKVVMSEDGKSKGYGFVQFETEESANAAIERLNGYLVGDKQIYVGKFVKKSDRISSGPDTRYTNLYMKNLDLDISETLLREKFSSFGKIISLAVAKDSNGMSKGFGFVNFDNPEDAKRAMETMNGLQLGSKILYVARAQKKAEREQILHQQFEEKRKEQVLKYKGSNIYVKNIDDNVSDEGLRDHFSVCGTITSAKIMRDDKGISKGFGFVCFSTPEEANKAVNSFHGFMFHGKPLYVSLAQRKEDRQAQLQLQYAQQIAGLAGPSTAIVPGGYPPFYYTATGVVSHAPPRAGLVYQPMALRPGWRANGSAPPARSFQQSPTPVVSNNNTRQHRQNRGRMNGHAVSQGNTHSGTYMPQAQQASQSAISSRESSTQQRTGQAKYVPSGRHREMEKGSGLSSSGGSLGPEVLHSMLANATPEQQKEILGEHLYMLVQKIKPNLAAKITGMLLEMDNVEEAFQVLKNSKAKVSGQDVLHSNFLSAEVAVN

SEQ ID NO: 540 - protein, 603 aa, Glycine max
MVADEASPFETSDMLATLLASTPLLSESWRLCTTVAATAPRSFMTEQHGGGGVVYVAFPGVEMAAGSDSICRNLVALESIGDVPLFSARRRNKEGDEPVMVHAGMLNLLSTFFEPFQKQMLALMGNSKTKSIVLTGHSIGGATASLCALWLLSYLHQTYSSISVSVLCITFGSPMLGNGSFSRAILRERWGGNFCHASLCSHNTLHCSNKLPASVLATVHDCSRLWEACTTQDEEGSAPVLFHPFGSYLFVSSDGAVCVDCATSVIKMLHLMFASVSPACSIEDHLKYGDYVKNLSLQFLNQNNSVQGNIPDSSYEAGLELSVQSSGLGNQESAIEPAKECLKMTRRMGPSPTKNAANLSITLSKFVPYRTEIEWYKAWCHQQVDQMGYYDLFKRRRSTSKMAMKVNMNRHKLARFWNNVIEMWERNELPHDVAVRAKWVNASHFYKLLVEPLDIAEYYGKGMHTTKGHYIQHGREKRYEIFDRWWKDAMGNTEENNERRSKFASLTQDSCFWARVEEARDWLNSVRSESDTTKLAVLWDNIEKFEKYAMELIDNKEVSEDVLAKNSSYSIWMEDLRGLRELKAKVKTFSHHFNPFLDGEVIP

SEQ ID NO: 541 - protein, 357 aa, Glycine max
MNLKQYCCFLKDEGLNKIQVSNKKNSRDYPWEMYTLKELLRATNNFHQDNKIGEGGFGSVYFGRTNSHAYNKWNLQIAVKRLKTMTAKAEMEFAVEVEVLGRVRHQNLLGLRGFYAGGDERLIVYDYMPNHSLLTHLHGPLAKECQLDWPRRMSIAIGAAEGLAYLHHESTPHIIHRDIKASNVLLDPEFQAKVADFGFAKLVPDGVTHLTTKVKGTLGYLAPEYAMWGKVSESCDVYSFGILLLEIISAKKPIEKFPGGVKRDIVQWVTPYVNKGLFNNIADPKLKGKFDLEQLKNVTTIALRCTDSSADKRPSMKEVVDWLKNGVGSTWGEENIPTLSIKNGDEGNDKDDKLKNN

SEQ ID NO: 542 - protein, 419 aa, Glycine max
MNEIDVPSFFLCPISLEIMKDPVTVSTGITYDRESIETWLFSKKNTTCPITKQPLIDYTDLTPNHTLRRLIQSWCTMNASHGIERIPTPKPPVNKNQISKLLKDASHSPLTCLRRLKSIASGSETNKRCMEASGAVEFLASIVINNNSNIDSSNEADSNDGSGFELKTSASDEALSLLHNLHLSEQGLKTLLSFRNGEFIESLTRVMQKGFFESRAYAVFLLKSTSEVAEPVQLLHLRQELFVELVQVLKDQISQKTSKATLQTLIQFSPWGRNRIKAVEADTVPVLVELLLDCKERKPCEMMLVLLELLCQCAEGRAELLSHAAGLAIVSKKILRVSTLANDRAVKIILSLSRFSATPHVVQEMLKLGVVAKLCLVLQVDSGNKAKEKAREILKLHARAWRNSPCIPNNLLNSYTNYV

SEQ ID NO: 543 - protein, 313 aa, Glycine max
MHTKSDSEVTSNSMEQSSPARSPPRRPLYYVQSPSNHDVEKMSYGSSPMGSPHHHFHYYLSSPIHHSRESSTSRFSASLKNPRNFSSSSSWKKLHPHPNRDVDPDDHDDADHHLKQSSRNLRLYLWFFLLFLLLLTLFSFILWAASKTYKPRIIVKSIVLENLYVQSGNDGTGVPTDMLSLNSTVRILYRNPATFFGVHVTSTPLLISYYQLAIASGQMQKFYQSRKSRRSLAVVVSGHQIPLYGGVSVLGNTKEHLESVALPLNLTFVVRSRAFILGRLVKSKFFRRIRCSVTLHGNKLGKHLNLTDSCVYK

SEQ ID NO: 544 - protein, 697 aa, Solanum lycopersicum
MSRPLHRGVSGGGRLSVNGPDFWDDSQMKDKIEKEDLERNRSPGDLTYSPTKFLCRILFPDNSPSKHNLGENGLLSDPFSPGTGRNRLKYALVLIRLSLVVIILLALTGSFWWTISITSSSRGHIYHGYRQLQEQVVSDLRDIGQLSLDATNVKDIEYCPPESENFIPCFNVSENLDLGLSKGEEVDRHCGPGSRQNCLVLPPVNYKIPLRWPTGRDVIWHANVNITAQEVLSSGSMTKRLMMLEEEQISFRSDSAMFDSIEDYSHQIAEMIGLRNESNFVRAGVRTILDIGCGYGSFGAHLFSSQLLTMCVANYEASGSQVQLTLERGLPAMIGSFNSKQLPYPSLSFDMIHCAECHVDWDQKDGIFLVEVDRLLRPGGYFVWTSTITNTQRSVRNKVSLKKWNFVQNFAESMCWKLLAQQDETAVWKKTSLKKCYFARRPGVGPSICSKGQDIESPYYRPLQACIAGTQSRRWIPIEERTKWPSRAKLNSSELKIHGLLSEALAEDSLNWNSAVNNYWSLLSPLIFSDHPKRPGDDDPSPPYNMLRNVLDMNAHFGGLNAALLDARKSVWVMNVIPTSGPNYLPLILDRGFVGVLHDWCEAFPTYPRTYDLVHANGLLSMEFGQHIRCPMFDLFIEMDRVLRPEGWVILRDTVPLIELARSHAARLKWDARVIEVESSDEKLLICQKPFSRRQAS

SEQ ID NO: 545 - protein, 526 aa, Solanum lycopersicum
MRSHHILSHIYMNEPCFPEENSSISCIMNHLPNKRRRRRKEIVQQTPTNSSAGGGGNDEFGSENQGAVKTKELKQILTSLLLLEEQEKSEFAKEEEEDKHLLEANHKKTTKVMWDYYSNVQQHHSDLEQLDGVRKRKGRGNSAALTATACALASAAAEEEGVSSNKSTDKGAPHRRLWVKNRSKAWWDQCNSPDFPEEEFKKAFRMGKDTFELICNELTSVVAKENTMLRDAVPVKQRVAVCIWRLATGEPLRLVSKRFGLGISTCHKLVLEVCTAIRTVLMPKYLQWPDEKKMRDIKDEYEDMSGITNVVGSMYTTHIPIIAPKISVAAYFNKRHTERNQKTSYSITVQGVVDPRGVFTDVCIGWPGSMPDDQVLEKSALFQRANTGLLNNVWIVGSSGYPLMDWVLVPYTQQQLTWTQHAFNEKIGEVQRVAKEAFVRLKRRWSCLQKRTEVKLQDLPVVLGACCVLHNICQMRNEEMDPELNFELIDDEMLPEIQLRSTNARLARDAIAHNLLHHNHAGTSLL

SEQ ID NO: 546 - protein, 1697 aa, Solanum lycopersicum
MQKRGSYPVFQSGHGFHRNSPEFSKRRIPNFTIQLRATPVNWKLNWQHLNSLITKLPFTPENPSVVDSSYIVGTLSYVEWCQTLEVMVKLWELRLSGEHCFNPILKAKVELPSDKEELNERIEGVFLEKLNRLINGVLVQKWQKKLGFVIDEIGKISLLLKKPNRIGVYQELCKKKKGIEGERDLILSRIDEYKNGIKCIIDNLEDSKNYEDVKVFDFGEGIDWNRIHFIMMRECRRLDDGLPIYGFRQQILQQILSHQVTVLVGETGSGKSTQLVQFLADSGIAGDGSIVCTQPRKLAANSLASRVREESQGCYDDCSISCNPPHSSDQQLDSKVIFMTDHCLLQHYMGDKNLSNISCIIVDEAHERSLNTDLLLALIKKLLHQRFDLRLIIMSATVDANQLAGYFFGCGTFHVAGRTFPVDIKYVPCEDNAHYAVGAIASYVHDVIKMVTEIDRTEGVGAILAFLTSQSEVEWACEQFKAPLAIALPLHGKLSYDDQNRVFLSYPGKRKVIFTTNLAETSLTIPGVKYVVDSGMVKESRFEPGSGMNVLRICSVSQSSANQRAGRAGRTEPGKCFRLYSQSDFEDMPRHQEPEIRKVHLGVAVLRILALGIKNVQDFDFIDAPSPKAIEMATRNLVQLGAVTQRDDASYELTEGGLKLVKLGIEPRLGKMILSCFDQRLGKEGVVLAAVMANSSSIFCRVGSEGDKLKSDCHKVQFCHPSGDLFTLLSVYREWEIVPREKKNSWCWDNSINAKSMRRCHETVLEMEACLQNDLNMILASYWCWHPQVHNKCDEVLQSIILSSLAENVAVYSGYDQLGYEVALTGKCVQLHPSCSLLNFGQRPRWVVFGDVLASANEYLVCVTAFEFSSLVSLTPAPLFDFLKMDARKLEKKVLTGFGVLLLKRFCGKFNSSINNLVSRIRTSCKDERIGIQVNVDENEVLLYASSRDMECVTLQVNDALEYESKLLRNECLEKCLFNGGSASVALFGAGAVIKHLELEKRCLTVDIFPSNGNAIDDKELLMCLERATSGNICMVHKYYNMGQDKVENKWGTVKFLTPDAAEQATSLNKVEFNGGFLKMVPSRSINCSDQKMFRSVLKAKVSWPRRYSKGVGFLRCDPMDVPLILDDLSDLMIGGNVIRCEASDKNPNNIVIARLDKDMAETEILEVLRATTNRRVLDFFLVRGDSVEDPPIATCEEALRKEISPFMPKKVPFVNSVRVQVFQPKLTEYFAKATITFDGSLHLEAAKALEQIDGMVLPGCLPWQKIRCERLFHSSVSCPAAVYHVIRNQLDFLLASLRQRKVGKCELQRNDNGSYTVRISATATKVVADLRRPLEQLMKGKIVDHVDITPKVVRLLFSREGNNIMRTIQRETGTYIYFDKHSLLVSIFGSLDNVDRARQRFIDSLLALHENKQLEVHLRGGHLPHDLMKRVVQTFGPDLSALKEKVPGAEFSLNTKRHCIYMNGTKDMKQNVEDIISEIAQRSFPTQTTGDDADCPVCLCGLEDPYKLEACCHLFCRTCLLEQCESAIKSREGFPICCLHQGCAEPILLADLKSLLSIEKLEELFRASLGAFVAANGSTYRFCPSPDCPSVYRIADPDMVGAPFACGACYVETCTSCHMEYHPYLSCEMYQKVKNDPDCSLEEWSKGKENVKKCPVCRCTIEKVDGCNHIECKCGNHVCWVCLRFFDTSDNCYDHL

SEQ ID NO: 547 - protein, 225 aa, Arabidopsis thaliana
MVREEEKSRWWWFESHKSSKHSQWLQSTLAEIDAKTKAMLKLLDGNADSFAQRAETYYKKRPELISFVEDFYRAHRSLAVNFDHLKSSDHYGSRSAKVPQQSMESVCDSNSHFEDADSEIEDPLQDDASAADCKEDETWQLEQERLKLIEETDALRKQLLDKDEEKREVIRQLSLTLETLKDENLSLKRRLAHHSLKQRTVLEFKPLNKFFGKLFYIMCDGNKVL

SEQ ID NO: 548 - protein, 316 aa, Arabidopsis thaliana
MDHQHSSDSPMHESTTSSSSSSWSFGNLIKTLSTKSESVIGSYRRDLVEFGSELKKETSIIRRVASRLPDSLEIGASVASESLESVGQVIDDIGATVWKSTAKIISRGKESLEPNRDRTNQVLSLKPYRRFEMMLLALQSDKGTFVREPDDLSDFENWSLGLKLEEKRNEIVELINGNKGVKEIYEEIVPVEVDAETFWRRYYYKVYKLEQVEEARVKLVKRAISGEEDEDLSWDLDDEKEKVESRDVSSKDSDYSVISTQPSLLGSEDLGWDKMEEDIRSNEERLDWRRRAGVAVEEEEDLSWDIEDEDDDSVQQ

SEQ ID NO: 549 - protein, 852 aa, Arabidopsis thaliana
MRDFVIVFGSSSAITNPHHHHRRCYATAPESNRKTKSNSSFTKLLPSLPQQHSPSPASVSATHSLSSHFSNVVRWIPDGSLEYYADFASKLAEDGRIEDVALIAETLAAESGANVARFASMVDYDLLSKGISSNLRQGKIESVVYTLKRIEKVGIAPLDLVDDSSVKLMRKQFRAMANSVQVEKAIDLMEILAGLGFKIKELVDPFDVVKSCVDISDPQLAIRYACLLPHTELLLCRIIHGFGKKGDMVSVMTAYEACKQILDTPNMYICRTMIDVCGLCGDYVKSRFIYEDLLKENIKPNIYVMNSLMNVNSHDLGYTLKVYKNMQILDVTADMTSYNILLKTCCLAGRVDLAQDIYKEAKRMESSGLLKLDAFTYCTIIKVFADAKMWKWALKVKDDMKSVGVTPNTHTWSSLISACANAGLVEQANHLFEEMLASGCEPNSQCFNILLHACVEACQYDRAFRLFQSWKGSSVNESLYADDIVSKGRTSSPNILKNNGPGSLVNRNSSSPYIQASKRFCFKPTTATYNILLKACGTDYYRGKELMDEMKSLGLSPNQITWSTLIDMCGGSGDVEGAVRILRTMHSAGTRPDVVAYTTAIKICAENKCLKLAFSLFEEMRRYQIKPNWVTYNTLLKARSKYGSLLEVRQCLAIYQDMRNAGYKPNDHFLKELIEEWCEGVIQENGQSQDKISDQEGDNAGRPVSLLIEKVATHMQERTAGNLAIDLQGLTKIEARLVVLAVLRMIKEDYMRGDVVIDDVLIIIGTDEANTVSGKQEITVQEALVKLLRDELSLVVLPAGQRNIIQDAHCVDDADQENTKSFVSISSTRRPAILERLMVTKASLYQWLQRRK

SEQ ID NO: 550 - protein, 201 aa, Brassica juncea
MTTIAGGSFGATSSRISILTPTLSSSSLFPPLTLHQSGNKKDSQLRCAVQESSTSAVATEKKEKEKEKEDSTLEVPAKKPKPAAAKAAVAKPLREMMEEDVIPPLKAILEAQDDISEIDLSFQDDKLEGFFFKKGIQYSFWAFFPTGNLTGAKGFSISSYGSGPSTVEPFLVDERKPTANHVVFWVEKRLAAQGIIPVWNQ

SEQ ID NO: 551 - protein, 499 aa, Brassica juncea
MEEVTSTLLFIVLITLIFFIGRSRTKLKLKLPPSPPFALPIIGHLRLLKPPLHRVFLALSQSLGGAPIFSLRLGNRLVFVVSSHSIAEECFTKNDVVLANRPHTVASKHVSYDYTTMVTAPYGEHWRNLRRIGAVEIFSAHRLSKFLSIRQDEVRRLIARLARNSSHEFVKVEINSMFSDLTFNNIMRMVAGKRYYGDASEENSEAKLVRKLIADLMSTFGAGNVADYVPVLRWVTGFEKRVKELAGRFDEFLQGLVDERRAAKEKGNTMIDHLLSLQETQPEYYTDRTIKGTILSSILAGTDTSAVTLEWALSSLLNHPEELSKAREEIDSKVGFNRLVEESDISSLPCLQNIVSETFRLYPAAPLMVPHVASEDCKVGVYDMPRGTTLLVNLWPMHRDPRLWDDPEAFKPDRFEKEGVAHKLMTFGLGRRACPGSGLAQRLVSLTLASLIQCFEWDRIGEEGVDMTEAGGVTMHKAKPLVAMCRARTFVGKILHQNA

SEQ ID NO: 552 - protein, 133 aa, Brachypodium distachyon
MANNGGARRQATFTKIDELRPSTHGHNLIVKVLNSKPITFQRPQPRQMRVAECLVGDETGVVVFTARNEQVDVMKAGAIVEVRNAKVDMYKGSMRLAVDKWGIVKAAESPSELTVKEDNNLSLIEFEMITLMV

SEQ ID NO: 553 - protein, 322 aa, Brassica napus
MFLLKTWRSTAFGIYGYMNFTKTGFLDHSKKFKPEDMQIQIQGKNCVVTGANSGIGYAVAEGLASRGATVYMVCRNKERGEEALSKIQNSTGNQNVYLEVCDLSSVNDIKSFASSFASKDVPVHVLVNNAGLLENKRTTTPEGFELNYAVNVLGTYTMTELMLPLLEKASPDSKVITVSSGGMYTSPLTTDLQFSGEKFDGVLQYARNKRIQVALTEKWADKYKNKGIGFYSMHPGWAETPGVARSLPSFKESFSGKLRTSEEGADTVVWLALQPKEKLVSGAFYFDRAEAPKHLTLAGTSKSHDLIDSVIDTLHSMAALDP

SEQ ID NO: 554 - protein, 665 aa, Brassica napus
MAARTLHSLSTSPLFLLLLLSALSPPTKAQQPYVNNHQLACENRDFDNITNGFTCNGPRSCRSYLTFWSLPPYNTPNSIATLLNASAAEIQTLNNLTSLTTVIPTRRLVVIPTTCSCSGGGGFYQHNATYRLSGERQETYFSIANDTYQALSTCQAMMSQNPYGERNLTAGLNLLVPLRCACPTANQTAAGFRYLLTYLVAQGDSVSAIAEMFRSSTPAVSSGNELTSDNIYFFTPLLVPLRTEPTRIVITPPSPTPPVATPPQSPPVDPPGGSSSSHKWIYIGVGIGAGLLLLISILSLYFCYYKRRSKTSSLIEQNKLTDSSTKQSLPTTSTNQWSIALSNSSDTTSGLKSAIESLTLYRFSDLQSATSNFSEENKIKGSVYKATINGDDAAVKVIKGDVSSSEISLLKKLNHSNIIRLSGFCIREGASYLVYEYSENGSVSDWLHSSNKKKSLTWRQRVEICRDIAEALDYLHNYVTPPHIHKNLESNNVLLDSNFKAKISNFGVARILDEGDLDLQLTRHVEGTQGYLAPEYVENGVITPKLDVFAFGVVVLELLSGKEAVTTVDKEEKEEMLLCREINNVLGGENVREKLKEFMDSSLGDEYPLELAFTMAQLAKSCVAPDINSRPSIAQVLTTLLMIVSSSIDWEPSHDLLHDSGSLGN

SEQ ID NO: 555 - protein, 867 aa, Brassica napus
MAYRFPLHSSSPHSRFLSPSNHPKTPRSPRKHHTSISCQNTNDPQDEEKSKINLLAIPITLTLISASLPQPSLAAATKKRSQKKKPQEALTPEQLKSWSKDLPVVSKRIPYTDLLTLKSQGKLKHVIKPPSLTLRLKAEPVLVVLEDSHVLRTVLPSIDGNKRFWEQWDELKLDSVCVNAYSPPVKKPPVPSPYLGFLWRVPSYMLTLAKPKKESKRAAELKRMREDFKRQRKEEMERMNEESEAMEKAIKAQKKMQERKKRKAVRKKKYEESLLEARRNYRDMGLMWARLAEDSNVATALGLVFFYIFYRVVVLNYRKQKKDYDDRLKIEKAEAEERKKMRELEREMEGIELDDEEEESGEKNPYLQMAKQFMKSGARVRRASSNRRMPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARDNAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEIAAINMMRDGRTELTTDDLLQAAQIEERGMLDRKDRSSETWRQVAINEAAMAVVAVNFPDLKNIEFLTINPRAGRELGYVRVKMDHIKFKEGMLSRQSLLDHITVQLAPRAADEVWYGEDQLSTIWAETSDNARSAARSLVLGGLSEKHHGLNNFWMADRINDIDVEALRIMNMCYDRAKEILQKNRTLMDEVVDKLVQKKSLSKQEFFTLVELYGSIKPMPPSILELRKIKRLQLQEAVMKQDMTSARNS

SEQ ID NO: 556 - protein, 363 aa, Unknown
  Sequence found in Organisms: Brassica napus, Brassica rapa
MAPLPISSIRVGKIDDVQELIKSKPNKVPERFIREANERGVLVSHKTHLHHHIPVVDLSKLSKPHTDDDFLFEILKLSQACEDWGFFQVINHGIEVGVVEDIEKVAKEFFEMPLEEKKKYPMEPGTVQGYGQAFIFSEDQKLDWCNMFALGVHPPSIRNPKLWPSKPARFSENLEGYSKEIRKLCKRLLKYIAISLDLKEERFEEMFGEAVQAVRMNYYPPCSRPDLVMGLSPHSDGSALTVLQQSKNSCVGLQILKDNTWVPVLPLPNALVINIGDTVEVLTNGKYKSVEHRAVTNRERERLTIVTFYAPNYEVKIEPMGELVDDETNPCKYRSYNHGDYSYHYVSNKLQGKKSLDFAKILN

SEQ ID NO: 557 - protein, 240 aa, Gossypium hirsutum
MASLQQASISLQPKLLSSSQHPRSLPSLNLSFSATFPSLKLCTTRPLHGGAKMSASAASSYATALADVAKSNNTLDATSSDVEKVEKIFSDPQVLQFFTNPTIDVLKKRQVLDEIVSSSELQPHTANFLNILVDAKRIDLIKEIVKEFELVYNELTDTELAVVSSVVKLESQHLAQIAKQVQKLTGAKNVRIKTMIDPSLVAGFTIRYGSSGSKLIDMSVKKQLEEIAAQLDLGDIQLAV

SEQ ID NO: 558 - protein, 692 aa, Gossypium hirsutum
MVRFSCFNAHIGSQKPKKTVQPSVEAMHTTIEDFSQVQAPKELTKAANMDSFFPETQTTAEIHESVEPVTVSSSPNPSWKSEDIKDGVILDSSSRVLQNPHYLKKCRSLGSGLCLEGRVPGQNDTDDQTDQGFSSDSHDHGLVEDGSKHIAVSQNASFSESVQVSSNHVYNEPVFSIGDSLLPEKDGHDISNLPLPCERANASGDHSPNNAPVIVKSCSMPNIVASALLFGGHSPPKCLARRTRSSEDVHVLSMRQKETLIHDVDTEVMREQERDDGMHKNHKTNFESSYEGFESYSCSASAKDWIVPVSDEVSSMKMLQEELRVLNRNELTGKDFKIKRIEDWVNGLQHVRPSEDSIELSHPNDQVKAEPAVYNDLTAAKVDVKVTPGMEAAKRYISSLSASATTAQLANHGLVVIPFLSAFVSLKVLNLSGNAIARITAGALPRGLHMLNLSRNNISTIEGLRELTRLRVLNLSYNRIFRIGHGLASCSSLKELYLAGNKISEVEGLHRLLKLTVLDLRFNKISTAKCLGQLAANYNSLQAIGLEGNPAQKNVGDENLKKHLQGLLPNLVYFNRQAIKVSTVKDGAERSVRLGISAHQFDRGLRSEHRATRKNSHGTSIHRPSSSSTRGHKSQVASPMQSRGRHGRYPPSGAKATNNRQNHHVDLGSKVLNFKSELSMRRTQSEGTLGLL

SEQ ID NO: 559 - protein, 350 aa, Medicago truncatula
MASASTTITSSFLSTPSSLTEKPSSFNQTLSLGYKPRHSVSVSASAAPSPPPSYDLNAFKFAPIKESIVAREMTRRYMTDMVTHADTDVVIVGAGSAGLSCAYELSKNPNVKIAIIEQSVSPGGGAWLGGQLFSAMVVRKPAHHFLDELEIEYDEQDDYVVIKHAALFTSTIMSKLLARPNVKLFNAVAAEDLIVKNGKVGGVVTNWALVSMNHDTQSCMDPNVMESKVVVSSCGHDGPFGATGVKRLKSIGLIDTVPGMKALDMNTAEDAIVRLTREVVPGMIVTGMEVAEIDGAPRMGPTFGAMMISGQKAAHLALRALGLPNAVDHAGNIHPELVLAAADSAEVAEA

SEQ ID NO: 560 - protein, 580 aa, Medicago truncatula
MAALTSSCSTAISASSKTLTKPTTTSFAAANLSFSKLYPQSVKARRCIAVGGAVGARMVSAPPATLPAKLDFETSIFKKERVNLAGHEEFIVKGGRDLFHLLPDSFKGIKQIGVIGWGSQGPAQAQNLRDSLAEAKSDIVVKIGLRKGSRSFNEAREAGFTEESGTLGDIWETISGSDLVLLLISDSAQADNYEKIFSHMKPNSILGLSHGFLLGHLQSVGLDFPKHFSVIAVCPKGMGPSVRRLYVQGKEINGAGINSSFAVHQDVDGRATDVALGWSVALGSPFTFATTLEQEYKSDIFGERGILLGAVHGIVESLFRRYTENGMSEDLAYKNTVESITGVISKTISTKGMLAVYNALSEDGKREFEKAYSASFYPCMDILYECYEDVASGSEIRSVVLAGRRFYEKEGLPAFPMGKIDQTRMWKVGEVVRSTRPAGDLGPLYPFTAGVFVALMMAQIEILRKKGHSYSEIINESVIESVDSLNPFMHARGVSFMVDNCSTTARLGSRKWAPRFDYILTQQALVAVDNGAPINQDLISNFMSDPVHGAIEVCAELRPTLDISVPADADFVRPELRQSN

SEQ ID NO: 561 - protein, 357 aa, Medicago truncatula
MAATHGKIVLFMSLAAFMLFNTQNAFVSCALTSELQNKIAKINEEGPYLGLIIPNSFELNPLLQNPGYTASDNIIDFAGRRFRFGSIGDKPVILVMTGLSVINAAITTQLLLSFFTVDGVVHYGIAGNANPSLHIGDVAIPHYWAHLALWSWQRYGQGADDTLPLENNGDYTRDVGFLKFSDFTSNISAADSVTVDNHLNNLWYQPEEIFPVDGIPEQRQHALWVPVDSKYYRIAKKLEEMKLDACIDSDTCLTTTPKVVLVERGTSAGFYLDNAAYRTFIYNKFNVSPVDMESASVALICLQQRIPFIAIRALSDLAGGGTAESNEADTFSPLAATNSVAVVIEFVKLLSSHHSKW

SEQ ID NO: 562 - protein, 169 aa, Medicago truncatula
MALVTGRSSALNPNAPLFIPAAFRQVEDFSPQWWELVKSSTWFHNYWLSQHKEEDFVESGGNDATNDDDIEHMLSETFDLGIEEDFNFLDNEFEKLVMSDEAQECPVLDEPVEEKKPVHGVNKDAAALIKILSPKERGSKSPIGSPKHFEKPAQYVNLKCAPQRIHQPR

SEQ ID NO: 563 - protein, 372 aa, Medicago truncatula
MASSDSNATNMLQAIRYNRGSLQLLDQTKLPLESVYLEIRDSNDGWNAIRDMVVRGAPAIAIAAALSLAVEVSNLDDFNGSTDDAVYFLQKKLDYLVSSRPTAVNLSDAATKLKEIISKAAATTSEAKGVFQAYLEAAEIMLEDDVASNRAIGTYGASFIQNQTEKLKLSVLTHCNTGSLATAGYGTALGVIRALYSGGVLERAYCTETRPFNQGSRLTAYELVHDKIPATLIADSAAAALMQAGRVDAVVVGADRVASNGDTANKIGTYSVALCAKFHNVPFFVAAPLTSIDLSLSSGQQIVIEERSPKELLNTRGGLGEQVAASGISVWNPAFDVTPANLISGIITEKGVITKTPAGDAFDIKAFVQKTG

SEQ ID NO: 564 - protein, 228 aa, Medicago truncatula
MEGIVKSLYLPKIPKSQTCSGSLLNSPLLLHSNATSVTFNSATHHLHKCFLFQQPGGVIHSKAQEKVNLGAIHASKATTPTTTATQRWILEPVGDGDSRHIGFKVERPGAYEITSNEVTVGRVPEKADLVIPVATVSGVHARIRIKQDNLLVIDLDSTNGTFIGDKRLKPGVVTTVSSGSYITFGDTNLAMFRVSKIEEKAADTVGEPEGELENDGKSDSTETSSTSS

SEQ ID NO: 565 - protein, 699 aa, Medicago truncatula
MKEAEKSLDPQLWHACAGGMVQMPSVNTKVFYFPQGHAEHAQSNVDFGDSFRIPPLILCRVVSVKFLADPETDEVFSKITLIPLRNSELENDDSDGDGSENSEKPASFAKTLTQSDANNGGGFSVPRYCAETIFPRLDYSAEPPVQTVIAKDVHGEVWKFRHIYRGTPRRHLLTTGWSSFVNQKKLVAGDSIVFLRGESGELFVGIRRAKRGIVNGLETPSGWSSGNGSCGLGPYGGAFSAFLREENKLGGVGGNLGGGRVKVSGESVKEAMRLAASNQTFEVVYYPRASTPEFCIKTSAVKAAMRIQWCSGMRFKMPFETEDSSRISWFMGTISSVQVVDPIRWPNSPWRLLQVTWDEPDLLHNVKRVSPWLVELVSNMSMIHLTPFSPPRKKLRFPQHPDFPLDVVQFQIPTFSGNPFNPLCCLSSSDNYNAPAVGIQGARHAQIGISLSDLHLNNNKFQLGVFPNNRETISNVSNITTNHDNKSKESISCLLTIGNSHKRSLEIKSDNNDKRHQFLLFGQPILTEQQISRKSSSDDVLLSKKKDKEKWFFSDTTKSSISEQFSPAKSSTTSASADFCWQLGLDTGHCKVFLESEDVGRTLDLSCVGSYEELYRKLAKMFGIERSEMLSHVLYRDVTGAVKQTGEEPFSDFMKKAKRLTILMDSGSKDTRRVCITGTRNAERGLDASNKTGPMSIFV

SEQ ID NO: 566 - protein, 934 aa, Medicago truncatula
MLHNKSFVKKTKGGKVIRQVREHYLRDDIYCGAPSCTVCDTSAARLSASPSTILVLDTNVVLNQIDLLENPAIDDVVVLSIVLDEVKNKNLSVYNRLRAICSNPMRKFFVFSNEYHRDTYVKEMSGETKNDRNDRAIRVASQWYQKHLGDAIKVLLVTNDKENKRKASEEGICAETVESYVKSLDRPDLLDLLVRPSSEDVEMEDVEDHRPSKRKIIYAEHKPMSEITSGLHRGIYHQGKLRVNRYNPFEAYVGSESIGDEIIIYGRSNMNRAFDGDIVAVELLPQDQWQGEKSMSIAGEEDEDDDDVHLAPNSADVAPRTIPQQSSTGEINAGSGRPSGCIVGIIKRNWQSYCGSLEPMPIPGGSRGVAYALFVSKDRRFPKIRIQTRQLENLLDKRIIVSVDSWDRQSRYPSGHYVRTVGKIGDKDTETEVVLIENDINSRPFSAQVLACLPPLPWSVSSEDLSIPFRQDLRHLRVFSVDPPGCKDIDDALHCIALPNGNFDVGVHIADVTNFVFPGTPLDDEASQRGTSVYLVEKRIDMLPKPLTEDVCSLRSDVERLAFSVIWEMTPEADIISTRYTKSVIKSAAALSYVEAQARMDDSRLMDPVTTDLRNMNSLAKKMRLRRIENGALTLASAEVKFQIDTETHNPLDIGIYQIKEANQMVEEFMLAANVSVAQQILKSFPLCSLLRRHPTPTKEMLEPLLRVSAAIGLNLDVSSSKALADSLDHAVGDDPYFNKLIRILTTRCMSQAVYFCSGDLSPPEYHHYGLATPLYTHFTSPIRRYADVIVHRLLAASIGISKLPSVFQDRLQLTSIADNLNYRHRNAQMAGRASVELNTLIYFRTRPTDTEARVVKIRSNGFFVFVPKFGIEGPVYLTTRAEKGSGEWYVDEQEQKIKKMDGSFSYSILQTVQIHLEVVEPQPNRPKLQLTLI

SEQ ID NO: 567 - protein, 592 aa, Medicago truncatula
MAKMNPLFILAFFSISSLFFSTVRSDSSDKRYKEGDPVPLFANKVGPFHNPSETYRYFDLPFCIPDHLKEKKEALGEVLNGDRLVSAPYQLEFQKDKDSMSVCKKTLTKEEVANFRSAVRKDYYFQMYYDDLPIWGFIGKVDKEGKDPSDYRYYLYKHIHFDIFYNKDRVIEINVRTDPNALVDVTEDNEVDVEFFYTVKWKETNTPFEKRFDKYSHSSSLPHHLEIHWFSIINSCVTVLLLTGFLATILMRVLKNDFVKYAHDEETAEDQEETGWKYIHGDVFRFPKFKSVFAAALGSGTQLFTLTVFIFILALVGVFYPYNRGALFTALVVIYALTSGIAGYTATSFYCQLEGTNWVRNLLLTGCLFCGPLFLTFCFLNTVAIVYNATAALPFGTIVVIVLIWTLVTSPLLVLGGIAGKNSKAEFQAPVRTTKYPREIPPLPWYRGAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRASLFFVRHIYRSIKCE

SEQ ID NO: 568 - protein, 324 aa, Medicago truncatula
MAFSSSMWSSLFVPNPNKTNRFATFSPSSHSKLLTTTFAIPPLSTATAADVTGAIDGTTVAVISGGFVAGLTALLSLSDPERRRREQAEEVGGDDKEVVREYFNNNGFQRWKKIYGDTDDVNRVQRDIRLGHSKTVENALQMLKDEGPLQGVTICDAGCGTGSLSIPLAKEGAVVCASDISAAMVAEAEKLAKEQLVSSENGVSPAMPKFVVSDLESLDGLYDTVVCLDVMIHYPQSKADGMIAHLASLAEKRLILSFAPKTFYYDALKRVGELFPGPSKATRAYLHSEADVERALRKVGWTIKKKGLIATQFYFAKLIEAVPM

SEQ ID NO: 569 - protein, 432 aa, Medicago truncatula
MATLNVFSQPLHPTTISSSLCSSSSSCSNSTFSCHFSLLSSHSSPTLSKLSNHVHTHFSKSGNGSSWLQSSSTVDSIAHKKGPVYSVFPSSPAQVSSVQDLYEFICSGPLLYKIGLTPEKVAESIDKWLSYGRQLCRLFQLNELFLTEPQKVRLYHYYIPVFLWCESEIAQHQAKFKDKEDIPPLVIGFSAPQGCGKTTLVFALDYLFQMIGRKSATISIDDFYLTAEGQNKLREANPGNALLEYRGNAGSHDLPFSVETLTALTKMSREGTKMKLPRYDKSAFGGRGDRADPSTWPEIEGPLTVVLFEGWMLGFKPLPVEAVKAVDPQLEIVNKNLKAYYDAWDKYIQSWIVIKIKDPSCVYQWRLQAEIAMREAGNPGMSDDEVRDFVSRYLPAYNAYLPTLYSEGPSGSDPQHLLNIEIDEKRNPILGV

SEQ ID NO: 570 - protein, 256 aa, Medicago truncatula
MEMEGYDIFGDATERISKNGFEVNNEVIGSGYGSSFSLVLDRERGELVEAPVKMEGKGVSTTERSVEALKNHSEAERRRRARINAHLDTLRCVIPGALKMDKASLLGEVVRHLKELKRNETQACEGLMIPKDNDEISVEEQEGGWNGFPFSIKASLCCEYQPGLLSNIRQALDALHLIIMKADIATFGDRMKNVFVVISCEEQNFDAAEYRQFLAGSVHQALKSVLSRFSVSQDMLRARKRRRVSIFSSSSLENFL

SEQ ID NO: 571 - protein, 718 aa, Medicago truncatula
MAGIPITSSNYNYASSIHSLPLFFARTNFTTTINVSPTSSFRVFCHTQSKTKKTEIRRFSPLLESSGNGAVALDEWKAVPDIWRTSAEKYGDKVALVDQYHDPPSTMTYKQLEDAILNFAEGLRVIGVKPDEKIALFADNSCRWLVADQGMMAIGAINVVRGSRSSIEELLQIYNHSESVALAVDNPEMYNQIAKPFYLKTSIRFIIMLWGEKSSLVNEANKEVPIYTFMEVVNFGRQSRRALHASHDGQHYMFETIKLDDIATLVYTSGTTGNPKGVMLTHQNLLHQIKHLSDVVPTEAGDRFLSMLPPWHAYERACEYFIFSHGLEHIYTTVRNLKDDLGRYKPHLMVSVPLVFETLYSGIMKQISTSSLVRKLVALTFIRVSLAYMECKRIYEGKCLTKNQKSPSYLYAMLDWLGARIMAAILYPVHMLANKLVYSKIRSTIGISTAAISGGGSLPSHVDKFFEAIGLNLQNGYGLTETSPVIAARRHGCDVIGSVGYPLKHTEFKVVDSETGEVLPPGSKGILKVRGPQLMKGYYKNPSATNRVIDRDGWLNTGDIGWIAAHHSTGRSRNSGGVIVVEGRAKDTIVLSSGENVEPGELEEAATRSNLIQQIVVIGQDKRRLGAVIVPNKEEVLKAAKELSIIDSNSSDVSQEKVTSLIYNELRTWTSGFPFQIGPILLVNDPFTIDNGLMTPTMKVRRDRVMAQYRDQIENLYK

SEQ ID NO: 572 - protein, 511 aa, Medicago truncatula
MSFAVTTTIFAFLLITFTYFLFKLFLHPKQKTIIHKKPPGPPTLPIIGNLHMLGTLPHRTLQSLSKKYGPIMSLQLGQVPAIVISSSKAAESFLKTHDIVFASRPKIQGSELMSYGSKGMAFCEYGPYWRSVRKFCTLKLLSASKVEMSGPIRKEELDVLVKSLEKAALQGEVVNVSEVVENLIEDIVYKMMFGRSKYEQFDLKSLVQEGLALIGAFNLADYVPWLGIFDLQGLTRSCKKVSKAIDEVLEVILTEHEQAANVNKTHHKDFVDILLSIMHQTINVEGEQNLVIDRTNIKAILLDMIVAAIDTSATSIEWALSELLRHPRVMKKLQDEIQNEVGNKRMVEEKDLNKLNYLDMVVDESLRLYPVAPLLVPRESRESTTIDSYFIKEKTRLIVNAWAIGRDPNVWSDNAEEFYPERFIEKKMNYLGQEFESIPFGSGRRRCPGIQLGLITVKLVIAQFVHCFNWELPHNISPSNMNMEEKFGLTIPRAQHLHAIPSYRLDDAKLE

SEQ ID NO: 573 - protein, 282 aa, Medicago truncatula
MSRRTMEWAARSEHLHGIPRKVVIAAVGSFAKTVSSLINTTSVHNADTLLHLVRSRPKGIPLITVSNHMSTLDDPAMWGFKGFPIFDTKLARWVLAAEDICFRNPLYSYVFRTGKCIPITRGGGIYQEHMNEALGRLNDGEWLHTFPEGKVHQDDAPIRRLKWGTASLIVRAPITPIVLPIVHHGFHEVMPEKYMFGRRPPLPLCNKKINIIIGDPIEFDLPAMSEMAIAQSRNDSFPTIGWPRTSDGLDEAAQRYLYTTLSEKIRVAMEKLRCYGKSFLKS

SEQ ID NO: 574 - protein, 474 aa, Medicago truncatula
MTSSSSSKSPPLIPSRHSPQFTPIQEEHEFDEYRSQSRRTTPTSASTPKHHHHHPPTPININKNTKPNHKKKRSETELEDGSVSCNKCRPHSRDKIFILPFDHSNNSNSNSKYSSLLQSPNGIFKSIVSKLTRKSPMSTSTTNNNEEQWKMAVAELSHKLVHATRKRDEALQEASRLMNSMSELEKKLNKLEIYCHTLKSGLEECNIGSSNVVAQKNFHHHVQDNDNVVQHFLVAVSEARSSVRLLSRSLTMQLRHTGSKVYEKVSLLLQPYDIKISFSKNPRSLLFYLEALLNKTFFEDFESIGFQKNACNRILNPMERCESSFASFNMIHGLTWDEVLSKGTRHFSEDFSRFCDRKMSEIVAMLGWNRAWSEPLLQAFFVASKSVWMVHLLANSVHPSLQIFRVDKGVNFDSVYMEDMGGDKSSRLVPNMVRIMVAPGFYVYGSAVKCKVLCRYLTNNLSNNKQEKGLNPSP

SEQ ID NO: 575 - protein, 629 aa, Medicago truncatula
MAVPPSATPASLYVGDLHPDLSDSHLHDAFSDFKTLSSVRICRDSSSGKSLCYGYVNFLSPHDAIRAIEVKNHSTLNGKAIRVMWSRRDPDARKSCIGNVFVKNLAESIDNSGLEDIFNKFGNILSSKVVMSEDGKSKGYGFVQFETEESANAAIDKLNGYLVGDKQIYVGKFVKKSDRVSSGPDTRYTNLYMKNLDLDITETFLYEKFSSFGKIISLAIAKDSNGMSKGFGFVNFNSPEDAKRAMETMNGLQLGSKILYVARAQKKAEREQILHQQFEEKRKEQVLKYKGSNIYVKNIDDNVSDEGLRDHFSVCGTITSAKIMRDDKGISKGFGFVCFSTPEEANKAVNSFHGFMFHGKPLYVALAQRKEDRQAQLQLQYAQQIAGLAGPSTAIVPGGYPPFYYTATGVVSHAPPRAGLVYQPMALRPGWRANGSAPPARSFQQSPTPVVSNNNTRQHRQNRGRMNGHAVSQGNTHSGTYMPQAQQASQSAISSRESSTQQRTGQAKYVPSGRHREMEKGSGLSSTGGSLGPEVLHSMLANATPEQQKEILGEHLYMLVQKIKPNLAAKITGMLLEMDNAELLVLIESPESLSAKVEEAFQVLKNSKAKVSGQDVLHSNFLSAEVAVN

SEQ ID NO: 576 - protein, 323 aa, Medicago truncatula
MAVDFSSIPIIDISPLLAKSDDPKMAEDPGVLDVVAQLDKACTEAGFFYVKGHGIPDSLLKGVRDITRRFFELPYEEKAKIKMTPANGFRGYEKIGENITEGAPDMHEAIDCYREVTKGMYGDLGKVMEGFNQWPQNPPKFKFLMEEYISLCKDLAKKIMRGIALALGGSPYEFEGDRAGDPFWVMRIIGYPGVSSDDIGCGAHTDYGLLTLLNQDDDINALQVRNLSGEWISAPPVPGTFVCNIGDMLKIYSNGLYESTLHRVINNSSKYRVSVVYFYETNFDAAVEPLNTYKTRINGDKKFERAIYGEHLVKKVLTNFVDE

SEQ ID NO: 577 - protein, 138 aa, Medicago truncatula
MNMNMTSITSSIATLVTPLPLFMNTKNKIQSRSSKMTRIRCDVGEEDSSSSSSSTAKIGSRVRVKVPLKVYHVPKVPEVDLTGREGEIKQNVTFWKDNKRISANLPYKVEFVADDIQGPRGPLKFVAHLKDDEFEFLE

SEQ ID NO: 578 - protein, 546 aa, Sorghum bicolor
MRRSWSCLSCLPMGTAALPIEDRFVPPAGLPAVPASGSEDGGFGKGSIDLGGLEVRQITTFAKVWSTTQGGQDGLGATFFKPSPVPAGFSVLGHYAQPNNRPLFGHVLVGRDTSGTGAVLAAPLDYALVWSSPDGAGHFWLPTAPEGYKAVGVVVTAAADKPSPDEVRCVRSDFTDASEIEDTVLTSDKDGFSAATLRPAVRGIDARGVHAGTFLAQSSATPACLKNNSASYTSAMPDLAQVNSLLAAYAPHVYLHPNESYLPSSVTWFFENDALLYQKGSQTPTPVAADGSNLPQGGGNDGGYWLDLPVDNNQREKVKKGDLAGAKVYVQAKPMLGGTVTDLAVWIFFPFNGPARAKVGLIQSIPLGKIGEHVGDWEHVTLRVSNFSGELLRVYFSQHSAGTWVDASRLEYLADGDGGNRPVAYASQHGHAFYPNAGTVLQGNTSLGIGIRNDCARGSRLDTGAGRCEVVSAEYLGVKEPAWVGFEREWGPREEYDIGREINRAARILPRSVRERLAKLVEKVLVGEGPTGPKMHGNWRNDEKEA

SEQ ID NO: 579 - protein, 416 aa, Glycine max
MAKKRSAPSGGRRENRAESSSRRLNSASGRRKLVAFFIVSSIIAIVTYRYRFRQSSPSQGLVTTHANCQHILAENSKVSGNSSQRHYTYPVLGYITPWNSRGYELAKRFNSKFTHLSPIWYDLKSQQTSLVLEGRHNADRGWISELKKAGEALILPRVVLEASPAVLLGKEKQRNKAINLIVTECKEMGYDGIVLESWSRWAAYGILHDPSMRNLALQFVKQLGDALHSISSEKISGQQLQLVYVIGPPSEKLQEHDFGPKDLETLSEAVDGFSLMTYDFSNPHNPGPNAPLKWIQIVLQLLLGTSGNRAQSLAPKILLGINFYGNDFSLSRDAGGGAIIGRDYLALLEKHWPELQWDKNSGEHFFFYTDDKDIRHVVFYPSLKSISLRLEEARSWGCGISIWEIGQGLDYFFDLL

SEQ ID NO: 580 - protein, 633 aa, Glycine max
MVADEASPFETSDMLATLLASTPLLSESWRLCTTVAATAPRSFMTEQHGGGGVVYVAFPGVEMAAGSDSICRNLVALESIGDVPLFSARRRNKEGDEPVMVHAGMLNLLSTFFEPFQKQMLALMGNSKTKSIVLTGHSIGGATASLCALWLLSYLHQTYSSMSVSVLCITFGSPMLGNGSFSRAILRERWGGNFCHVVSKHDIMPRLLFAPITPYTAQINFLLQFWQLSMTAPGFGKLAVPISDQQKELFNFVMSHLDAATQDEEGSAPVLFHPFGSYLFVSSDGAVCVDCATSVIKMLHLMFASGSPACSIEDHLKYGDYVKNLSLQFLNQNNSVQGNIPDSSYEAGLELSVQSSGLGNQESAIEPAKECLKMTRRMGPSPTKNAANLSITLSKFVPYRTEIEWYKAWCHQQVDQMGYYDLFKRRRSTSKMAMKVNMNRHKLARFWNNVIEMWERNELPHDVAVRAKWVNASHFYKLLVEPLDIAEYYGKGMHTTKGHYIQHGREKRYEIFDRWWKDAMGNTEENNERRSKFASLTQDSCFWARVEEARDWLNSVRSESDTTKLAVLWDNIEKFEKYAMELIDNKEVSEDVLAKNSSYSIWMEDLRGLRELKAKVKTFSHHFNPFLDGEVIP

SEQ ID NO: 581 - protein, 419 aa, Glycine max
MNEIDVPSFFLCPISLDIMKDPVTVSTGITYDRESIETWLFSKKNTTCPITKLPLIDYTDLTPNHTLRRLIQAWCSMNASHGIERIPTPKPPVNKNQISKLLKDASHSPLTCLRRLKSISSGSETNKRCMEASGAVEFLASIVINTNRNIDSSHEADSNDGSGFELKTSACDEALSLLHNLHLSEQGLKTLLSFRNGEFIESLTRVMQKGFFESRAYAVFLLKSISEVAEPVQLLHLRQELFVELVQVLKDQISQKTSKATLQTLIQFSPWGRNRIRAVEAGAVPVLIELLLDCKERKPCEMMLVLLELLCQCAEGRAELLSHAAGLAIVSKKILRVSTLANDRAVKIILSLSRFSATPHVVQEMLKLGVVAKLCLVLQVDSGNRAKEKAREILKLHARAWRNSPCIPNNLLNSYPNYV

SEQ ID NO: 582 - protein, 339 aa, Glycine max
MTMAGALSLSQFPVRGSVSLPKRRIPRRSFCIRGMSEISSTFSVSTQQEEPTSNASSVTIAPPPNFKPPEPKRFAIRPDKTSEVFGALLPLLFRFATGVFVSGYSFSIVSKDEIPPDEYALELNGVTIKETAKLGPRPEKPIEIYEFESCPFCRKVREIVAILDLDVLFYPCPRNGPNFRQKVLEMGGKLQFPYMVDPNTGASMYESDDIIRYLVDKYGDGNVPLSLSLGFLTTLTAGLGMLSRISKGTTYTPAKFPPKPLKLWAYEGSPFCKLVREVLVELELPHLLVCCARGSPKRNILYQKTGTFQAPFLEDPNTGIEMFESAEIIEYLRATYALQ

SEQ ID NO: 583 - protein, 366 aa, Glycine max
MDAEADPPQNPITRHKCLACYKQYKKKEHLIEHMKTSYHSVHQPRCGVCQKHCKSFESLREHLTGPLPRGICSKIFSQQGCQLCLALFDSPGSLIDHRKICRISAPTCPGTSALPYIDSQFDCQDSSDENHAGEGPGGAVAMDCEMVGGGSDGSLELCARVCLVDEDERLIFHTYVQPEIPVTNYRYDITGLTEEHLRNAMPLKEVREKLLQILHNGESIGKVRLDGGKARLLVGHDLAHDLDCLKMNYPDHMLRDTAKYRPLMKTNLVSHSLKYLTRTYLGYDIQSGTHDPYEDCISVMRLYKRIRSQLHPEEDHGTMTLSNNIVGMPDSWISRELDNLTPDELYAMSRSDYKCWCLDLIPRLSA

SEQ ID NO: 584 - protein, 859 aa, Glycine max
MTITLSPSLSVPHPSPFSLTPTTTLRQLFFTNFTPSPRRRLQLQARAGKPNVLIPINPSVAVEKGKYSYDVETLINRITALPPRGSIARCLDPFKNKLSLNDFALVFKEFAQRGDWQRSLRLFKYMQRQIWCKPNEHIYTIMITLLGREGLLDKCREVFDEMPSNGVARTVYVYTAVINAYGRNGQFHASLELLNGMKQERVSPSILTYNTVINACARGGLDWEGLLGLFAEMRHEGIQPDVITYNTLLGACAHRGLGDEAEMVFRTMNESGIVPDINTYSYLVQTFGKLNRLEKVSELLREMESGGNLPDITSYNVLLEAYAELGSIKEAMDVFRQMQAAGCVANAATYSVLLNLYGKHGRYDDVRDIFLEMKVSNTDPDAGTYNILIQVFGEGGYFKEVVTLFHDMVEENVEPNMETYEGLIFACGKGGLYEDAKKILLHMNEKGIVPSSKAYTGVIEAFGQAALYEEALVVFNTMNEVGSNPTVETYNSFIHAFARGGLYKEAEAILSRMNESGLKRDVHSFNGVIKAFRQGGQYEEAVKSYVEMEKANCEPNELTLEVVLSVYCSAGLVDESEEQFQEIKASGILPSVMCYCLMLALYAKNDRLNDAYNLIDEMITMRVSDIHQGIGQMIKGDFDDESNWQIVEYVFDKLNSEGCGLGMRFYNALLEALWWMFQRERAARVLNEASKRGLFPELFRKSKLVWSVDVHRMSEGGALTALSVWLNNMHEMSRTGNDLPELATVVVVRGHMEKSTEAQDFPIAKAAISFLQDNVPSSFTFPGWNKGRIVCQQSQLRRILSGTESSSSRKKMDKLVSLSNTPLTTAGVITSKSDVQSGKANDVDSRTDSTRTELLTSAI

SEQ ID NO: 585 - protein, 179 aa, Solanum lycopersicum
MSRHPSIKWAQRSDKLFITVELPDAKNVKLKLEPEGKFLFSATAGADNVPYEVDLDLFDKINVDESKSSTTSRSIVYLVKKAEDKWWSRLVKQEGLRPVFLKVDWDKWVDEDEEDSKPEPDMDFGDMDFSKLNMGEGPSDFDVDVPEGDDDSDTEEIDEEENSEPKAAVPPSTEPGVKA

SEQ ID NO: 586 - protein, 366 aa, Solanum lycopersicum
MVLSKKLIFFVLFLSISLFLFPASAIRGFVEKPRNIKIDGYLDYVESPEYRNSRECPVLDTNMLICDPNLIHVAMTLDVKYFRGSVAAVHSVLKHSSCPENVYFHFVASKDKDFQDLRKMVKSIFPSLSFKVYSFNEFRVKKLISSSIRQALDNPLNYARTYLAEIIQPCVERVIYLDSDVVLVDDIQKLWSISLTGSKIIGAPEYCQANFRTYFTNNFWSDPKLSNVFQEKKPCYFNTGVMVMDLGKWRKGDYTVKIEKWMKIQKEKRIYELGSLPPFMLVFGGEIERIDHRWNQHGLGGDNLVNSCRTLHPGPVSLLHWSGKGKPWVRLDQGSPCPVDLLWMPYDLYRLSSIDSLDDQERRAMI

SEQ ID NO: 587 - protein, 342 aa, Solanum lycopersicum
MAEDICFFAKDSIIIKPAKKSPALLRMVVVAFTLIFGIYICSICLKQTSLENTSKYLNIEVMEKPCHNYDMDQSQIPYVHYPKPKTFSRAECSCNPVRRFAILSMQRSGSGWFETLLNSHMNVSSNGEIFSVKYRRENASSILRTLDTVYNLDFFTSASKNHCSAAVGFKWMLNQGLIEHYKEIVEYFNRKGVSVIFLFRKNLLRRMVSVLSNSHDRYAKLLNGTHKSHVHSHEEAGTLAKYKPEINTTLLITDLKRMEVSATEALDHFNSTRHMILYYEDIVRNQAKLVDVLEFLRLPKMDLSSRQVKIHNGPLWKHIKNWDDVNKTLSGTAYEKFLRADY

SEQ ID NO: 588 - protein, 604 aa, Solanum lycopersicum
MGIEGEVPESGGGIRRRNCVCTKDDFLPEESFKSWGNYANALRQTPTRLIERALTRSNDEAELEAKSRSHHEMKKTLTWWDLIWFGMGAVIGAGIFVLTGLEASQDAGPAVVLSYAVSGISALLSVFCYTEFAVEIPVAGGSFAYLRVELGDFVAFIAAGNILLEYVIGGAAVARSWTSYFATLLNFKPEKFLITAHGLAKGYNQLDPIAVAVCFIICIIAIRSTKGSSRLNYVASIIHIVVIVFIIICGLIKADTKNYTPFTPFGVRGIFKASAVLFFAYVGFDAVSTMAEETKDPARDIPIGLVGSMVITTTVYCLLAITLCLMQPYQSIDPNAPFSVAFKVVGWSWAQYIVAAGALKGMTSVLLVGAVGQARYLTHIARTHMMPPWFSYVDEKTGTPVNATAVMMSATAIIAFFTKLEILSNLLSISTLFIFMLVALALLVRRYYVSGVTTNANRNKLIICILLILGSSIATAAYWGLSEKGWIGYCFTVPIWVSATAGICIFIPQARNPKLWGVPLVPWLPSLSIAINIFLLGSIDKDSFIRFAGWTGFLLAYYFFFGLHASYDTAKEFEKSKGWKNNIEEGKGTSNVVVSKDVPIAPGN

SEQ ID NO: 589 - protein, 229 aa, Solanum lycopersicum
MAKLILQIFTISLFLSLVAFRATGEEDNYIFGKSINKKPTRLRKEKISHFRFFWHDILSGSKPTSMMIIPPPKNTTTGFGQMNMIDNALTLGPKLSSKIVGRAQGFYGAASLNDVGLMMVMNFAFIEGKYNGSTFTILGRNPVFEKVREMAVIGGSGLFRFARGYVQASTHSWDFKTGDATVQYDAYVFALLRFTNFIYFHRVNLCDLVYTKFKKYKNIFCIIAFQNYS

SEQ ID NO: 590 - protein, 496 aa, Solanum lycopersicum
MANKVFCPKLLKNLGFHVRRLNSAPSPLSAVPPLNFTGDFNAVEPAQQINTTLHHHHDHHNIINFDDVKELFYGVPTTKLIRSSMTLQMAAIDPMVDLGMWVMNSKLMEMPIFREVILGFVKNTFYEHFCAGKDLTEARRTVTNLSDSGLKAMLDYGVEHATDNESCEQSTAAFIQTIESTKSLPESSASFVVAKITAICTPRLLKRMSDLLRWEQKDPSFNLPWKRESLPLFAESSPVYHTCSKPEPLSVEEERDLQLAHERLRKICEKCLEHEVPLLIDAEDTTIQPAIDYFAYSAAIKYHKDDQPLIFGTIQAYLKDAKERMVIAKKAAEKMGVPMGFKLVRGAYMCSEKELASTLGFNSPIHDSIEQTHACFNSCAEFMIEEIANGSGAVVLATHNIESGKLAATKAIDLGIKNERQNLQFAQLYGMADGLSFGLRNAGFQVSKYLPFGPVEQIMHYLMRRAEENRGMLSTSAFDRQLMRKELSRRFEVATS

SEQ ID NO: 591 - protein, 551 aa, Solanum lycopersicum
MKDQNLDLFDPRTAVMDPEYSPTHTGEPDFAFAFDDVNFSDRILRIEILGDSIAGGSSSDGGCSSLADWARNRKRRREDFRKENALDITACPEDQIICCNQIDSEDADNENQDEAVVAMIEETNSGDDAANSDDSTWNCDSPRVMRVKTLNISSPILAAKSPFFYKLFSNGMRESEQRQVTLRINASEEAALTELLKFMYRNMLTTNTAPGLLDVLMAADKFEVASCMKYCSRLLCNLPMTPESALLYLELPSSVLMADAVRPLTDAAKQFLAARYKDITKFQEEVMKLPLAGIEAILSSDDLQVASEDAVYDFVLKWTRAHYPLIEDRREILSSRLGRCIRFPFMSCRKLRKVLTCNDFEHEFASKLVLEALFFKAEAPHRQRTQAAEESASTSRRFVERAYKYRPVKVVEFELPRQQCIVYLDLKREECANLFPSGRVYSQAFHLGGQGFFLSAHCNMDQQSSFHCFGLFLGMQEKGSVSFTVDYEFAARTTLAEEYVSKYKGNYTFTGGKAVGYRNLFAIPWTSFMAEDSLYFIKGVLHLRAELTIRH

SEQ ID NO: 592 - protein, 347 aa, Solanum lycopersicum
MGDSSGSVSVDMETISVTGKEHLVKTGRGYVSVAVFGDQDKPALITYPDLALNYMSCFQGLFYCPEAFSLLLHNFCIYHISPPGHELGAAVMSLDDPVLSVDDLADQIVEVLDYFRLGKVMCMGVTAGAYILTLFAVKYTQRVMGLILVSPLCKAPSWTEWLCNKVMTNLLYYCGMCTLVKELLLLRYFSKEVRGSVEVPESDVVQACRRLLGERQSPNVLRLLEAMNERPDITQGLRKLKCRSLIFVGESSPFHSEALHMTSKLDRRLSALVEVQACGSMVTEEQPEAMLVPLEYFLMGFGFYRPSQCNVSPRSPLSPTSISPELFSPESMGLKLKPIKTRFSEEV

SEQ ID NO: 593 - protein, 373 aa, Solanum lycopersicum
MTEVKKDEENHHQHLCDFCGNNTALLYCRADSAKLCFTCDREVHSTNQLFTKHTRWLLCNLCDSSPASILCCTETSVLCQNCDWESHNKLLSLHERRPLEGFTGCPSVSELLSILGFEDLGKKELLCGGDDGAYGFSDWVIWDAPSVVTLDDLIANNNESRHNYQAIGVPPLPKNRNAACGKHKEEILGQLRELSKLEPNSGDDQDENVPTTGFQSMEPVQNCPLRYKGSGFMQRSDQHVVPSSEGSAFHWHGDTGEFVDQGFSSSLTDCFIETKCLLPDRDSDVCDASGGGNEEQSHHPTTTETFQMVPKVVHRELNSQERETAVSRYKEKKKTRRYEKHIRYESRKARAETRTRIKGRFAKMDYRDSSVHQ

SEQ ID NO: 594 - protein, 471 aa, Solanum lycopersicum
MTVEVQCEATQVAEVVVPQEELVAANKVVEEVEVNEKVKEDEEEESKPNTIEKSSSYREESNFLSDLKENEKKALNELKSIVEEAIVGNTLFKKEETNKSLEEEGKNEENPDANIEEKEGDLDVVEVDREISIWGVPILPSKGDEKTNVVLLKFLRARDYKVNESFEMLKKTLQWRKDFNIQSILEEDLGSDLAPAAYMSGVDNQGHPICYNIFGVLEDEEIYNKTFGTEEKRNQFLRWRVQLMEKGIQQLDFKAGGVSSLLQINDLKNSPGPSKKEVRVATKQAVDLLQDNYPEFVAKNIFINVPFWYYAVHSLLSPFLTQRTKSKFVFARPAKVTETLLKYIPIHEIPIQYGGLKRENDFEFSASDCEASEILLKAGSTETIEIPAVDVESTFIWDVTIVGGEVSYKEEFVPEDETSYTIIIQKDKKVSSTIRNTFKNTEAGKVVLTIKNTSSKKKKAFYRHKITKSTI

SEQ ID NO: 595 - protein, 300 aa, Solanum lycopersicum
MNNDTPSMIHDPLIDSTGDGGYALSGKIMLSAIVILFTVVVFMVGLHLYARWYLVSQRRRELLRRRRVNHRRTHIVFYVDNPGSGLSDANRGLEQAVLSSLPVFVYSDKTHPEPLECAVCLSEFEENEKGRVLPKCNHSFHSECIDMWFHSHSTCPLCRSPVEAVLIEPDINRVEVAVTVNEPGSSSGCEENSSHHSNMTPLGCRRKGLDLTGVRIEVPRRNDFEADLEMGVRVSSPAIQSRSPATRLMSLRRILSMNRKTPTGTSHSPSGSCAADFDIETGGSSGGGKIQVGGERITTP

SEQ ID NO: 596 - protein, 515 aa, Solanum lycopersicum
MNEPCFPEENSSISYIMNHLPNKRRRRRKEIAQQTPTNSSAGGGGNDEFGSENQGAVKTKELKQILTSLLLLEEQEKSEFAKEEEEDKHLLEANHKKTTKVMWDYYSNVQQHHSDLEQLDGVRKRKGRGNSAALTATACALASAAAEEEGVSSNKSTDKGAPHRRLWVKNRSKAWWDQCNSPDFPEEEFKKAFRMGKDTFELICNELTSVVAKENTMLRDAVPVKQRVAVCIWRLATGEPLRLVSKRFGLGISTCHKLVLEVCTAIRTVLMPKYLQWPDEKKMRDIKDEYEDMSGITNVVGSMYTTHIPIIAPKISVAAYFNKRHTERNQKTSYSITVQGVVDPRGVFTDVCIGWPGSMPDDQVLEKSALFQRANTGLLNNVWIVGSSGYPLMDWVLVPYTQQQLTWTQHAFNEKIGEVQRVAKEAFVRLKRRWSCLQKRTEVKLQDLPVVLGACCVLHNICQMRNEEMDPELNFELIDDEMLPEIQLRSTNARLARDAIAHNLLHHNHAGTSLL

SEQ ID NO: 597 - protein, 410 aa, Solanum lycopersicum
MIFPLLKPHYHKVSIFIKKMRAVSVFGGVFLVLAVYCGLDPFKHSAISEFPNFESFKVEMPAWSEIPVEKDSQNLLQKSEVKFLDQIQGPESIVFDPQGRGPYTGIADGRVVFWDGEKWNDFAYTSANRSGLCDPKPSALSYRKYEHICGRPLGLRFDKRTGDLYIADAYLGLMKVGPEGGLAESLTTEAEGVPIGFANDLDVDDEGNVYFTDSSTKYQRRNFIQLVFSAEDSGKVLKYNPRTKETTILIRNLQFPNGLSLSKDGSFFIFCEGSKGRLRKYWLKGEKAGTSEVIAILPGYPDNVRANERNEFWVAIHCRRTIYSYINGIYPRLRQFLLKLPISAKLQYLIHIGGRFTAVVVKYSPEGKLLQILEDRQGKVVRAVSEVEERDGKLWMGSVLMSFISVYQLE

SEQ ID NO: 598 - protein, 614 aa, Solanum lycopersicum
MAKMVSPDAISTILANPSPDSSSDLPEIIVQVVDLKPTGNRYMFSANDGKMKIKGILQSSLSSEVISGSIQNLGLIRIIDYTLNDIPTKNEKYLIVTKCEAVSPALEVEYKAEVKSEDTGIVLKPRQEETGIVLKPKQEYQTKSAAQIVHEQSGNMAPTARMAMTRRIQPLVSLNPYQGNWTIKVRVTSKGNMRTYKNARGEGCVFNVELTDEDGTQIQATMFNEAAKKFFDKFELGKVYYISKGTLRVANKQFKTVQNDYEMTLNENSQVEEASNEEAFIPEIKFNFVPIDELGPYVNGRELVDVIGVVQSVSPTMSIRRKSNNETVPKRDITIADETKKTVVVSLWNDLATHVGQELLDMADKSPVVAIKSLKVGDFQGLSLSALSKSNIVVNPDLPEAKKLRSWYDSEGKETSLASIGSGMSPSTKSGARSMYTDRVSLLHITSNLSLGEEKPVFFSLKAYISFIKPDQTMWYRACKTCNKKVTEAFGSGYWCEGCQKNDAECSLRYIMALRVSDASGEAWLSTFNDQAEKILGCSADELDKLKSEEGETAYQMKLKEATWVPHLFRVSVAQQEYNNEKRQRITVRAIAPVDYEAESKYLLEEMSKMNIAI

SEQ ID NO: 599 - protein, 439 aa, Solanum lycopersicum
MAAAKRFLDNSNPDPNQPNYKRMRPSFASVIKEAMKANFLENVSSALEPMLRRVVVEEVEKGLRRYSCLSITRSPSLRIKALEPSNLRLIFNKKLSKPIFTSSKVVAGDGQSLQILLVDTSGEGMVPTTLPYPIKVELVVLDGDFPSGETETNWSREEFDKRVVKERTGKRPLLTGELNFTMREGVVPVGEIEFTDNSSWIRSRKFRIGAKVVQIGNNQTSVRIIEAVTESFVVKDHRGELYKKHYPPALGDEVWRLEKIGKDGTFRKKLSSKGINTVQDFLKLATIDTQQIRTILGTGMSDKMWEVTYKHAKTCEMGSKLFMARGSNYVLILTPICEVVRAVIDGQIYPTHDLTGIQKAYIQNLVKEAYTNWSSLEEVDGLVNEPALLTQGEPMVDQYPNVHQQQQPMIRSYQRNTILTDASEQLIEYNDWIGNPNYI

SEQ ID NO: 600 - protein, 190 aa, Solanum lycopersicum
MSVISKLTLLIISIACIFQVSSLSADGSSLVPLIIDQMISSNPANTFLDPFKVLEQIPFGLENTLLARVDWKETAKGHVISVEVPGLNKDDIKIEIEENRVLRVSGERKKEEEKNDEENHWHCVERSHGKFWRQFRLPENADIDTMKAKLENGVLTISFAKLSADRIKGPKVVSIESKQQGKESSVREEL

SEQ ID NO: 601 - protein, 701 aa, Solanum lycopersicum
MAYQGGNLKSTAINGVKMYTVAGQHRSVATWLPPKKLRALRKDPGYMQRVDLIQDLKFETATTRIKVTPDGEYLIASGIYPPQVKVYELRELSLKFERHLVSEIVNFQVLGDDYSKIAFLCADRSVCLHAKYGSHYKLRIPRMGRDIIYDSWSCDLLCAASSPDLYRINLEQGRFLSSLCTRSPALNVVSRSKVHGLVACGGEDGALECFDMRARSSVGRINAVAPAGGGDQEVTAIEFEGDGGYLMAVGSSDGKVLVYDLRSSQPMRIKDHMYGSPILNIKWHKTLNTERTKLITADSHIVRVWDPETGEGMTSIEPTGGRINDLCAFTGSGLMLLALDSSQIPSYFIPSLGPAPKWCSYLENLTEELEEQPQTTIYDDYKFLTKEDLEKLNLTNLIGTNLLRAYMHGYFIDYRLYKKAHAASNPFAYDEYIEQRKKEKFEKERDSRITIKRRLPKVNRTLVEQLLENEEAENVKEDVDDVDAKKTSKKKKGLTMDVLEDERFKRIIENKDFEIEEDSHEYRALHPMPSLKRPSLVEEHFEPVMEGEEASDSDAQSSEDEQENDRNSRKKARVPRMYEVKDDRHAEAFSNHISLAKEDALSLGERVAGLSNGRASHDMNNIKVGPGGSREVSFFSRSSAKYVEDDGEKETRTEKRRGVQSLKLKPERSGFQGSGSRGRGRGGRGRGMGRGRGRGRGRGRG

SEQ ID NO: 602 - DNA, 1794 bp, Arabidopsis lyrata
tctgagacagagaaccagagagatggggaagagcgaaaagacgtcgttagggcgatcactggtgaagcaccacaaccatatgattcaagaatccaaagacaaaggcaagtactacaagaatcttcagaagaaagttctcgaatccgtgaccgaggtcagcgacatcgacgccatcattgagcaagccgaggaggctgagcgtctttacaccattaatcacagctcctccacacctttgtccatcaatctagacacaaattccagctcaagtgttatagcacctgaagaatggagagagcaacagaagatagaggaggctttacacgccagtagtcttcaagtgcctcgaagacctccgtggacacctgaaatgtcagtggaagaacttgatgctaatgaaaaacaagcttttctgaattggcgccggatgcttgtgagccttgaggaaaatgaaaagcttgtgttgactccattcgaaaagaaccttgacatctggagacagctttggcgagtgcttgaacgcagtgatttgattgttatggtagttgatgctagagatccactgttttaccgctgccctgatcttgaggcgtatgctcgagaaattgatgagcataagaaaataatgcttctagttaacaaggcggatcttttacctactgatgtcagggagaaatgggcagaatatttccgccttaacaacattctgtttgttttctggtcagccatagctgctacagctaccctagaaggtaaagtctttaaagagcaatggagacaacccgataactttcagaagacagatgatccagacattatgatatatggcagggacgagctgttgaatcgtttagaatttgaggctcaagagattgtcaaagtaaggaattctagagtagcatcgactgttgaatatcaacgtgatcaagccgtggttggatttgttgggtacccaaatgttggaaagagttctacaatcaacgcattagtgggtcagaagcgaacaggtgtcacctctaccccaggaaaaacaaagcatttccagactttgataatctctgatgagcttatgctatgcgattgccctggtttagtcttcccttcgttctcaagctcgagatatgaaatgattgcttctggtgtacttccaattgaccggatgacggagcaccgtgaagctattcaggtggtggctgacaaggtccctagacgtgtcattgagagtgtctacaacatctctcttcctaaacccaaaacctatgagcgtcagtcccgcccgcctcatgctgcagagcttttaagaagttactgtgcttctcgtggctatgttgcctctagtggactacctgatgaaacaaaagctgctaggcttattctgaaagattacattggaggtaagctgccgcattatgcaatgccacctggaatgacacaaggtgatgaagcggatatagaggacactgaagaacttgaggatattctcgaaggttcagagtctgaagactctacagtaggagatgagacagaaagcgagcaagttcctggtattgatgcggtgctagatgatctgagctcgtttgatcttgccaatgggcttaagtcttcaaagaaagtgacagcgaagaagcaaaccgcttcacataaacagcacaaaaagccacagaggaaaaaggatcgaacttggagggttcaaaacacagaagatggagatgggatgcctatggttaaagttttccagaaaccggctaacacagggcctctcacgatgcgttgattagcaaattgtagttcatc

SEQ ID NO: 603 - DNA, 2165 bp, Eutrema parvulum
aacttgattcagcttcaccgtgcagcctgtgcggtcggcggctgacgttttcttaccctaaggaaagcccaacactttaacattaacaaaagcgccttcgaatctatctgctcaaagggttttagatatttagggtttactgagaagaggcagagagagagatagaagggagagatggggaagagcgaaaagacgacgttagggcgatccctggttaagcaccacaaccatatgattcaagaatcgaaagacaaaggcaagtactacaagaatctacagaagaaggttctcgaatccgtcactgaggtcagcgacatcgacgccatcctcgagcaggccgaggaagcagagcgtcttttcaccattaatcacagcaacaccacacctctgcccatcaatctagacacaatttccagctcaagtactatagcagctgaagaatggagagagcaacaaaagatagaggaggctttacatgccagtagtcttcaagtgcctcgaagacctccttggactcccgaaatgtccgtggaagtactagatgctaatgaaaaacaagcttttctgaattggcgccggatgcttgtgaggctcgaggaaaatgaaaagcttgtgctgactccgttcgaaaagaacctggacatctggagacagctttggcgagttcttgaacgtagtgatttgattgttatggtagttgatgctagagacccactgttttaccgttgccctgatcttgaggcatatgctcgagaaattgatgagcataagaaaataatgcttctagttaacaaggcggatcttttacctcttgatgtcagggagaaatgggcagaatatttccgccataacgacattctgttcgtgttctggtcagctatagctgctacagctgtcctagaaggtaaagttttgaaagagcaatggagaaaacccgaaaactttcagaagacagatgatccagaagttgtgatatatggcagggaagagctgttgggccgtttacagtttgaggctcaagagattgtcagagcgaggaattctagagcagcatcgtcttcgcagtcagtgactgttgaatctcaacgtgataatgctgtggttggatttgttgggtacccgaatgtgggaaagagttctacaatcaatgcattggttggtgagaagcgaacaggtgtcacctctaccccaggaaaaacaaagcatttccagactttgataatctctgatgagcttatgctttgcgattgtcctggtttagtcttcccttcgttctcaagctcgagatatgaaatgattgcttgtggtgtacttccgattgatcggatgacagagcaccgtgaagctgttcaggtggtggctgacagggtccctcgccgtgtcatcgagagtgtctacaacatttctcttcctaaacccaaaccctatgagcgtcagtcccgtcctcctcatgctgcagagcttctaagagcttactgtgcttctcgtggctacgttgcctctagtggactacctgatgaaacgaaagcagcgaggctgattctaaaagattacattggaggtaagctgccacattttgcaatgccgcctgggatgactgaaggtgatgaacagaagatagacgacactactcgagaaacaggagatgttgaaggttcagattccgaagactctacaataggagatgagaaagaaagggagcaagttcctggtatcgatgatgtgctagatgatctgagctcgtttgatctggcaaacgggcttgcatcttcgaagaaagtgacggtgaagaaggaaacagcgtcacataaacatcacaagaagccacagaggaaaaaggaccggaattggagggttaaaaacacagaggatggagatggaatgccgttggttagagtgttccagaaaccggctaacacagggcctctcacgatgcgatgatcaccaaatgttagtcatccgaccaaagagattcttttccaaagcttatgtgataaagattgtgtgttgtcaaacgaagattcgtaaaagtttgttttctttctttatatgcaataacagttgaacatgtcgcagttctcgagactattaatgttttttgcttccatgcttttttagtcttaagagttgaggaaaggatagaggagtgacaattcaaacttggt

SEQ ID NO: 604 - DNA, 2053 bp, Eutrema halophilum
aactcgtgaattcagcttcaccgtgcagccagtgcggacggcggctgacgttttcttagggttaacataacataacaaaagcgccgttgaatccatatcgaagggtttagattcttagggtttattgagagagagagagatggggaagaccgaaaagacgacgttagggcgatccctggtgaagcaccacaaccatatgattcaagaatccaaagacaaaggcaagtactacaagaatctccagaagaaggttctcgaatccgtcaccgaggtcagcgacatcgacgccatcatcgagcaggctgaggaggcagagcgtcttttcaccattaaccacagcaacaccacacctttgcccatcaatctagacacaaattccagctcaagtactgtagctgctgaagaatggagagagcagcagaagatagaagaggctttacacgccagtagtcttcaagtgccccgaagacctccttggacacccgaaatgtcagtggaagaacttgatgctaatgaaaaacaagcttttctgagttggcgccgaatgcttgtgaggctcgaggaaaatgaaaagcttgtgttgactccattcgagaagaacctcgacatctggagacagctttggcgagttcttgaacgtagtgatttgattgttatggtagttgatgctagagatccattgttttaccgttgccctgatctcgaggcatatgctcgagaaatcgatgagcataagaaaataatgcttctagttaacaaggcagatcttttgcctccttatgtcagggagaaatgggcagaatatttccgcctaaacaacattctgtttgtcttctggtcagccatagctgctacagctgccctagaaggtaaagtcttgaaagagccatggagaaaaccggataactttcagaagacagatgatccagaagtcgtgatatatggcagggacgagctgttgagccgtttacaatatgaggctcaagagattgtcaaagtgaggaattctagtgaatctcaacgtgagaatgctgtggttggttttgttgggtacccaaatgtgggaaagagttctacgatcaacgcattggtgggtcagaagcgaaccggtgtcacctctacaccaggaaagacaaagcatttccagactttgatcatctctgatgagcttatgctatgcgattgtcctggtttagtcttcccttcgttctcaagctcgagatatgagatgattgctagtggtgtacttccgattgataggatgacagagcaccgtgaagctatccaggtggtggctgacaaagtcccacgccatgtcatcgagagtgtctacaacatttctcttcctaaacccaaaccttatgagcgtcagtcgcgtccgcctcttgctgcagagcttttgagagcttactgtgcttctcgtggctacgttgcctctagtggactacctgatgaaacgaaagcagcgaggctgattctaaaagattacattggaggtaagcttccacattttgcaatgccacctggaatgagcctaggtgaggaatcgaagatagatgaaagtcaaggcaccggagctgtagaaggctctgattccgaagactctgacgtaggagatgagacggagagtgagcaagctcctggtattggtgaggttctagatgatttgagctcttttgatcttgcaaacgggcttgcgtcttcaaagaaagtgacagtgaagaagcaaacggcttcacataaacagcacaaaaagccgcagaggaaaaaggatcggaattggagggttcaaaacacagaggatggagatggaatgcctttggttcgagttttccagaaaccggctaacacagggcctctcatgatgcgatgatcatcatattgtaatcatcatccgagcaaaagatttcccaaaagtttatgtgatacagatagtggattggcaaacctaaggttcttacgttgtttttttttgtttgttatatcccaacagttgaacatttcgcggatttctttaaaacaaaaacaataaacatgtcgcggttttcgagtc

SEQ ID NO: 605 - DNA, 2080 bp, Brassica rapa
aacttgaatcagcttcaccagctaatgcggtcggcggctgacctaagaaaagctcaacactttttaacattaaccgactccatcgtctcaaaagggtttttatacttttagggttttaccgaaaagaagagagttcgagagagagagagagatggtgaagagcgagaagacgacgctggggcggtccctggtgaagcaccacaaccacatgatccaggaatcgaaggacaaaggcaagtactacaagaatctccagaagaaggttctcgaatccgtcaccgaggtcagcgacatcgacgccatcctcgaacaggccgaggaggctgagcgtcttttcactatcaatcacagtaacaccactcctctgcccattaatgtagacacacagtctagctcaagtactatagcagctgaagaatggagagagcaacagaagatagaggaggctttacacgccagtagtcttcaagtgcctcgaagacctccttggacacctgaaatgtcagtggaagagcttgatgctaatgagaaacaagcttttctgaattggcgccggatgcttgtgaggctcgaggaaaacgaaaagcttgtgttgacaccatttgaaaagaacctggatatctggagacagctttggcgtgtgcttgaacgtagtgatttgattgttatggtagtagacgctagagatccactgttttaccgttgccctgatcttgaggcatatgctagagaaattgatgagcacaagaaaatgatgcttttagtcaacaaggcggatcttttacctcctgaagtcagggcgaaatgggcagaatatttccgccgtaacgacattctctttgtcttctggtcagctatagctgccacagccgtcctagaaggcaaagtcttgaaagagcaatggagaaaatccgataacttccagaacacagacgatccagaagttgtcatatacggcagagacgagctcttggcccggttacagtccgaggcccaagagattgtcagagcgaggaactctagatcacctgttgatgagtctcaacgtgagaatgccgtcgttggatttgttggttaccctaacgtggggaagagttcaacaatcaacgcgttggttggtcagaagcgaacaggagtcacctcaactccagggaaaacaaagcacttccagacattgatcatatccgatgagcttatgctttgtgattgtcccggtttagtcttcccttcgttctcgagctcgagatacgagatgatcacttgcggtgtgcttcctatcgacaggatgacggagcaccgcgaagctatccaggtggttgctgacaaggtccctcgcagtgtcatcgagagtgtatacaacattacacttccgaaaccaaaaacatatgagcgtcagtctcgtcctcctctcgctgctgagctcttaagagcttactgtgcttcacgtggctacgttgcctctagtggactacctgatgaaacgaaagcggcgaggcagattctgaaggattacatcggaggtaagctgcggcattttgcaatgccgcctgggatgacggaggagaagatagaggatgacactggtcgagaaacaggttcagattctgaagaaggtgagggtgatgagaaggaaagcgacgagcaagttcctggtattgatgacgtgttggaggatctgagctcgtttgatctggcgaacgggcttgcttcttctaagaaagtgacagtgaagaaggagactgcttcacataaacagcacaagaagccgcagaggaagaaggataggaactggagagttaagaacacagaggaaggagatggaatgcctctggtgagagttttccagaaacctgctaacacaggacctctcacaatgcgttgatcttaccatattgtataacatccaagagtttatgatatgcagatggtgttttgtcatactaagatgcttcaaagtttttgtttttattatgtaataacagtttgaaccttctcgaatctgttcgatgtttttgtttccaaattttaagtcttatttggtgaaaaaggagaatggtgagagtgaaaattgaaatatggt

SEQ ID NO: 606 - DNA, 1995 bp, Brassica napus
gattctttcaaattctattaaattctttgattgaacttgattcagcttcaccgtaacgcggtcggcggctgacgttttctttaacctaagggaaaggctcatcgcttttaacattaacaaaacgcgcctccgcactcaaaagggttttagggttttacagagaagaggtcgcgagagatggtgaagagcgagaagacgacgctggggcggtccctggtgaagcaccacaaccacatgattcaggaatcgaaggacaaaggcaagtactacaagaatctccagaagaaggttctcgaatccgtcaccgaggtcagcgacatcgacgccatcctcgagcaggccgaggaggctgagcgtcttttcactattaatcacagcaacaccactccgttgcccattaatgtagacacgcagtctagctcaagtactatagcagctgaggaatggagggagcaacagaagatagaggaggctttacacgccagcagtcttcaagtgcctcgaagacctccatggacaccggaaatgtcagtggaagaacttgatgctaatgaaaaacaagcttttcttaattggcgccggatgcttgtgagactcgaggaaaacgaaaaacttgtgctgacaccattcgaaaagaacctcgacatctggagacagctttggcgtgttcttgaacgaagtgatttgattgttatggtagttgatgctagagatccactgttttaccgttgccctgatcttgaggcatatgctcgagaaatcgatgagcacaagaaaatgatgcttctagttaacaaggcggatcttttacctcctgaagtcagggcgaaatgggcagaatatttccgccgtaacgacattctcttcgtcttctggtcagctatagccgccacagccgtcctagaaggcaaagtcttgaaagagcaatggagaaaagccgataacttccagaacacagacgatccagaagttgtgatatacggcagggacgagctcttggcccgtttacagtccgaggcccaagagattgtcagagcgaggaactccagagcacctgttgatgagactcagcgtgagaatgctgtcgttggatttgtcggctacccgaacgtagggaagagttcaaccatcaacgcattggtcggtcagaaacgaacaggagttacctcaactccagggaaaacaaagcacttccagacattgatcatctctgaggagcttatgctgtgcgattgtcccggtttagtcttcccttcgttctcgagctcgagatacgagatgatcacttgcggtgtgcttcctatcgacaggatgacagagcaccgcgaagctattcaggtggttgctgacaaggtccctcgccgcgtcatcgagagtgtttacaacattactcttcctaaaccgaaaacatacgagcgtcagtctcgtcctcctcttgctgctgaggttttaagagcttactgtgcttcacgtggctacgttgcctctagtggactacctgatgaaaccaaagcggcgaggcagattctgaaggattacatcggaggtaagctgccgcacttcgcaatgccgcctgggatgacggaggagaaaatagaggatgacactggtcgagaaacaggttcagattctgaagaaggtgagggtgatgaggaaggaagcgagcaagttcctggtatcgatgacgtgctggatgatttgacctcgtttgatctggcgaacgggcttgcgtctacgaagaaagtgactgtgaagaaggaatcggcgtcacataagcaacacaagaagccgcagaggaagaaggataggaactggagggttaaaaacacagaggaaggagatggaatgcctctggtgagagttttccagaaacctgctaacacagggcctctcacgatgcgttgatctcaccattattgcataacatccaaagtttatgatatgcagtttggtgtatcaaacgagatgcttcaaagtttttttttcatatatgta

SEQ ID NO: 607 - DNA, 1767 bp, Brassica napus
cgcggcgtcccgcgaccaccacaccacatgactacaggaatcaggcaaaggcaagtactacaagaatctccagaagaaggttctcgaatccgtcaccgaggtcagcgacatcgacgccatcctcgagcaggccgaggaggctgagcgtcttttcactatcaatcacagtaacaccactcctctgcccattaatgtagacacacagtctagctcaagtactatagcagctgaagaatggagagagcaacagaagatagaggaggctttacacgccagtagtcttcaagtgcctcgaagacctccttggactcctgaaatgtcagtggaagagcttgatgctaatgagaaacaagcttttctgaattggcgccggatgcttgtgaggctcgaggaaaacgaaaagcttgtgttgacaccattcgaaaagaacctcgacatctggagacagctttggcgtgtgcttgaacgaagtgatttgattgttatggtagttgatgctagagatccactgttttaccgttgccctgatcttgaggcatatgctcgagagattgatgagcacaagaaaatgatgcttctagtcaacaaggcggatcttttacctcctgaagtcagggcgaaatgggcagaatatttccgccgtaacgacattctcttcgtcttctggtcagctatagctgccacagctgtcctagaaggcaaagtcttgaaagagcaatggagaaaagccgataacttccagaacacagacgatccagaagttgtcatatacggcagagacgagctcttggcccggttacagtccgaggctcaagagattgtcagagcgagaaactccagagcacctgttgatgagactcaacgtgagaatgctgttgttggatttgttggctaccctaacgtggggaagagttcaacaatcaacgctttggtcggtcagaaacgaacaggagtcacctcaactccagggaaaacaaagcacttccagacattgatcatatccgatgagcttatgctttgtgattgtcccggtttagtcttcccttcgttctcgagctcgagatacgagatgatcacttgcggtgtgcttcctatcgacaggatgacggagcaccgcgaagctatccaggtggttgctgacaaggtccctcgcagtgtcatcgagagtgtatacaacattacacttccgaaaccaaaaacatatgagcgtcagtctcgtcctcctctcgctgctgagctcttaagagcttactgtgcttcacgtggctacgttgcctctagtggactacctgatgaaacgaaagcggcgaggcagattctgaaggattacatcggaggtaagctgccgcattttgcaatgccgcctgggatgacggaggagaagatagagaatgacactggtcgagaaacaggttcagattctgaagaaggtgagggtgatgagaaggaaagcgacgagcaagttcctggtattgatgacgtgttggaggatctgagctcgtttgatctggcgaacgggcttgcttcttctaagaaagtgacagtgaagaaggagactgcttcacataaacagcacaagaagccgcagaggaagaaggataggaactggagagttaagaacacagaggaaggagatggaatgcctctggtgagagttttccagaaacctgctaacacaggacctctcacaatgcgttgatcttaccatattgtataacatccaagagtttatgatatgcagatggtgtttgtcatactaagatgctt

SEQ ID NO: 608 - DNA, 2559 bp, Arabidopsis lyrata
aaaatactcgactctgattgtctgaagaaagaaaccgaatcgattcaattcaacgtctcgtccatcgattttcgttttcccgagaaaatttaggaaagaaaaagagagggcagagacaacattttcttcgccgtctgagtgggaaagatggcggaggatttcgctagagcggtcgacgatgggcttaaactcgcgaaacggatttatttcggcaaagaccgagccgttgcggcgccgagaccaccagctccgatggagagatcttccacgacgcagtcttaccttcctacggcacctatggtttacgctgttatacccgacccgggaattgtggataacccggatttgcctagctaccagcctcacgtgcacggcaggtgcgacccaccggctctgatccctttgcagatgaattcgattgagcttgatgttgattgttatctcgacacggctcttgttaccgtcaccggatcgtggcgggttcattgtgttatgggaagcaagagatgtgattgccgaattgcaattcccatgggagaacagggttcaattctaggtgttgaggttgagattcctagaaaatcttacacaacgcagttgatcacagccgaagatggaaacgaattcgagaaaactgcactacctgaaactggaggcttcttgaaaccaaacatattcattcttacaataccacaggttgatggaggtaccaacctctctatcaagatgacttggtctcagaagttgacatataacgaagggcaattttttctcgatattcctttcaactttcctgagtatgtgactcctgcggtaaagaaaatctcaaagagagaaaagatatacttgagtgttaatgctggtactggaactgaagttctctgcaaaggatgcagtcatcaactaaaggagaaattgcgaagtgcagggaagttgaggtttgtatatgaagcagatgttttgaagtggtcaaacacggactttagtttttcttatacggcctcctcaagtaatatagttggtggacttttccttcaatctgcgcctgttcacgatgatgatcagagagacgtattttctttctatctttttccaggaaagcagcaaaaaactaaggcatttaagcgagaggtggtatttgttgttgacataagtaaaagcatgactggaaaacctcttgaggatgtaaacaatgcgatatccacagctctatctaagcttagtcctggagattccttcaatattatcactttcagcgatgatacttctctgttttcgacatcgatggagtcggtcacttccgatgctgttgaaagaggcattgagtggatgaataagaactttgttgtcgcagatggtacaaacatgctccttcccctagagaaggctgtggaaatgctttcaaatactcgtggctctattcctatgattttcttcgtaacagatgggtctgttgaagatgagagacacatttgtgatgtaatgaagaaacatctagctagtgctggatcagtgtgtccacggatacacacttttgggttaggtatattctgtaatcactacttcctgcaaattcttgcaaatctatcctgcggccagcacgaatcagtttataatacagatcacatcgaggaacgaatggacaaactgtttacaaaggctttatctaccatccttgttaatataacaattgagccccttcagagtctagatgaagttgaggtatacccttcgaatattccggatctgacatctgcaagtccattgatgatatatggaagataccgaggaaagttccccgagaatgtgatagccaaaggtctgctaggagatttgagcagcttttctacagacttgactgtacgaagtgcaaaagatatgcctcttgataaagtatttgcaaagaatgtgattgacttgcttactgctgaggtatggctctctgaagataaacagctaaaagagaagattgccaaactaagcatccaaactggcgtaccatccgagtatactcgaatgatccaattagagaacacagaagaattaaaacccagcgaaactggcgtaaagaaaaagacaacaagcaatggagagaaacagaagatgatatcaagaacaatcccgctacaaagccttgggataggctttggtgataaaacagccaccagagagaatgttccaccaggatttggtgagcagaaagcacctgatgctgctgagaaattcgtcaaggctgcttcgagctgttgtgtctccttgtgcaataaatgttgctgcatgtgttgtgtccaatgctgctctaagctcaatgatcaatgtgtccttgtattcacacagctcttcacagcgattgcttgcatcgcctgttttgaatgttgctcaactgtttgctgtgctggagacgatgggtagttagttatattatttataaaaaaaaacggttttgaattcgagtgtaaagctttaaaagtttcaagtaagtttgtacatttacatacacactgcatgtaacttctgtacggcctgatcaaatataaaagctgtggtttcttttgtata

SEQ ID NO: 609 - DNA, 2722 bp, Eutrema halophilum
ggaaaaaactcgactccgaagtgatttctttcccctttttttccccatcgttgtctgaagaaagaaaccgaattagaatcaatttcaacgattcgtcctccggattttcaattctgatttgctttcccgagaaaataaagagaagaaggcgaagcaacccgagacaaatttcttcgccgtctgtgtgggaaagatggcggaggatttcgcaagggcggtggacgatgggcttaagctcgcgaaacggatttatttcggaaacgaccgagcggttgcggcgccgaggctagcggcgccgatggagagatcttccccggcgcaggcttaccttccttcggcaccgatggtttacgccgttatacccgacccggggattgtggataacccggatttgcccagctatcagcctcacgtgcacggcaggtgcgacccaccggctctgattcccttgcagatgaacgcgattgagctcgacgttgattgttacctcgacacggctctcgttaccgtcaccggatcgtggcgtgttcactgcgttatgggaagcaagagatgtgattgccgaatcgctattcctatgggagaacagggttcaattctaagtgttgaggttgagattcctagaaaatcttacacaacccaattgatctcagccgaagatggcaacgaattggagaaatcggcacaacctcaaaatgcaggcttcttgaaaccaaacatattcactctcacagtgccacaggttgatggaggtacaaacctctctatcaagatgtcttggtctcagaagttgacttacaacgaagggcagtttttcctcgatattcctttcaactttcctgagtatgtgactcctgctgtaaagaaaatctctaagagagaaaagatttacttgagtgttaatgccggtactggaacagaagttctatgtaaaggatgtagtcatcaactaaaggaaaaaatgcggaatgccgggaagttgaggttttcatatgaagcagatgttttgaagtggtcgaataccgattttagcttttcttatacggcttcttcaagtcatatagttggtggacttttccttcaatctgcgcctgttcacgacgttgatcagagagatatattttctttctatctttttcctggaaagcagcaaagaaccaaggcattcaagcgggaggtaatgtttgttgttgatacaagtaaaagcatgaccggaaaacctctcgaggatgtacataatgcgatatcgaccgctctatctaagcttaatcctggagattccttcaacattatcactttcagtgatgacacttctctgttttcgacatcaatggagttggttactccagatgctgttgaaagaggaattgagtggatgaacaagaactttgttgtcgccgatggtacaaacatgctccctcctctagagaaggctgtggaaatgctttcgaatactcgtggctccattcctatgatcttcttcgtaacagatgggtctgttgaagatgagagacacatttgcgatgtaatgaagaaacgtcttgctagtgctggatcagtgtgtccacggatacacacttttgggttaggtgtattttgtaatcactacttcctgcaaatgcttgcgaatctatccaggggccagcacgaatcagtttataatacagatcacatcgaggaacgaatggacaaattgtttacaagggctttatccactgttcttgtgaatataacaatcgagcccctgcagaatcttgatgaagttgaggtatacccttcaaatattccggatctgacgtctgcaagtccattgatgatatatggaagataccgaggaaagttccctgagaatgttaaagccaatggtctgctaggagatttgagcagcttttctgcagacttgacggtacaaagtgcaaaagacatgcctcttgataaagtatttgcaaagaatgtgattgacttgcttactgctgaggcatggttctctgaagacaaacagttaaaagagaagattgctaaactaagcatccaaaccggtgtaccatctgagtatactcgaatgatccaattggagcacacagaagaagcattgaaacccagcgacactggcggaaagaaaaagacagccagcaacggcgagaaacagaagatgatatcaagaacgatcccactacaaaacctcgggataggctttggtgatagaacagccaccacagagaatgttccaccaggatttggagaacagagagcacctgatgctgcagagaagttcgtgaaggctgcctcgagctgttgtgtctccttgtgcaacaaatgttgctgcatgtgttgtgtgcaatgctgcacgaagctcaatgatcaatgtgtccttgtcttcacacagctcttcacagcgcttgcttgcatcgcctgctttgaatgttgcacaaatgtttgctgtacctgtggagacgactagttatttaaaaaaatgatttggaattcgagtgtaaagcttgaataagcttcaaaggaagtctgtacatttaccttacactgcatgtaatttttgtacggccgggtcagatataaaaggtgtgttttttttgttgttgtatagctgcttcagaggagaaagtgtaaagaacagacaaatccatgtgtatccttcacaatttactcgatttcgatctcttaaaccatatttttttatataaagaatgcgattttgttgaaccga

SEQ ID NO: 610 - DNA, 2720 bp, Eutrema parvulum
aaaagagtcgactcctaagtgatttctttcccctttttttttccctcgttgtctgaagaaaggaaccgaaccgattcgattccacgactcggcctcgtattgctttcccgagaaaatttaggagagaaaagagaagagagaaccaaaccccgagacaaacatttcttcgccgtctgtgtgggaaagatggcggaggatttcgcaagagcggtggacgatgggcttaaactggccaaacggatttattttggaaacgaccgagcggttgctgcgccgaggctaacggcgccgatggagagatcttctacgccgccggcttaccttccttcggcaccgatggtttacgccgttatacccgacccgggaattgtagataatccggacctacctagctatcagcctcacgtgcacggcaggtgcgacccaccggctctgattcctctgcagatgaacgcgattgagcttgacgtcgattgttatctcgacacggctctcgtcaccgtcaccggatcgtggcgtgtccactgcgttatgggaagcaagagatgtgattgccaaatcgctattcctatgggagaacagggttcaatactaggtgttgaggttgagattcctagaaaatcttacacaacccaattgatcacagccgaagatggaaacgaattggagaaaacggcacaacctcaaactggaggcttcttgaaaccaaacatattcactcttacaataccacaggttgatggaggtaccaacctctctatcaagatgtcttggtcccagaagttgacgtataacgaagggcagtttttcctcgatattcctttcaactttcctgagtatgtgactcctgctgtaaagaaaatctccaagagagaaaagatttacttgagtattaatgccggtactggaacagaagttctctgcaaaggatgcagtcatcaactaaaggaaaaaatgcggaatgcagggaagttgaggttttcatatgaagcagatgttttgaaatggtcaaacacagattttagcttctcttatacggcctcttcaagtaatatagttggtggacttttccttcaacctgcgcctgttcacgatgttgatcagagagatatattttctttctatctttttccaggaaagcagcaaagaactaaggcattcaagcgggaggtagtatttgttgttgatataagtaaaagcatgactggaaaacctcttgaggatgtgaacagcgcgatatctatagctctatctaagcttaatcctggagactccttcaatattatcactttcagctatgatacttctctgttttcgacatcaatggagttggttacctcaaatgctgttgaaagagggattgagtggatgaacaagaactttgttgtcgcagatggtacaaacgtgctccctcccctagagaaggctgtggaaatgctttcaaatactcgtggctccattcctatgatcttcttcgtaacagatgggtctgttgaagatgagagacacatttgtggtgtcatgaagaaacatcttgctagtgctggatcagtgtgtccacggatacacacttttgggttaggtgtattctgtaatcactacttcctgcaaatgcttgcaaatctatccaggggccagcatgaatcagtttataatacagatcacatcgaggaacgattagacaaattgttaacacgggctttatccactgttcttttgaatataacaatcgagcccctgcagaatcttgctgaaattgagatatacccttcgaatattccggatctgacgtcctcaagtccgttgatgatatatgggagataccgaggaaagttccctgagaatgtgaaagccaatggtctgcttggagatttgagcagcttttctgcagacttgactgtacaaagtgcaaaagacatacctcttgataaagtgtttgcaaaaaatgtgattgacttgcttactgctgaggcatggttctctgaagacaaccagctaaaagaaaagattactaaactaagcattcaaaatggcgtaccatctgagtatactcgaatgatccaattggagaacacagaagatgtattgaaaccgagcgacactggcggaaagaaaaagacagcaagcaacggcgagaaacagaagatgatatcaagaacaatcccactacaaaactttgggataggctttggtgatataacagctaccagagagaatgttccaccaggatttggagaacagagaggacctgatgctgctgagaaattcgtgaaggctgcctcgagctgttgtgtctcattgtgtaacaaatgttgctgtatgtgttgtgtccaatgctgcactaagctcaatgatcaatgtgtccttgtcttcacacagctcttcacagcgattgcttgcatcgcctgctttgaatgttgcacaaatgtttgctgtgcctgtggtggagacgagtagttacaaaaaatgattctgaattcgagtgtaaagcttttaaaagcttcaaagtaattttgtacatttaccttacacagttacactacatgtaatttatgtacggcctggtcaaatattaaaagctttacttttttttgtatagttgtctcaggggagaaagtgtaaagaacagacaaaatccatgtgttatccttcaactagttactcgatttcgatatcttaaacaattgtttatttaaagaatgcgattttggtgaaccaac

SEQ ID NO: 611 - DNA, 2394 bp, Brassica napus
tttcgccgtctgtatcggagagatggcggaggatttcgcaagagcggtggacgacgggcttaaactagccaaacggatatacttcggacacgaccgagcagtcgccgcgccgaggctaacggcgccgatggagagatcgtccacgtcgcaggctcaccttccttctgcgccgatggtttacgccgttatacccgacccgggaatcgtggataacccggacctacctagctaccagcctcacgtgcacggcaggtgcgacccacctgctctgatccctctccagatgaacgcgatcgagctccacgtggattgctatctcgacacggctctcgtcaccgccaccggatcgtggcgtgtccactgcgtcatgggaagcaagagatgtgattgcagaatcgctattcctataggagaccagggttcaattctaggtgttgaggttgagattcctagaaaatcttacacaacgcaactgatcacagcacaagatggtacggaactggagaaaacggcacaacctcaaagtggtggcttcttgaaaccaaacatattcactcttacagtaccacaggttgatggaggcaccaacctctctatcaagatgacttggtcccagaagctaacgtataacgaaggccagttttttctggacattccattcaacttccctgagtatgtgacgcctgcggttaagaaaatctccaagagagaaaagatttacttgagtgttaacgccggtactggaacagaagttctctgcaaaggatgcagtcatccacttaaggaaaaatgaggaacgcagggaagttaaggtttgcatatgaagcagatgttttgaagtggtcgaacacagattttagcttctcttacacggtctcttcaagtaatatagttggtggactgttccttcaatctgcgtctgttcaagatgttgatcagagagatatcttttctttctatctttttccgggaaagcagcaaagtactaagtcagctaagcgggaggtagtgtttattgttgatataagcaaaagcatggctgggaaacctctagaggatgtaaagaacgcgatatctacagctctatctaagctcaatcctgaagattccttcaatatcatcacttttagtgatgatacttctctgttttcgacatcgatggaggcggttacttcagatgctgttgaaagaggtatcgagtggatgaacaagagctttgttgtcgcagatggtaccaacatgctcccacccctagagaaggctgtggaaatgctttcgaatactcgcggctccgttcctatgatcttcttcctaacagatggttctgttgaagatgagagacacatttgtaatgtaatgaagaaacgtcttgctaatgctggttcagtgtggccacggatacacacttttgggttaggtgtgttctgtaatcactacttccttcaaatgcttgctaatatatccaggggacagcatgaatcagtttataatacagatcacattgaggaacggttagacaagttgtttataagggccttatccactgttcttttgaatataacaattgagcctctgcagaatcttgatgaagttgaggtgtacccttcaaacattcctgatctgacttcctcaagtccattgatggtgtatgggagataccgaggaaagtttcctgagagtgtgaaagcaaatggtctgcttggagatttgagcagcttttctgtagacttgactgtacaaagtgcaaaagacatgcctcttgataaagtgtttgctaaaaatgtgattgacttgcttactgctgaggcttggttctctgaagacaaccagccaaaagaaaagattactagactaagcatccaaactggtgtaccatctgagtacactcgaatgatccaattggagaacacagaagaagcatctaaacccatcaacactggtggaaagaaaaagactgaaaccaacggagagaaacagaaggtgatatcaagaaccatcccactacaaaactttgggataggctttggtgatacaacagctaccaaagagaatgttccaccaggatttggagaagcgagagcacctgatgctgctgagaagttcgtcaaggctgcctccagctgctgcgtctccttgtgcaacaaatgttgctgcatgtgctgtgtccagtgctgcactaagctcaatgaccaatgtgtcattgtcttcacgcagctcttcacagcgattgcttgcattgcctgctttgaatgttgctcacatgtatgctgtggtggagacgactagttataataaaaaaatatgattttgaatttcgagtgtaaagctttatgaagcttcagtaagtttgtacattttactctatacggcttggtgaaatataaaagttttact

SEQ ID NO: 612 - DNA, 2594 bp, Brassica rapa
caactccgaagtgatctcgctgtctgaaaaaagcagccgaaatcgattcagctcaacgactcgaaagagaagagaaccccgacacaacgtttctttcgccgtctgaatcggagagatggcggaggatttcgcaagagcggtggacgacgggcttaaactagccaaacggatatacttcggacacgaccgagcagtcgccgcgccgaggctaacggcgccgatggagagatcgtccacgtcgcaggctcaccttccttctgcgccgatggtttacgccgttatacccgacccgggaatcgtggataacccggacctacctagctaccagcctcacgtgcacggcaggggcgacccacctgctctgatccctctccagatgaacgcgatcgagctccacgtggattgctatctcgacacggctctcgtcaccgccaccggatcgtggcgtgtccactgcgtcatgggaagcaaaaaatgtgattgccgtatcgctattcctataggagaccagggttcaattctaggtgttgaggttgagattcctagaaaatcttacacaacgcaactgatcacagcacaagatggtacggaactggagaaaacggcacaacctcaaagtggtggcttcttgaaaccaaacatattcactcttacagtaccacaggttgatggaggcaccaacctctctatcaagatgacttggtcccagaagctaacgtataacgaaggccagttttttctggacattccattcaacttccctgagtatgtgacgcctgcggttaagaaaatctccaagagagaaaagatttacttgagtgttaacgccggtactggaacagaagttctctgcaaaggatgcagtcatccacttaaggaaaaaatgaggaacgcagggaagttaaggtttgcatatgaagcagatgttttgaagtggtcgaacacagattttagcttctcttacacggtctcttcaagtaatatagttggtggactgttccttcaatctgcgtctgttcaagatgttgatcagagagatatcttctctttctatcttttcccaggaaagcagcaaagtactaagtcagctaagcgggaggtagtgtttattgttgatataagcaaaagcatggctgggaaacctctagaggatgtaaagaacgcgatatctacagctctatctaagctcaatcctgaagattccttcaatatcatcactttcagtgatgatacttctctgttttcgacatcgatggaggcggttacttcagatgctgttgaaagaggtatcgagtggatgaacaagagctttgttgtcgcagatggtaccaacatgctccctcccctagagaaggctgtggaaatgctttcgaatactcgcggctccgttcctatgatcttcttcctaacagatggttctgttgaagatgagagacacatttgtaatgtaatgaagaaacgtcttgctaatgctggttcagtgtggccacggatacacacttttgggttaggtgtgttctgtaatcactacttccttcaaatgcttgctaatatatccaggggacagcatgaatcagtttataatacagatcacattgaggaacggttagacaagttgtttataagggccttatccactgttcttttgaatataacaattgagcctctgcagaatcttgatgaagttgaggtgtacccttcaaacattcctgatctgacttcgtcaagtccattgatggtgtatgggagataccgaggaaagtttcctgagagtgtgaaagcaaatggtctgcttggagatttgagcagcttttctgtagacttgactgtacaaagtgcaaaagacatgcctcttgataaagtgtttgctaaaaatgtgattgacttgcttactgctgaggcttggttctctgaagacaaccagccaaaagaaaagattactagactaagcatccaaactggtgtaccatctgagtacactcgaatgatccaattggagaacacagaagaagcatctaaacccatcaacactggtggaaagaaaaagactgaaaccaacggagagaaacagaaggtgatatcaagaaccatcccactacaaaactttgggataggctttggtgatacaacagctaccaaagagaatgttccaccaggatttggagaagcgagagcacctgatgctgctgagaagttcgtcaaggctgcctccagctgctgcgtctccttgtgcaacaaatgttgctgcatgtgctgtgtccagtgctgcactaagctcaatgaccaatgtgtcattgtcttcacgcagctcttcacagcgattgcttgcattgcctgctttgaatgttgctcacatgtatgctgtggtggagacgactagttataataaaaaaatatgattttgaatttcgagtgtaaagctttatgaagcttcagtaagtttgtacattttactctatacggcttggtgaaatataaaagttttacttgtatagttgctttcaggggagaaaagtgtaaaagaacagacaaatccatgtgttttcattcaacttgttacttgatcttgatcttttaaaccatattttatatta

SEQ ID NO: 613 - DNA, 2655 bp, Brassica rapa
tctataattcaactcaccgaaaacgattcatctcagcgattcgattcgtcttctcggattgttttcaggaaacgaaagagagaggcaacgaaaccctaagacaaacgtttcttcgccgtctctgtgctaaaagatggcggaggatttcgcgagggcggtggaggacgggctcaaactcgcgaaacggatttatttcggaaacgaccgagccgtcgcggcgccgaggctagcttccccgatggagagagccgcctccgcggcgcatgctcaccttcctacggcgccaatggtgtacgccgtgatacacgagccgggaatcgtggataacccggacctgcctagctaccagcctcacgtgcacggcaggtgcgaccctccggctctgattcctctccagatgaacgcgattgagctcgacgtcgactgttatctcgacacggctctcgtcaccgtcaccggatcgtggcgtgtgcattgcgttatgggaagcaagcgatgcgattgccgtatcgctattcccatgggtgaacagggatcaattctaggtgttgaggttgagattcctagaaaatcttacacaacacagttgatcacagctgaagatggacatgagttggagaagacggcacaacctcagagtggaggtttcttgaaaccaaacatattcaccatcacaataccacaggttgatggaggtactaacctctctatcaagatgtcttggtctcagaagttgacgtataacgaaggagagtttttcctggatattccttttcactttcctgagtatgtgactcctgctgtgaagaaaatctccaagagagagaagatttacttgagtgtcaacgctggtactggaacagaggttctctgcaaaggatgcagtcatccgctaaaggaaaaaatgaggaaggcagggaagttgaggttttcatatgaagctgatgttttgaagtggtcgaacacagattttagcttttcttatacggcctcttcaagtaatatagttggtggacttttccttcaatctgcgcctgttcaagatgttgatcagagagagatattttctttctatctttttccaggaaagcaacaaagaactaaggcattcaagcgggaagtagtatttgttgttgatataagtaaaagcatgactggaaaacctctggaggatgtaaagaatgcgatatcgacagctctatctaagcttagtccgggagattccttcaatattatgagtttcagcgatgaaacttctctgttttcgacatcaatggagccagctactccagatactgttgaaagaggcattgagtggatgaacaagaactttgttgtcgcagatggtacaaacgtgctccctcccctagagaaggctgtggaaatgctatcgaatactcgtggctcccttcctatgatattcttcgtaacagatgggtctgttgaagatgagagacacatttgtgatgcaatgaagaaacgtcttgctagtgctggatcagtgtgtccacggatacatacttttgggttaggtatattctgtaaccactacttcctgcagatgcttgcaaatctatccaggggacagcacgaatcagtttataatactgatcacatcgaagaacgattagacaaattgtttacaagggctttgtccaccgttcttttgaatataacaattgagccccttcagaatcttgatgaaattgaggtatacccttcaaatattccggatctgacgtctgtaagtccattgatgatatatgggagataccgaggaaagttccctgagaaagtgaaagccaatggtctgctaggagacatgagcagcttttctgcagacttgtctgtacaaagtgcaaaagacatacctcttgataaggtgtttgcaaagaacgtgattgacttgctaactgctaaggcatggttctcggaagacaaacagctaatagaaaagattactaaactaagcatccaaaccggcgtaccatctgagtatacccgaatgatccagttggagaacacagaagaagcactgaagcccagtgacactggcggaaagaaacagacgggaagcaatggcgagaaacagaagctgatatcaagaacaatcccactacaaaactttgggataggctttggtgatacaacagctaccagagagaatgttccaccaggatttggagaacagagagcgcctgacgctgctgagaagttcgtgaaggctgcctcgagctgttgtgcctccttgtgcaacaaatgttgctgcatgtgttgtgtccagtgctgcactaagctcaatgatcaatgtgttcttgtcttcacacagctcttcacagcgcttgcttgcatcgcctgctttgaatgttgctcaaatgtctgctgtgcctgtggtggagacgaatagttataaaaaaatgtttttgaattctgagtttaaaagcttttaagagcttcaaagtaagtttgtacatttaccttacacactaaatgtaatttctgtacggcctaatccaatataaaagctttacttaaattttctatagttacttcaggtgaggaagtgtaaagaaccgacaaatccatgtgtactagttactcgatttcgatatcataaaccatgttttatatagaatgttattatggtgagccgac

SEQ ID NO: 614 - DNA, 2415 bp, Brassica napus
tcaactcagaagaaacaaaaccgaaacgattcaactcaacgattcgattcgtcttctcaaattgttagttatctggaaacgaaagagagaagcaaccaaagcctaagacagcgtctctctcttcggtaaaagatggcggaggatttcgcgagggcggtggaggacggtctcaaactcgcgaaacggatttatttcggaaacgaccgagccgtcgcggcgccgaggctagcgtccccgatggagagagccgcctccgcggcgcatgctcacctccctacggcgccaatggtttacgccgtgatacacgagccgggaatcgtggataacccggacctgcctagctaccagcctcacgtgcacggcaggtgcgaccctccggctctgattcctctccagttgaacgcgattgagctcgacgtcgactgctatctcgacacggctctcgtcaccgtcaccggatcgtggcgtgtgcattgcgttatgggaagcaagcgatgcgattgccgtatcgctattcccatgggtgaacagggctcaattctaggtgttgaggttgagattcctagaaaatcttacacaacacagttgatcactgctgaagatggacatgagttggagaagacggcacaacctcaaagtggaggtttcttgaaaccaaacatattcaccatcacaataccacaggttgatggaggcaccaacctctctatcaagatgtcttggtcccagaagttgacgtataacgaaggagagtttttcctcgatattccttttcactttcctgagtatgtgactcctgctgtgaagaaaatctccaagagagagaagatttacttgagtgtcaacgctggtactggaacagaggttctctgcaaaggatgcagtcatccgctaaaggaaaaatgaggaaggcagggaagttgaggttttcatatgaagctgatgttttgaagtggtcgaacacagattttagcttttcttatacggcctcttcaagtaatatagttggtggacttttccttcaatctgcgcctgttcaagatgttgatcagagagagatattttctttctatctttttccaggaaagcaacaaagaactaaggcattcaagcgggaagtagtatttgttgttgatataagtaaaagcatgactggaaaacctctggaggatgtaaagaatgcgatatcgacagctctatctaagcttagtccgggagattccttcaatattatgagtttcagcgatgatacttctctgttttcgacatcaatggagccggctactccagatactgttgaaagaggcattgagtggatgaacaagaactttgttgtcgcagatggtacaaacgtgctccctcccctagagaaggctgtggaaatgctatcgaatactcgtggctcccttcctatgatattcttcgtaacagatgggtctgttgaagatgagagacacatttgtgatgcaatgaagaaacgtcttgctagtgctggatcagtgtgtccacggatacatacttttgggttaggtatattctgtaaccactacttcctgcagatgcttgcaaatctatccaggggacagcacgaatcagtttataatactgatcacatcgaagaacgattagacaaattgtttacaagggctttgtccaccgttcttttgaatataacaattgagccccttcagaatcttgatgaaattgaggtatacccttcaaatattccggatctgacgtctgtaagtccattgatgatatatgggagataccgaggaaagttccctgagaaagtgaaagccaatggtctgctaggagacatgagcagcttttctgcagacttgtctgtacaaagtgcaaaagacatacctcttgataaggtgtttgcaaagaacgtgattgacttgctaactgctaaaggcatggttctcggaagacaaacagctaatagaaaagattactaaactaagcatccaaaccggcgtaccatctgagtatacccgaatgatccagttggagaacacagaagaagcactgaagcccagtgacactggcggaaagaaacagacgggaagcaatggcgagaaacagaagctgatatcaagaacaatcccactacaaaactttgggataggctttggtgatacaacagctaccagagagaatgttccaccaggatttggagaacagagagcgcctgacgctgctgagaagttcgtgaaggctgcctcgagctgttgtgcctccttgtgcaacaaatgttgctgcatgtgttgtgtccagtgctgcactaagctcaatgatcaatgtgttcttgtcttcacacagctcttcacagcgcttgcttgcatcgcctgctttgaatgttgctcaaatgtctgctgtgcctgtggtggagacgaatagttataaaaa

SEQ ID NO: 615 - DNA, 2481 bp, Brassica napus
agaaaatttaggaaagaaagagagaaccaaaccccgagacaaagatctcttcgccgtcctcaagatggcggaggatttcgcaagggcggtggaagatggtctcaaactcgcgaaacgtatatatctcggaaacgatcgcgccgtcgcggcgccgaggctagcggcgccgatggagagaacctccacggcgcaggcctaccttccttcgtcccccatggtctacgcagttatacccgacccgggaatagtggataatcctgacctacctagctaccagcctcacgtgcacggcaggtgcgacccaccggctctgattcctctccagatgaacgctatagagctcgacgtcgattgttatctcgacacggctcttgtcaccgtgaccggaacgtggcgtgtccactgcgtcatgggacgcaagagatgcgattgccgtatcgctgttcctatgggagaacatggttcgattctaggtgttgaggtcgagattactagaaagtcttacgcaacgcaactgatcgcggctcaagatggtaacgagttggagaaaacgacgcaacctcaaagtggagggttcttgaaaccaaacatattcactcttactgtaccacaggttgatggaggtaccaacctctctatcaagatgtcttggtcccagaagttgacgtataacgaaggagagtttttcctcgatattccttttcactttcctgagtatgtgactcctgctgtgaagaaaatctccaagagagagaagatttacttgagtgttaacgccggtactggaacggaagttctctgcaaaggatgcagtcacccgctaaaggaaaagatgaggaacgcagggaagttgaggttttcatatgaagctgatgttttgaagtggtcgaacacagattttagcttttcttatacggcctcttcaagtagtatagttggtggacttttccttcaatctgcgcctgttcaagatgttgatcagagagagatattttctttctatctttttccaggaaagcaacaaagaactaaggcgttcaagcgggaggtagtatttgttgttgatataagtaaaagcatgactggaaaacctctcgagaatgtaaacaatgcgatatcggcagctctatctaagcttaatccgggagattccttcaatattatgactttcagcgatgatacttctctgttttcgacatcaatggagccggctactccagatactgttgaaagaggcattgagtggatgaacaagaactttgttgtcgcagatggtacaaacgtgcttcctcccctagagacggctgtggaaatgctatcgaatactcgtggctcccttcctatgatcttcttcgtaacagatgggtctgttgaagatgagagacacatttgtgatgcaatgaagaaacgtcttgctagtgctggatcagtgtgtccacggatacacacttttgggttaggtatattctgtaaccactacttcgtgcagatgcttgcaaatctatccaggggacagcacgaatcagtttataatactgatcacatcgaggaacgattagacaaattgtttacaagggctttgtccactgttcttttgaatataacaattgagccccttcagaatcttgatgaaattgaggtatacccttcaaatattccggatctgacgtctgcaagtccattgatgatatatgggagataccgaggaaagttccctgagaatgtgaaagccaatggtctgctaggagacatgagcagcttttctgcagacttgactgtacaaagtgcaaaagacatacctcttgataaggtgtttgcaaagaatgtgattgacttgctaactgctaaggcatggttctcggaagacaaacagctaatagaaaagattactaaactaagcatccaaaccggcgtaccatctgagtatactcgaatgatccagttggagaacacagaagaagcactgaaacccagtgacactggcggaaagaaacagacgggacgcaatggcgagaaacagaagctgatatcaagaacaatcccactacaaaactttgggataggctttggtgatacaacagttaccagagagaatgttccaccaggatttggagaacagagagcgcctgacgctgctgagaagttcgtgaaggctgcctcgagctgctgtgtctccttatgcaacaaatgttgctgcatgtgttgtgtccagtgctgcactaagctcaatgatcaatgtgtccttgtcttcacacagctcttcacagcgcttgcttgcatcgcctgctttgaatgttgctcaaatgtctgctgtgcatgtggtggagacgaatagttattaaaaaaaaaagattttgaattctgagtttaaaagcttttaagcttcaaagtaagtttgtacatttaccttacacactaaatgtaatttctgtacggcctgatccaatataaaagctttactaaattttctatagtttgctt

SEQ ID NO: 616 - DNA, 2598 bp, Brassica rapa
aaagacagaacttcccaagtgatttgtttccctcgttgtctgaagaaaggaacatcctcctctcagattattttcccgagaaaatttaggaaagaaagagagaaccaaaccccgagacaaagatctcttcgccgtcctcaagatggcggaggatttcgcaagggcggtggaagatggtctcaaactcgcgaaacgcatttatctcggaaacgaccgtgccgtcgcggcgccgaggctagcggcgccgatggagagaacctccacggtgcatgcctaccttccttcgtcccccatggtctacgcggttatacccgacccgggaatcgtggataacccggacctacctagctaccagcctcacgtgcacggcaggtgcgacccaccggctctgattcctctccagatgaacgctatcgagctagacgtcgattgttacctcgacacggctcttgtaaccgtcaccggaacgtggcgtgtccactgcgtcatgggaagcaagagatgtgattgtcgtattgctgttcctatgggagaagaacatggttcgattctaggtgtagaggtcgagattactagaaagtcttacgcaacgcaactgatcgcggctcaagatggtaacgagttggagaaaacgacgcaaactcaaagtggagggttcttgaaaccaaacatattcactctcactgtaccacaggttgatggaggtaccaacctctctatcaagatgtcttggtcacagaagctgacgtataaggaaggagagttcttcctagacattccttttaactttcctgagtatgtgactcctgctgtaaagaaaatctccaagagggagaagatttacttgagtgttgatgccggaaccggaacagaagttattagtaaaggatgcagtcatcaacttaaggagaaagtgaggaatgctgggacgttgaggttttcatatgaagcagatgttttgaaatggtcaaatacagactttagcttttcttgcacggcctcttcaagtaatatagttggtggactttttcttcaatctgcgccagttcacgatgtagatcagagagatgtattctcattctaccttttcccaggaaagcagcaaaaaattaaggcattcaagagggaagttgtgtttgttgttgatgtaagtaaaagcatgactggtaaacctctagaggatgtaaacaacgcgatatctacagctctatctaagcttagtcctggagattcctttaacatcatcactttcagcgatgatacttctctgttttcgacctcgatggagttggttactccagatgctgttgaaagaggcattgagtggatgaacaagaactttgctgtctctgatggtacaaacatgctccctcctctagagaaggctgtggaaatgctttcgaatacacgtggctcggttcctatgatcttctttgtaacagatgggtctgttgaagatgagagacacatatgtaatgtaatgaagaaacgtcttgctagtggtggatcagtgtctccacggatacacacttttgggctaggtgtattctgtaatcactacttcctgcaatcgcttgcaaatctatctaggggccaacacgaatcagtttataatacagatcatatcgaggaacggttagacaaattgtttacaagggctttatccactgttcttttgaatataacgattgagcctctgcaggttcttgatgaagttgaggtatgcccttcaaacattcctgatctaacgtcttcaagtccgttgatgatatatgggagatacagaggaaagttccctgagaatgtgaaagccaatggtctgctaggagattttagcagcttttctgtggagttgactgtacaaagtgcaaaagacatgcctcttgataaagtgtttgcaaagaatgtgattgacttgcttactgctgaggcatggttctcggaagacaaacagctaatagaaaaggttactaaactaagcatccaaaccggtgtaccatctgagtatactagaatgatccaactggagaacacagaagaagcatcaaaacaaagtgacactggaggaaagaaaaagacagcgagcaacggcgagaaacaaaagctgatatcaagaacaatcccactgcaaaaatttagtataggctttggtgatataacagctacaagagagaatgttccaccaggatatggagagcagagagcacctgatgctgctgagaagttcgtgaaggctgcctcgagctgttgtgtctcattgtgcaacaaatgttgctgcatgtgttgtgtccaatgctgcaccaagctcaatgatcaatgtgtccttgtcttcacacagcttttcacagcgcttgcttgcatcgcctgctttgaatgttgcacaaatgtttgttgtgcatgtggtggagaagactagttataagaaaagataaaaaagattttaagaagcttcaaagtaagtttgtacatttacgttacagacacgacatgtaatttctgtacggcctggtcatatataaaagatttacttcaggggagaaagtgtaaaggacagacaaatccatgtgttttttctcaactagttgattgatttcgatc

SEQ ID NO: 617 - DNA, 1813 bp, Arabidopsis lyrata
aaatcattcagagagagagcttctgagacataaacatcaattcaaattgacgcaagcataaacaaaatggaaaatggaagtgggaaggtgttgaagccgatggactcagagcaattgagagaatacggacatcgaatggttgatttcattgctgattattacaaaaccatcgaagacttccctgttcttagccaagttcagcctggttatcttcataagcttttgcctgattccgcaccagaccaccctgaaactctagaccaagttcttgatgatgttcgagcgaagatattgcctggagtaacgcattggcaaagcccgagtttctttgcttattatccttctaacagcagtgttgctgggttcttgggggagatgttgagtgctggtcttggtattgttggttttagttgggttacttctccagctgctaccgagctagaaatgattgttcttgattggcttgccaaactgctcaacctacccgagcagtttatgtccaaaggaaatggaggtggagttatacaagggtcagctagtgaagctgttcttgttgttctcattgctgcccgtgacaaggttttaagaagcgttggcaaaaacgcgcttcagaagcttgttgtctactcctctgaccagacccattccgctttacagaaggcctgccagattgctggaatccatccagagaattgcagggtgctgaaaaccgattcttctacaaattatgctctgcgtccagaattgcttcaagaagctgtttctcaggatcttgacgctggattgattccattcttcttatgtgctaatgttggaaccacttcttcaaccgcagttgatccattagctgcactgggaaagatcgctaacagaaatgagatgtggtttcacgtggatgcagcgtacgctggaagtgcttgtatatgtccagagtatcgacaatacattgacggtgtagaaactgcagactcttttaacatgaatgctcacaaatggttcctcactaatttcgattgttcccttctttgggttaaggatcaagattctcttacattagctctttcaacaaatccagagtttctcaaaaacaaggcctctcaggcaaacttggttgttgattacaaagattggcaaatccctctcggacgaagattcagatcattgaaactatggatggttttgaggctctatggatctgagaccttgaagagctatataagaaaccatatcaaactggctaaagaattcgaacaacttgtctctcaagatcctaacttcgagattgtcacacctcggatcttttctcttgtctgtttccgcctcgtgcctgtgaaaaacgaagaaaagaagtgtaataaccgaaaccgtgaactcctagacgcagtgaactcttccgggaaactcttcatttctcacactgctttgtcggggaaaatcgtactgcgttgcgcaataggagcgccattgacggaggagaagcacgtgaaggaggcgtggaaggttattcaggaagaagcctcttacttgcttcacaagtaaatatgataaaaagacaaaagaataaaacggtttttgccaagaaaccgaagcatttcggtttggtttggtttatttgatatgataatataataataaaacaaaaaattgctaaagtaagacttatcgacttcggtttgatttcggtacactttagtaaggtgatcttgtgtgatttgtgtgtattttctcctctctctctcttttttttttccaattgtgtgtattttatcaatttggtttgggtttattttgtggttaattaatgtaagcaatg

SEQ ID NO: 618 - DNA, 1927 bp, Brassica rapa
aaaccattcagaaccttttgataacacgaattcaaagatacgcaagaaagaatggaaaatggtagtaggaacgtgctgaagccgatggactctgagcaactgagggagtatggacatcgaatggttgatttcattgctgattattacaaaaccatcgaaactttccctgtccttagccaagttcagcctggttatcttcacaaccttttgcctgattcagcacctgaccaacctgaaacggtggaacaagttcttgatgatgttaagacgaagatattgcctggaataacgcattggcaaagccccaccttctatgcttattacccttctaacagcagcgttgcagggttcttgggtgagatgttgagtgctggtcttggaattgttggttttagttgggtcacttctccagctgccactgagctcgaaatgattgttcttgattggcttgcaaaactgctcaacctgcccgagcagtttctctccaaaggaaatggaggtggagtgatccaagggtcagccagtgaagctattcttgttgttatgattggtgctcgcgagaaggtcttaagacgcgttggtaagaacgcgcttgggaagctcgttgtgtactcctctgaccagacacattcagccctacagaaagcttgccagatagctggaatccatccagagaattgcagggtgctgaaggcagattcctctacaaattacgctttgcgtccagaattgcttcaagaagcagtttctaaggatattgaagctggactgattccgttcttcttatgtggcaatgttgggaccacttcttcaacagcagttgatccattagctgcactgggaaagatcgcaaagagcaatgagatttggtttcacgtggacgcagcgtacgctggaagtgcgtgtatatgtccagagtatagacagtacattgacggagtagaaactgcagactcttttaacatgaatgctcacaaatggttcctcactaattttgattgttccctactttgggtcaaggatcagtatgtgctcactgaagctctgtcaacaaatccagaatttctcaaaaacaaggcctctcaggcaaacttagttgttgattacaaagattggcagatccctctcggacgaagattcagatcattgaaactatggatggttttaaggctctatggagctgagaccctgaagagctatataagaaaccatatcaaactggctaaagatctcgaacaacttgtctctcaagatcctaactttgaggttgtgactcctcggatattttcactcgtctgtttccgtatcttacctgtggataacgatgaaaaggagtgtaataacagaaacagaaacctcctagacgcagtgaactcttctgggaaactgttcctttctcacactgctttgtcgggaaaaatagtactacgttgcgccataggagcgccactgacggaggagaggcacgtgaaggagacatggaaggttatccaggaagaagcttcacgcttgcttggcaagtaaataagaagaaaaacacttttatgataaaacctcatgtttttgccaacaaacctcactcatggtttggtttggtttaatttgatttgataatatacgaaataaaataaacataccgatgctggacagcctggagttgtgaacttcggtaaaggtactcttgtgtgattgtgtgcttttcttttaccaattgtgtgtattttatctccttttccaattgtgtgtatgtgttttggttttaacgtattgttgtggttaactatgtgtaaccaatgacaagcatattgtaaggctgtaagcatatgcatatacataaagaaatctattaatctttctatcaagtatatttctgttgtacaaacaaagcttagacaaaggaaaaaaagaaaagcatattgtaatattg

SEQ ID NO: 619 - DNA, 1855 bp, Eutrema halophilum
ttttttgtttttggttttttgttttcttatggaacagggaaaatggtaataagaacgtgttgaagccgatggactctgagcaactgagagagtacggacatcgaatggttgatttcattgccgactattacaaaaccatcgaagacttccctgttcttagccaagttcagcctggttatcttcataaccttctgcctgattccgcaccagaccaacctgaaacgcttgaagaagttcttgatgatgttaagggcaagatattgcccggagtaacgcattggcaaagcccgagtttctttgcttattacccttctaacagtagcgttgctggtttcttgggtgagatgttgagtgctggtcttggaatcgttggttttagttggatcacttctccagctgccaccgagctcgaaatgattgttcttgattggcttgccaagctactcaacctacccgagcagtttctctccagagggaatggaggaggggtaatccaagggtcagctagtgaagctgaacttgttgttctgattgctgcccgggacaaggttttaagaagcgttggcaagaaggcgcttgagaagctcgttgtctactcctctgaccagacacattcagctttacagaaagcttgccagattgctggaatccatccagagaattgcagggtgctcaaagcagattactctacaaattacgctctgcgtcctgaaacgcttcaagaagctgtttctaaggatcttgaagctggattgattccattcttcttatgtgctaatgttggaaccacttcttcaaccgcagttgatccattagctgcactgggagagatcgcaaagagcaatgagatgtggtttcacgtggatgcagcgtacgctggaagtgcctgtatatgtccagagtatcgacaatacattgacggagtagaaactgcagactcttttaacatgaatgctcacaaatggttcctcactaatttcgattgttcccttctttgggtcaaggatcagtatgctctcactgaagctcgttcaacaaatccagagtttctcaaaaacaaggcctctcaggcaaacttggttgttgattacaaagattggcaaatccctctcggaagaagatttagatcattgaagctatggatggttttacgactctatggatctgagaacttgaagagctatataagaaaccatatcaaactggctaaagatttcgaacaacttgtgtctgaagatcccaactttgagattgtcactcctcggatcttttctctcgtctgtttccgcatcgtgcctgcggaaaacgatgaaaagaagtgtaataaccaaaaccgcaacctcctagacgcagtgaactcttcagggaaactcttcctttctcacactgctttgtcgggaaaaattgtactacgttgcgccataggagcgccattgacggaagagaagcacgtgaaggaggcatggaaggttatccaggaagaagcatcatacttgcttcgcaagtaaacaagataaaaagaatttataataaaacctgtttttgccaacaaattaaccgaagcactggtttggtttggttttaatttggtttggtttaatttggtttgatataatcatataaaaataaataaaacctaccaaagctggactgatgaacttacatttgatttcggtaaggtaatcttgtgtgtattttttttttccctcccaattgtgtgtatttttttttcttcttttcccaattgtgtgttggtttggttttattttggttaatcatatgtaaccattgaaacaaacttaatgtaagcatatataaaaaaaaatctattacatctgatcaaatattttactat

SEQ ID NO: 620 - DNA, 1552 bp, Eutrema halophilum
tacttgttatgtaacagggaaaatggtagtagtaggaacgtgttaaagccgatggactctgagcaactgagagaatacggacatcgaatggtggatttcattgccgattattacaaaaccatcgaaaatttccctgttcttagccaagttcagcctggttaccttcataaccttttgcctgattccgcaccggaccaccctgaaacactggaacaagttcttgatgatgttaaggcaaagatattgccaggggtaacgcattggcaaagcccgagtttctttgcttattacccttcaaacagcagcgttgccgggttcttgggtgagatgttgagtgctggtcttggaatcgttggttttagttggatcacttctccagctgccaccgagcttgaaatgattgttcttgattggcttgccaaacttctcaacctacccgagcagtttctttccaaaggaaatggaggtggtgtaatccaagggtcagctagtgaagctcttcttgttgttctgattgctgctcgtgataagtttttacgaagatttggcaagaactcggttgagaagctcgttgtctactcctctgaccagacacattcatctttacagaaagcttgccagatatccggaatccatccagagaattgcagggtgctgaaaacattttcctcaacaaattacgctctgcctccagaattgcttcaagaaactatttctcgggatcttgaagctggattgatcccattcttcttatgtgctaatgttggaaccacttcttcaaccgcagttgatccattagctgcgttgggaaagatcgcaaagagaaatgagatgtggtttcacattgatgcagcgtacgctggaagtgcttgtatatgtccagagtaccgacaatacattgacggagtagaaagtgcagactcttttaacatgaatgctcacaaatggttcctcactaattttgattgttccctactttgggtgaaggataagtatgctctcactgaagctctttcaacaaatccagagtatctcaaaaacaaggcctctcaggcaaacttggttgttgattacaaagattggcaaatccctctcggacgaagattcagatcattgaaactatggatggttttaaggctttatggatctgagaccttgaagagctatataagaaaccatatcaaactggctaaagacttcgaacgacttgtgtctcaagatcctaactttgagattgtaactcctcggatcttttctctcgtatgtttccgcatcgtgccttcgaaaaacgatgaaaagaagtgtaataaccaaaaccgcaacctcctagacgctgtgaattcttcagggaaactcttcattactcacactgctctgtcgggaaaaattgtactacgttgcgccataggagcgccattgacggaggagaagcacgtgaaggaagcatggaaggttatccaggaagaagcatcatacttgcttcgcaaggaaaaaacttaaataagaaaaaaaaaagaaatttgcagtgtatagctatcaaaagaatcatatt

SEQ ID NO: 621 - DNA, 1940 bp, Brassica rapa
tattttggtatcctataataagaaatatctaggcttgctgaacccaaaccattcagatttcagaaagctcttgttcccgagacgtaaactacaaaagatggaaaatggtagtagcaacaaggcgttgaagccgatggactcggagcaactgagagagtacggacatcgaatggtcgatttcattgccgattattacaaaaccatcgagactttccctgtccttagccaagttcagcctggttatcttcataatcttttgcctgattcagcaccagaccaacctgaaaccctggaacaagttcttgacgatgtgaaggagaagatattgcctggagtaacgcactggcaaagccctagtttctttgcttattaccctgctaacagcagcgttgcagggttcttgggtgagatgttgagtgctgctctcaatattgttggttttagttgggtatcttctccagctgccactgagctcgagatgatcgttcttgattggtttgccaaacttctcaacctgccagagcagtttctatccagagggaatggtggtggagtcatccaagggacagctagtgaagctattcttgttgttatgattgctgcccgcgacaaggtcttaagaagccttggcaagaaggcgcttgagaagctcgttgtctactcctctgaccagacacattcttctttactgaaagcttgccagatagctggaatacatctagagaactgcagaatgctgaaaacagattcctctacaaattatgctctgcgtccagagtcgcttcaagaagctgtttctggggatcttgaagctggattgattccattcttcttatgtggcactgttggaacaacttcttcaacagcagttgatccactagctgaactgggaaagatcgcaaagagcaatgagatgtggtttcacgtggatgcagcgtacgctggaagtgcttgtatatgtccagagtataggcagtacattgacggagtagaaactgcagactcatttaacatgaatgctcataaatggttcctcaccaacttcgattgttcccttctttgggtgaaggatcggtatgctctcactgaagctctttcaacaaatccagagtttctcaaaaacaaggcttctcaagcaaacttggttgttgactacaaagattggcaaatccctctcggaagaagattcagatcattgaaactatggatggttttaaggctgtatggagctgagaccttgaagagctatataagaaaccatatcaaactggccaaagatctcgaacagcttgtctctcaagatcctaactttgaggttgtgactcctaggatcttttctctggtctgtttccgtatagcagctgttgataacgatgaaaaaacatgcaacaacctaaaccgcagcctcctagacgcagtgaactcttcggggaaactcttcatttctcacactaccttgtctggaaaattcgtactacgtttggccataggagcaccactgacggaggagaagcacgtgatggacgcatggaaggttatccaggaagaagcatctttcttgcttgcttctcaagtaaaataagttcaaaaaaaactttatgagaaaacctccggttcttgcaaacaaaccgaagcacactagtttggtgtgttataatttgatttgatatcatataaaatcatataccttatccaatgccggactcgtaatttgtaagcaagtttgtatattttgtttgattatttttttataagaggtaaatatatatatattaccaaatcaaaaattggatacaagagctatgtagccgaatgcttgtttggccaaagaaaacaaaaaccagtgagaagccatgttttgaatcatatacaaagagagattagcagctattactgaaccaaatagtcatttggcttgggcagtttatcaaaaccaaact

SEQ ID NO: 622 - DNA, 1858 bp, Brassica rapa
caagtaagagatctgcgccataccaatcaaaccctttgaggaagcttctgagacataaaacacggattcaaggccacgcaagaacaacataaaatggaaaatggtcgtagcaacaacgcgttgaagccgatggactcagagcaactgagagagtacggacatcgaatggtggatttcgttgctgattattacaaaaccatcgagactttccctgtccttagccaagttcagcctggttatcttcataatcttttgcctgagtcagccccagaccatcctgaaacggtggaacaagttcttgacgatgtcaaggcgaagatattgcctggagtaactcattggcaaagccctagtttctttgcttacttccctattaacggcagcattgcagggttcttgggtgagatgttgagtgctggtcttaatactatgagttttagttgggttgcttctccagctgcaactgagctcgaaattgtcgttgttgattgggttgcaaaactgctcaacctgccagagcagtttctatccaaaggaaatggaggtggagtaatccaagggtcagcttgtgaagctattctcgttgttatgattgctgcccgcgataaggtcttaagaagcgttggtaagaaagcacttgagaagcttgttgtctactcctctgaccagacacattcatctttacagaaagcttgccagctagccggtatccatctagagaattgcagggtcctgaaaacagattcatctacaaattacgctctgcgccctgaatcgcttcaagaagctgtttctaaggatcttgaagctggattgattccattcttcttatgtggcactgttggaacaacttcttcaacagcagttgatccactagcagcactgggaaagattgcaaagagcaatgagatgtggtttcacatcgatgcagcgtatgctggaagtgcttgtatatgtccagagtatagacagtacattgacggagtagaaactgcagactcttttgacatgaatgctcacaaatggttgctcactaatttcgagtgttccctactttgggtgaaggatcaatctgctctcactgaagctctttcaacaaatccagagtatctcaaaaacaaagcatctcaggcaaacttggttgttgattacaaagattggcaaatccctcttggacgacgattcaggtcactgaaactatggatggttttacggctctatggagctgagaaccttaagagctatataagaaaccatatcaaactggctaaaatattcgaacaacttgtctccaaagatcctaactttgaggttgtgactcctaggatcttttctctggtctgtttccgtatagcggctgttgataacgatgaaaagaagtgcaacaacctaaaccgcagcctcctagacgcagtgaactcttcaggaaaactcttattttctcacactatattatcggaaaaattcgtactacgtttcgccataggagcgccattgacggaggagaagcacgtgaaggaggcatggaaggttatccaggaagaagcatcattcttgctttccaaataaaataagttcaaaagaactttatgagaaaacctcctatatatccttgccaacaaagtgacaaaccgaagcactagtttggtttgatttaatttgaacttcggtttggtctccgaaagtatttactattttgtgtgattgtgtgcattttcttttccaatagagtgtatcttatctccttttcccagttgtgtgttttatctatttggtttggttttgttgtgattagctatatatgtgttcctaatgacaacaaacttgttctaagcatatataaatatcaatctataaa

SEQ ID NO: 623 - DNA, 1707 bp, Raphanus sativus
acactttgaggaagcttctgaaacaggaattcaaagcgacgcaagaagaacataaaatggaaaatggtagtagcaacaacgcgttgaagccgatggactctgagcaactgagggagtacggacataaaatggtcgatttcattgctgattattacaaaactatcgagactttccctgtccttagccaagttcagcctggttatcttcaaaatcttttgcctgagtcagcaccagaccaccctgaaacggtggaacaagttctggacgatgtaaaggcgaagatattgcctggaataacgcattggcaaagccctagcttctttgcttatttccctattaacggcagcgttgcagggttcttgggtgagatgttgacagctggtcttaatactatgagtttcagttgggttgcttctccagctgcaactgagctcgaaattatcgttcttgattggtttgcaaaactgctcaacctgccagagcagtttcaatccaaaggaaatggaggtggagttatccaagggacagctagtgaagctattctcgttgttatgattgctgcccgcgataaggtcttaagaagagttggtaagaaagcacttgaaaagcttgttgtctactcctctgaccagacacattcatctttacagaaagcttgtcagatagcaggaatacatctagagaattgcagagttctgaaaacagatccatctacaaattacgctctgcatccagaatcacttcaagaagctgtttctcaggatcttgaagctggattgattccattcttcttatgtggcactgttggaaccacttcttcaacagcagttgatccactagcagcactgggagagatagcaaagagcaatgagatgtggtttcacgtggatgcagcgtatgctggaagtgcttgtatatgtccagagtatagacagcacattgacggtgtagaaactgcagactcttttaacatgaatgctcacaaatggttgctcactaacttcgattgttccctactttgggtgaaggatcagtatgctctcactgaagctctttcaacaaatccagagtttctcaaaaacaaggcgtctcaggcaaacttggttgttgactacaaagattggcaaatacctctcggaagaagattcaggtcattgaaactatggatggttttaaggctctatggagctgagaccttgaagaactatattagaaaccatatcaaactggctaaagatttcgaacaacttgtctctcaagatcctaactttgaggttgtcactcctaggatcttttctctggtctgttttcgtatcgcgcctgtggataacgatgaaaagacatgcaacaacctaaaccgcaacctcctagaggcattgaactcttcagggaaactcttcatttctcacactatcttgtcgggaaaattcgtactacgtgtcgccataggagcgccattgactgaggagaagcacgtgatggaggcatggaaggttatccaggaagaagcatcaaacatacttgcttctcaagtaaactaagctaagaaaagctttatgagaaaaaacctcctgttcttaccaacaaaccgaagcacttgtttcgtttggtttaatttgatttgatatcattataaaatcatactagagattgatctatcccgggcagaaatttttatcttttttaaaattgatattttattttcca

SEQ ID NO: 624 - DNA, 1833 bp, Eutrema parvulum
ttcttgaaagtttgggaaatcccattttgtgatttgtaatttttgttttgaattgtattttctcttacggaacagggaaaatggtggaagtaggaacgtgttgaagccgatggactctgagcaactgagagagtacggacatcgaatggtcgatttcattgccgattattacaaaaccatcgagagtttccctgttcttagccaagttcagcctggttatcttcacaaccttttgcctgattcagcaccagaccaccctgaaacgctggaacaagttctcgatgatgttaaggccaagatattgcctggagtaacgcattggcaaagccccagtttctttgcttattacccttctaacagcagtgtcgccgggttcttgggtgagatgttgagtgctggtctcggaatcgttggttttagttgggttacttctcctgctgccaccgagctcgaaatgatcgttcttgattggcttgcaaagctactcaacctacccgagcagtttctctccaaaggaaatggaggtggagtcatccaaggttcggctagtgaagctattcttgttgttatgattgctgcccgcgataaggtcttaagaagcgttggcaagaacgcccttgagaagctcgttgtctactcctctgaccagacacattcagctttacagaaagcttgccagatatccggaatccatccagagaattgcagggttctgaaagctgattcttctacgaattacgctctgcgtccagaattgcttcaaaaagctgtttctcaggatcttgaagctggattgattccattctttttatgtgctaatgttggaacaacttcttcgaccgcagttgatccattagctgcactaggaaagatcgcacagagcaatgagatgtggtttcacgtggatgccgcgtacgctggaagtgcttgtatatgtccagagtatcgacagtacattgacggggtagaaactgcagactcttttaacatgaatgctcacaaatggttcctcactaatttcgattgttccctactttgggtgaaggatcagtatgctctcactgaagctctttcaacaaatccagagtttctgaaaaacaaggcctctcaggcaaacttggttgttgattacaaagattggcagatccctctcggacgaagattcagatcattgaaactatggatggttttacggctctacggagctgagagcttgaagagctatataagaaaccatatcaaactggctaatgatttcgaacaacttgtgtctcaagatcctaactttgagattgtcactcctcggatcttttccctcgtctgtttccgcatagtgcctgcggaaaacgatgaaaagaagtgtaataaccgaaaccgcagcctcctagacgcagtgaactcttcagggaaactcttcatttctcacactgtaagctctgtctggaaaaatcgtactacgttgcgccataggagcaccattgacagaggagaagcacgtgaaggaggcatggaaggttatccaggacgaagcatcatacttgcttcgcaagtaaacaagataaaaaaagaaaagactatatgataaaacctgtttttgccaacaaaccgaagcactggtttggtttggtttaatttgatataatataattatataaaagaaaataaaggataaacttaccaaagctggacttgtgaacttcggtaagctaatcttgtgtgattgtgtatatttttatttttctcccaattgtgtgtattttatctatttggtttggtttggtttggttttgttgtggtcaactatatgtaaccagtgacactaaacttatctat

SEQ ID NO: 625 - DNA, 1416 bp, Brassica rapa
atggactctgagcaactgagagagtacggacatcgaatggttgatttcattgctgattattacaaaaccatcgaaactttccctgtccgtagccaagttcagcctggttatcttcataaccttttgcctgattcagcaccagaccaccctgaaacgctggaacaagttcttgatgatgttaaggtgaagatattgcctggagtaacgcattggcaaagccctagtttctttgcttattacccttctaacagcagcgttgcagggttcttgggagagatgttgagtactggtcttaatgttattggttttagttgggtagcttctccagctgccactgagctcgaaataatcgttcttgattggcttgcaaaactgctcaacctacccgaacagtttctctccaaaggaaaaggaggtggagtcatccaagggtcagctagtgaagctattcttgttgttatgattgctgctcgagataaggtcttaagaactgctggcaagaacgcgcttgggaagcttgttgtctactcctctgaccagacacattcagctttacaaaaagcttgccaagtgaaggtgctgaaggcagatacctctacaaactttgctctgcgtccagaattgcttcaagaagccgtttctctggatcttgaagctggattgtttcctttcttcttgtgtggcaatgttggaaccacttcttcaaccgcagttgatccattagccgatctgggaaagattgcaaagagcaatgagatgtggtttcatgtggatgcagcgtacgctgggaatgcatgcatatgtccagagtatagacagtacatagacggagtagaaactgcagactcatttaacatgaatgcttacaaagggctcctcacaaacttcgactgttccctactctgggtgaaggatcagtatgctgtcactgaagccttttcagcaaatccagagtatctcaaaaacaaggcctctgaggcaaacttggttgttgattacaaagattggcaaatcgctctctcgcgaagattcagatcattgaaactatggatggttttaaggctctacggagctgagactttgaagagctatataagaaaccatatcaaactggctaaagttttcgaacaactcgtctctcaagatcctaactttgacgttatcactcctcggatattttccctcgtctgcttccgtatggttcctattgatgacgacgaaaagaagtgtaatagtcgaaacctcgagctcctagaggcagtgaattcctcagggaaactcttcatttctcacactgctttgtcgggaaaaatggttctacgtttttccataggagcgccattgacagagcagaagcacgtgaaggaggcatggaaggttatccgggaggaagcttcatacttgcttggcaagtaa

SEQ ID NO: 626 - DNA, 2534 bp, Arabidopsis lyrata
aaagactcaaaacccattttcctaaaaccctcgtccctacaaagccatggcgaggtttccgaattctccggcgcctaacctcctcttgaggctcttctcgtcaaacaaacggtcttcatctcctactgccgcgcttttaaccggagattttcagctgattcgtcatttctccgccggaaccgctgctcgtgcggccaaggatgacaaggaaccctggtggaaagaatccatggacaagcttcgcaacatcgggatctcagctcatatagactctgggaagactacgttgactgagcgtgttctgttctatacgggtcggatccatgagatccacgaagtcagaggtagagatggcgtcggcgctaaaatggactccatggacttggagcgagagaaaggtatcaccatccaatcagccgctacttactgtacttggaaggattacaaggttaatataattgatactcctggtcacgttgacttcaccattgaagtggagagggctttacgtgtactagacggtgcgattctagttctgtgcagtgttggtggtgtacagagtcagtctattacagtagataggcaaatgaggagatatgaagtcccgagagttgcgtttattaacaagcttgataggatgggagcagatccatggaaagttttgaaccaagcaagagctaagcttcgacatcatagtgcagctgtgcaagtgcccattggtttagaagaaaatttccagggtcttgtagaccttattcatgtgaaagcttatttctttcatggatctagcggcgagaatgttgtggctggtgatattcctgctgatatggaaggtttggttgcggagaagaggcgagaattgatagagacagtctctgaagttgatgatgtactcgccgagaaatttctgaatgatgaacctgtatctgctgctgagcttgaggaagctattcgaagagctaccatagcacaaaagtttgttcctgtatttatgggtagtgcattcaaaaacaagggagtacaacctctgctagatggtgttgtcagttatctcccttctccaaatgaagtcaataactatgctcttgaccaaatgaataatgaagagagggtaactttgactggatctccagatggacctcttgtggcgctggctttcaaattagaggagggtcgttttggtcagctgacatatttgagagtttatgaaggtgtgattaagaagggtgattttatcataaatgtcaatactgggaagagaattaaggttccacgcttggtccgtatgcattcgaatgatatggaggatattcaagaggcacacgctggacaaatcgtagctgtgtttggtattgagtgtgcatcaggtgatacatttacggatggatcagtcaagtacacaatgacatcgatgaacgttcctgaacctgttatgtccttagctgttcaaccggtttcaaaagattctggaggacagttctcgaaagcactgaatcgattccagaaagaggatcctactttccgggtgggattggatcccgagagtggccagacgattatttctggtatgggggaattgcatttggacatctatgttgaacgcatgcgaagagaatataaggttgatgcgactgtgggcaaaccccgtgtcaattttagggagactattactcaacgggcggagtttgattatttacataagaagcaaagtggaggagctggtcaatacggtagggttacagggtacgtggaaccgctaccaccaggctctaaagagaagtttgaatttgaaaacatgattgttggacaagcaattccgtctggttttattccagcaattgagaaaggtttcaaagaagctgcaaactcgggctcactaattggtcaccctgtagagaatctcagaatagtattgacagatggagcttcacacgcggtagattccagtgaacttgcatttaaaatggctgcaatatacgcattcagactgtgttacacagcagctagaccggtgattctagaacctgttatgcttgttgagttgaaagtaccaacagagtttcagggcactgttgctggtgacatcaacaagaggaaaggtataatcgttggaaacgatcaagagggtgacgattcagtaatcactgctaatgtgcctttgaacaacatgtttggctactccacttctctccggtccatgacacaaggcaaaggagaattcacgatggaatacaaagaacattctgctgtatccaatgaagtccaagctcagctcgtcaatgcttacagcgccagcaaagcaactgaataagcaagcccttgaatcgaatattatggtttgttttctcataatgttgaattacaacattatttatacggttctcaaccaacaaaatcacccaacataaaatgcctaatgggctctgtcagaaaatcacttatgtttattgggccattaggtaggtcattttttggtatatttccaccagtcccaatcattttgataatggtaaaccagcaaatatttttctctt

SEQ ID NO: 627 - DNA, 2588 bp, Arabidopsis thaliana
ttgggtataatcttgatcagtaatttaaaccgttgcagactagggtgttgttgaaccggatttttcctttgctgggggaatcaactatacaaacaaaaaacccattttcctaaaaccctcgtcgtccctacaaagcctatggcgaggtttccgacttctccggcgcctaaccgcctcttgaggctcttctcttccaacaaacggtcgtcatctcctactgccgcgcttttaaccggagattttcagctgattcgtcatttctccgccggaaccgctgctcgtgttgccaaggatgagaaggaaccatggtggaaagaatccatggacaagcttcgcaacatcgggatctcagctcatatagactctggaaagactacgttgactgaacgtgttctcttctataccggtcggatccatgagatccacgaagtcagaggtagagatggcgtcggcgctaaaatggattccatggacttagaacgagagaaaggtatcaccatccaatcagccgctacctactgtacttggaaggattacaaggttaatataattgatactcctggtcatgttgacttcaccattgaagtggagagggctttacgtgtactagacggtgcgattctagtcctgtgcagtgttggtggtgtacagagtcagtctattacggttgataggcaaatgaggagatatgaagtcccgagagttgcgtttattaacaagcttgataggatgggagcagatccatggaaagtcttgaaccaagcaagagctaagcttcgacatcatagtgcagctgtgcaagtgcccattggtctagaagaaaattttcagggtcttatagaccttattcatgtcaaagcttatttctttcatggatcaagcggtgagaatgttgtggctggtgatattcctgctgatatggaaggtttggttgcggagaagaggcgagaattgatagagacagtctctgaagttgatgatgtactcgccgagaaatttctgaatgatgaacctgtatctgcttctgagcttgaggaagctattcgtagagctaccatagcacaaacgtttgttcctgtatttatgggtagtgcattcaaaaacaagggagtacaacctctactagatggtgttgtcagttttctcccttctccaaatgaagtcaataactatgctcttgaccagaataataatgaagagagggtcaccttgactggatctccagatggacctcttgtggcgctggctttcaaattagaggagggtcgttttggtcaactgacatatttgagagtttacgaaggtgtgattaagaaaggtgattttatcataaatgtcaacactgggaagagaattaaggttccacgcttggtccgtatgcattcaaatgatatggaggatattcaagaggcacatgctggacaaatcgtagctgtgtttggtattgagtgtgcatcaggtgatacatttacggatggatcagtcaagtacacgatgacatcgatgaacgttcctgaacctgttatgtccttagctgttcaaccggtttcaaaagattctggaggacagttctcgaaagcactgaatcgattccagaaagaggatcctactttccgtgtgggtttggatcccgagagtggccagacgattatttctggtatgggggaattgcatttggacatctatgttgaacgcatgcggagagaatataaggttgatgcgactgtgggcaaaccccgtgtcaattttagggagactattacccagcgcgctgagtttgattatttacataagaagcaaagtggaggagctggtcaatacggtagagttacagggtacgtggaaccgctaccaccaggctctaaagagaaatttgagtttgaaaacatgattgttggacaagcaattccgtcgggttttattccagcaattgagaaaggtttcaaagaagctgcaaactcgggctcactaattggtcaccctgtagaaaatctcagaatagtattgacagatggaacttcacacgctgtagattccagtgaacttgcgtttaaaatggctgcaatatacgcattcagactgtgttacacagcagctagaccggtgattctagaacctgttatgctggttgagttgaaagtaccaacagagtttcagggcactgttgctggtgacatcaacaagaggaaaggtataatcgttggaaacgatcaagagggtgacgattcagtaatcactgctaatgtgcctttgaacaacatgtttggctactccacttctctccggtccatgacacaaggcaaaggagaattcacgatggaatacaaagaacattctgctgtgtccaatgaagtccaggctcagctcgtcaatgcttacagcgccagcaaagctactgaataaacaagccattgaatcaaaatattatggtttgttttctcataatgttcatttacaacatttatttatacggttcacaaccaacaaaatcactcaacataaaaatgcgtgatgggctatgtcagaaaatcacttatgtttactgggccattatggtcactcatcataatagtggaacgattagctgt

SEQ ID NO: 628 - DNA, 2492 bp, Eutrema halophilum
aaaaagctcactgaaacccatttcataaaagtctaaaaccctcgttcctagaaagatatggcgaggtttccgtcatctccgacgcctaacctcctcttgaggctcttctcctctaacaaacgatcatcatctccgactgccgcgcttctagccggagatttccagcttcgccaattctccgccggcagcgctgcccgtgcggccaaggacgacaaggaaccatggtggaaggaatctatgaacaagcttcgcaacatcgggatctcagctcacatagactcgggcaagactacgcttaccgagcgtgttctcttctacacgggtcggatccatgagatccacgaagtcagaggcagagacggcgtcggcgctaagatggactccatggacttagagcgagagaaaggtatcaccatccaatccgccgccacctactgtacttggaaggattacaaggttaatattatcgacactcctggtcacgttgacttcacaattgaagtggagagagctttacgtgtattagatggtgcgatcctggtcctatgcagtgttggtggtgtgcagagtcagtctattacagtggataggcaaatgaggagatacgaggtcccgagagttgcctttatcaacaagcttgatagaatgggagcagatccatggaaagtcttgaaccaagcaagagccaagctccgacatcatagtgcagctgtgcaagtgccgattggtcttgaagaacatttcaagggtcttattgacctcatacatgttaaagcttatttcttccatggatcaagcggtgagaatgttgtggctggtgatattcctgcagatatggaagatttggttggcgagaaaaggcgagaactgatagagatagtctctgaagttgatgacgttctcgctgagaaatttcttaatgatgaacctgtttctgctgctgagcttgaggaagctattcgcagagctaccattgcacaaaagtttgttcctgtatttatgggtagtgctttcaaaaacaagggagtacaacctctactagatggtgttcttagttatctcccttgtccaactgaagtcaataactatgctcttgaccagaacaacaatgaagagagggtaacattgactgggtctccagatggacctcttgtggcattggcttttaaattagaggagggacgttttggtcagctgacatatctaagagtatacgaaggtgtgattaagaagggtgaatttatcataaatgttaatactggaaagagattaaaggttccacgattggtccgtatgcattctaatgatatggaagatattcaagaggcacacgctggagaaattgtagctgtctttggggtcgagtgtgcatcaggtgatacatttacggatggatcagtcaagtacacaatgacatctatgagtgttcctgaacctgttatgtcattggcggttcaacccgtttcaaaagattctggtggacagttctcaaaagcattgaatcgattccagaaagaggatcctactttcagagtgggtttggatcccgagagtggccagacgattatttccggtatgggggaattgcatttggacatttatgttgaacgcatgcgaagagaatataaggtagatgcgacggttggaaaaccccgtgtcaattttagagagacgattactcaacgggctgagtttgattatttacataagaagcaaagtggaggagcgggtcagtacggcagggtcaccgggtatgtggaaccactaccgccggattctaaagaaaagtttgaattcgaaaacatgattgttggacaagcgattccgtctggctttattccagcaattgagaaaggtttcaaagaagctgcaaactcgggctcactaattggtcaccctgtagagaatctcagaatagtattgacagatggagcttcacatgcagtagattccagtgaacttgcgtttaaaatggctgcaatatacgcgttcagactttgttactcagcggctagaccggtcattttagagcctgtcatgttggttgagttgaaagtaccaacagagtttcagggtactgttgctggcgacatcaacaagaggaaaggtataatcgttggaaacgatcaagagggtgacgattccgtaatccaagctcatgtgcctttgaacaacatgtttggctactccacctcactccgctccatgacacagggaaaaggagaattcacgatggaatacaaagaacactgcgctgtgtctaacgatgtccagactcagctcgtcaacgcctacaccgccagcaaagctactgattaattaatccctttcaatcgatattatggtttatcatcttaatcaatttgtcttttcataatccaacaattatttatacggttcacacaaggaacaaattcactcagtgcctaatgggctttatagaaaatctatttcaaggttatttgggccatgagcccttcaacctctattta

SEQ ID NO: 629 - DNA, 2568 bp, Eutrema parvulum
aaaaagctcactcaaacccatttcctaaaaccctcgttcctacaaagctatggcgaggtttccgtcatctgcgtcgcctaacctcctcttcaggctcttctcgtctaacaaacggtcgtcatctccgactaccgcgctactagccggagatttccagctgcgccaattctccgccggaagcgccgcccatgcggcgaaaggcgagaaggaaccatggtggaaggaatcgatgaacaaggttcgcaacatcgggatctcagctcacatagactcagggaagactacactgaccgagcgtgttctcttctacacgggtcggatccatgagatccacgaagtcagaggcagagacggcgtcggcgcgaaaatggactccatggacttagagcgagagaaaggtatcaccatccaatccgccgccacctactgtacttggaaggattacaaggttaatattattgatactcctggtcacgttgacttcaccattgaagtggagcgggctttacgtgtactagatggtgcgattcttgtcctatgcagtgttggtggtgtgcagagtcagtctattacagtcgacaggcaaatgaggagatacgaagtcccgagagtcgcgtttatcaacaagcttgatagaatgggagcagatccatggaaagtcttgagccaagcaagagcgaagctcagacatcatagtgcggctatgcaagtgccgatgggtctagaagaaaatttcaagggtcttattgaccttgtgcatgtgaaagcttatttcttccacggatcaagcggtgagaatgttgtgcctggtgatattcctgctgatatggaagagttggttgcagagaagaggcgagaattgatagagacagtctctgaagttgatgacgtactcgctgagaaatttctaaatgatgagcctgtatctgctgctgagcttgaggaagctatacgtagagctaccattgcacaaaagtttgtacctgtatttatgggtagtgcattcaaaaacaagggagtacaacctctactagatggtgttcttagctaccttccttgtccaactgaagtcaataactatgctcttgaccagaagaacgatgaagagagggtaaccttgaccgggtctccagatggacctcttgtggctctggcttttaaactagaggagggacgttttggtcagctgacatatctaagagtatatgaaggtgtgattaagaagggtgattttatcataaatgttaatactggaaagaggataaaggttccacgcttggtccgtatgcattctaatgatatggaggatattcaagaggcacacgctggagaaatcgtagctgtgtttggtgttgagtgtgcatcaggtgatacatttacggatggatcagtcaagtacacaatgacgtcgatgagtgttcctgaacctgttatgtccttggctgttcaaccagtttcaaaagattcgggtggacagttctcgaaagcattgaaccgattccagaaagaagatcctactttcagagtgggattggatcccgagagtggccagactattatttctggtatgggggaattgcatttggacatttatgttgaacgcatgcggagagaatataaggttgatgcgactgttggcaaaccccgtgtcaattttagggagactattactcagcgggctgagttcgattatctacacaagaagcaaagtggaggagcgggtcagtacggtagggttaccgggtacgtggaaccgctaccggcagactcaaaagagaagtttgaattcgaaaacatgattgttggacaagcgattccttctggttttatcccagcaattgagaaaggtttcaaagaagctgcaaactcgggctcactaattggtcatcctgttgagaatattcggatagtactgacagatggagcttcacacgccgtagattccagtgaacttgcttttaaaatggctgcaatatacgcgttcagactgtgttacacagcggctagaccggtgattctagagcctgtcatgttggttgagttgaaagtaccaacagagtttcagggtactgttgctggtgacatcaacaagaggaaaggtataatcgttggaaacgatcaagagggtgacgattcagtaatccaagctcatgtgcctttgaacaacatgtttggctattccacctctctccgctccatgacacagggaaaaggagaattcactatggaatacaaagaacactgtgctgtgtctaacgaagtccagactcagctcgtcaacgcccacaacgccagcaaagcaactgattagttccttcaatcgatatttatggtttgtgatcttaatcaaatgattttttttttcataatccaacatttatttatacgattcatacagggaacaaaatcactcagcttaaaaagcttaatgggctttgtcgaaaatctatttcgagattactgggccttgagcccttcaacctttttctgaatatattaatcccaattggttcacgagtcaaaaccaatttggtaagcaaattgtaatccagtttttggatttttctt

SEQ ID NO: 630 - DNA, 2592 bp, Brassica rapa
aaaaaacctcactcaacccccattttctaaaaccctcgttcctcccaccaaaagcaatgccgaggtttcccccatctccgtcgcccaacctcctccagagactcttctcctcctccaacaaacgctcctcatcctcccccaccgccgcgctcctctccggagacttccacctccgccaattctcctccggaaacgccgcccgcgccgcgaaaggcgagaaggagccatggtggaaggaatcgatgaacaaggtccgcaacatcgggatctcagctcacatagactcggggaaaaccacgctcaccgagcgcgtgctgttctacacggggcggatccacgagatccacgaagtcagagggagagacggcgtcggcgctaagatggactccatggacttggagcgtgagaaaggtatcaccatccaatccgccgccacgtactgcacctggaaggattacaaggttaatatcattgacactcctggtcacgttgacttcacaattgaagtggagagagcgttacgtgtactagacggagcgatcttggttctatgcagtgttggtggtgtgcagagtcagtctattactgttgacaggcaaatgaggaggtacgaggttccgagagtggcgtttatcaacaagcttgatagaatgggagctgatccatggaaagtgctgagccaagcaagagctaagctcaggcatcatagtgcagctgtgcaaatgcctattggtctagaagaaaattttaagggtcttattgaccttgtgcatgtgaaagctcttttcttccatggatccagcggtgagaatgttgtggctggtgatattcctgctgatatggaagagttggttgcggagaagaggagagaattgatagagacagtctctgaagttgatgatgtgctcgctgagaagtttctaaatgatgagcctgttactgctgctgagcttgaggaagctattcgcagagctaccattgcacaaaagtttgttcctgtatttatgggcagtgcattcaaaaacaagggagtacaacctctactagatggtgttgttagctatcttccttgtccaactgaagtcaataactatgctcttgaccaggataatgaagaagcgaaggtaaccttgaccggttctccagatggacctcttgttgcgctggcttttaaactagaggagggacgttttggtcagctaacatatcttagaatatacgaaggagtgattaagaagggtgattttatcataaatgttaatactaaaaagagaataaaggttccacgcttggtccgtatgcattctaatgatatggaggatattcaagaggcacatgctggagaaatcgtagctgtgtttggtattgactgtgcatcaggtcatacatttacagatggatcagtcaagtacacaatgacatcgatgagtgttcctgaacctgttatgtccttggctgttcaaccagtttcaaaagattcgggtggacagttctcgaaagcattgcaacgattccagaaagaggatcccactttcagagtgggattggatcccgacagtaaccagacgattatttctggtatgggggaattgcatttggatatttatgttgaacgtatgcgcagagaatataaggttgatgcgactgttggcaagcctcgtgtcaactttagggagactatcactcagcgagctgagttcgattatctacacaagaagcaaagtggaggagcgggtcagtacggtagagttaccgggtatgtggaacctctaccatctgactctaaagagaagtttgagttcgaaaacatgattgttggacaagcgattccgtctggttttataccagcaatcgagaaaggtttcaaagaagctgcaaactcgggttcactaattggtcatccggtagagaatattcggatagtattgacagacggagcttcacacgcagtagattccagtgaacttgcgtttaaaatggctgcaatatacgcgttcagactgtgttacacagcggctaaaccggtgattctagagcctgtcatgttggttgagttgaaagtaccaacagagtttcagggcactgttgctggtgacctcaacaagaggaaaggtataatcgttggaaacgatcaggagggtgatgattcagtaatccaagctcatgtgcctttgaacaacatgtttggctattccacatctcttcgctccatgacacagggaaaaggagaatttacgatggaatacaaagaacactctgctgtgtcaaacgatgtccaaactcagctcgtcaacgcccacaacgccaccaaaccaactgattagttcctccgatcgatacctatggttttgtcatcttttaatcgatgatttgttttgtgttttttcatagctcaacattatttatacggttccttcatacagggaactaaatcactcagcataaaatgttagttcttgataggctttgtcaaaaaagtctatttcaagattactgggccatgagcccttcaacctttttaatattaatcccatctcttggtccaccagtgacatccattttggtaattgtaatgtttaaatggctcttcct

SEQ ID NO: 631 - DNA, 2864 bp, Theobroma cacao
aaatcaaaatttttattttctattttttaatggcccacccaaataagtcacttatataaacagattttggatcatttgccattattatccatgggctcatggtaaatgcacaaatgtcaagtgggtctagactccagaggcaagatccaaattacctgacccattagagaacacgaatccgaattcttcccgaccctaacccgatccattttcaactccaaattctcccattttttgaaatcaaaattcaaaaccccaagaaaaaccattaccttgggtttagggttttacccgcaccaggcaccatcagctgcacagctattccgccatggcgcgattcccgagatccccagtccagcgcctgctttacaccttctactccgccaaaacgacgccgtcgtcttccccgtcccagaccgccgccttgctcctcgggaacttcgagatccgtcatttctcagcgggcaacgtcgcgcgagcaaaggacgacaaagaaccatggtggaaagagtccatggaacgactccgaaacatcggaatctcggcccacatcgactcgggcaaaaccacgctaacggagcgggttctctattatacgggccggatccacgagatccacgaggttcgtggcaaggatggcgtcggagcaaagatggattctatggatttagaaagagagaaaggaattactatccagtctgctgccacgtattgcacctggaaagattacaagattaatataatcgatacgcccggtcacgttgattttacgatagaagtggagagggcgctgcgtgttcttgatggtgccattctagttctgtgcagtgttggtggggtacaaagtcagtcaattactgttgatcgacaaatgagaagatacgaggttccgagacttgcttttattaacaagcttgatcgaatgggagctgatccatggaaagttctcaaccaggcgaggtctaagcttcgacatcatagtgcagctgtgcaagttccaattggcctggaagaaaattttcagggtcttatcgaccttgtgcaattaaaagcttattattttcatggttccaatggagaaaaggttgttgctgaagaaataccagctgacatggaggccatagtcgcagaaaagagacgtgaactgatagaaatggtttctgaagtggatgataaactggcggaagcttttctaaatgatgagcctatttcatctgctgatcttgaggacgcaattcgtagggcaacgatagcacggaagtttgtacctgtattcatgggtagtgcattcaaaaacaagggtgtacaaccacttttggatggtgtccttagttacttgccatgtccagttgaagtcagtaactatgctcttgatcaaacaaagaatgaagagaaggttacgttgtctggaaccccagatggaccacttgtagcattagcttttaagttggaggaagggcggtttggtcagctaacatatctcagagtctacgagggtgtgatccgaaagggtgattttatagtgaacataaacacaggcaagaagattaaggtacctcgcctggttcggatgcattctgatgaaatggaggacattcaagaggcacatgctgggcaaatagttgcagtttttggtgtagactgtgcttcaggagatacatttactaatgggtctgtcaaatacaccatgacttctatgaatgtccctgagccagtgatgtcattagctgttcagccggtttccaaagattctggaggacaattttcgaaggcattaaatcgttttcagaaagaggatccgacattccgtgtgggcctggatgctgaaagtgggcagacaattatctctggaatgggagagcttcatttggacatatatgtggaacggatccggagagaatacaaggttgatgcaactgtcggaaggcctcgggtgaatttcagggagactataactcaacgtgctgaatttgattatttgcataagaagcaatctggaggacagggtcaatatggacgagtatgtgggtatgttgaaccacttccaccagggtctccaattaaattcgaatttgagaacatgattgttggacaagctataccatcaaattttattcctgcaattgagaagggtttcaaagaagctgcaaattcgggttcattaattgggcatccagttgaaaatatccggattgttttaactgatggtgcttctcacgcagtagattccagtgagcttgcatttaagttagctgctatatatgctttcagacaatgttatactgctgcaaggcctgtgatactggaacctattatgttggttgagttgaaagtaccaacagaatttcagggtacagtagctggtgatattaacaagaggaaaggtgttattgttggaaatgatcaagatggagatgattctatcattaccaccaatgtcccgttgaacaatatgtttggatactcgacagcacttcgatcaatgacacagggtaaaggggaattcacaatggaatacaaggagcacttaccagtgtctcaggacgtgcaaatgcaattagtgaacactcacaaggccagtaaagcagcggaataatcagagggaatggctgaagaactagccacaagcccttatagtctttttgcaagccagccatataatttgttgtgatattcatttttgctatatttatttaggctatatggtccatcatatagtgataaaaaattttggaagcacaataagtttaaaccgtcatttctaggccaacataatatttcatcagtaattatatagggacctagcaagtttttattataacatttgacataattgtcttcagcattaaaatagatattcattg

SEQ ID NO: 632 - DNA, 2909 bp, Gossypium hirsutum
accaagcagcactacccatattccaccatggcgcgattccaaagatccgcagtcccgcgcctcctttacaccttgtactccaccaaagcggcgccctactgttccccctccccgaccgccgccctcctcctggggaacttcgaggtccgtcatttcgctgctggcaacgtcgcgcgagcaaaggacgacaaagaaccatggtggaaagagtccatggaacgactccgaaacatcggaatctccgctcacatcgactcgggaaagaccacactgacagagcgggttctctattataccggccggatccacgagatccacgaggttcgcgggaaagacggcgtcggagcaaagatggattccatggatttagaaagagagaaaggaattactatccaatctgctgccacgtattgcacctggaaagattaccagattaatataatcgatacgcctggtcacgttgattttacgattgaagtcgagagggcgctgcgtgttcttgacggtgccattttagttctgtgtagcgttggtggtgtacaaagtcagtcaattactgttgatcggcaaatgagaagatacgaggtgccaagactcgcatttattaacaagctcgatcgaatgggagctgatccatggaaagttctcaaccaggcaaggtctaagcttcggcatcatactgcggctgtgcaagttccaattggtttggaagaaaactttaagggacttatcgaccttgtgcagctaaaagcttattattttcatggttccagcggagaaaaagttgtgtctgagggtataccagcagatatggaagccatagttgcagaaaagagacgtgaactaatagaagtagtttctgaagtggatgataaactagctgaagcatttctaaatgatgagcctatttcccctgctgatcttgaggaagcagttcgtagggcaaccatagcacggaagtttgttcctgtattcatgggtagtgcattcaaaaacaagggtgtacaaccgcttttagatggtgtccttagttacttgccatgtccaattgaagtcagtaactatgctcttgatcaaacaaagaatgaagaaaaggtaatgttgcctggaaccccagatggaccacttgtagcattagcttttaagttggaggaagggcggtttggtcagctaacatatctgagagtctacgagggtgtggttcggaagggtgattttatagtcaatgtaaatacaggaaagaagattaaggtgcctcgtttggttcggatgcattctaatgaaatggaggacattcaagaggcacatgctgggcaaatagttgcagtttttggtgtagattgtgcttcaggtgacacatttacaaatgggtctgtcaaatacaccatgacttctatgaatgtccctgagccagtgatgtcattagctgttcaaccagtttcgaaggactctggcgggcaattttcaaaggcattgaatcgtttccagagagaggatcctacattccgtgtgggcttggatgcagaaagtgggcagacaattatctctggaatgggagagcttcatttggatatatatgtggaaaggatccggagagaatacaaggttgatgcaactgttggaaagcctcgtgtgaatttcagggagactataactcaacgtgctgagtttgattatctacataagaagcaatctggaggacagggtcaatatggacgagtgtgtgggtatgttgaaccacttccgcctgggtctccaattaagtttgaatttgagaacatgattgttggacaagctataccatcaaattttattcctgcgattgagaagggtttcaaagaagctgcaaattcaggttcattaattggacatccagttgaaaatatccgggttgttataactgacggtgcttctcatgcggtagattctagtgagcttgcatttaagttggcttctatctatgctttcagacagtgttatagtgctgctaggcctgtgatattggaacctattatgttggttgagttaaaagtaccgacagaatttcagggtacagtagctggtgatattaacaagaggaaaggtgttatagttggaaatgatcaagatggggatgattctgtaattactgccaatgtaccattgaacaatatgtttggttactcaacagcacttcgttcaatgacacagggtaaaggtgagttcaccatggaatacaaggagcattcaccagtttctcaggatgtgcaaatgcagttagtgaacacacacaaggccaataaagcagtagaatgaagggacggctgaagaactagccataagcccttaatagtcttttcaagtctataatttgttgtgatattcatttttgctatatttatttaggctatatgtttaatcagatagtaacatttttggaagcacaataagtttaaaccgtctgtttgttggccaacatgagccggcaaacattatataggcacctagggtgtttttttagggaatacggtactgtaaggacttatttccatactgccccaagaaagcagagaaaagaccttacatttctggatgcagaacacatacatacagaattccatgttttttgaggatgagaacccttaccttcaaaactttagatcctatgtatgtatattgtcatcacagtccttccgttgaacttgttctgagtcacttgaggcattggtttaaattgaatttttttgcaatcgacaaagaaatggtttctttcgtctaagcttgatgaaatcattggagatgcacgataggtcatatattttggatgtatagcttctattcgtatgtagttgcattattgttgtttcttttgtatgttgtgttggctataagttgataacagaagagatgttgacaaggcaaaaaaaaaa

SEQ ID NO: 633 - DNA, 2777 bp, Gossypium hirsutum
aagcagcactacccatattccaccatggcgcgattccaaagatccgcagtcccgcgcctcctttacaccttgtactccaccaaagcggcgccctactcttccccctccccgacggccgccctcctacgcgggaacttcgaggtccgtcatttcgctgctggcaacgtcgcgcgagcaaaggacgacaaagaaccatggtggaaagagtccatggaacgactccgaaacatcggaatctccgctcacatcgactccggaaagaccacactgacagagcgggttctctattacaccggccggatccacgagatccacgaggttcgcgggaaagacggcgtcggagcaaagatggattccatggatttagaaagagagaaaggaattactatccaatctgctgccacgtattgcacctggaaagattaccagattaatataatcgatacgcctggtcacgttgattttacgattgaagtcgagagggcgctgcgtgttcttgacggtgccattttggttttgtgtagcgttggtggtgtacaaagtcagtcaattactgttgatcggcaaatgagaagatacgaggtgccaagactcgcatttattaacaagctcgatcgaatgggagctgatccatggaaagttctcaaccaggcaaggtctaagcttcggcatcatactgcggctgtgcaagttccaattggtttggaagaaaactttaagggacttatcgaccttgtgcagctaaaagcttattattttcatggttccagcggagaaaaagttgtgtctgagggtataccagcagatatggaagccatagttgcagaaaagagacgtgaactaatagaagtggtttctgaagtggatgataaactagctgaagcatttctaaatgatgagcctatttcccctgctgatcttgaggaagcagttcgtagggcaaccatagcacggaagtttgttcctgtattcatgggtagtgcattcaaaaacaagggtgtacaaccgcttttagatggtgtccttagttacttgccatgtccaattgaagtcagtaactatgctcttgatcaaacaaagaatgaagaaaaggtaatgttgcctggaaccccagatggaccacttgtagcattagcttttaagctggaggaagggcggtttggtcagctaacatatctgagagtctacgagggtgtggttcggaagggtgattttatagtcaacgtaaatacaggaaagaagattaaggtgcctcgtttggttcggatgcattctaatgaaatggaggacattcaagaggcacatgctgggcaaatagttgcagtttttggtgtagattgtgcttcaggtgacacatttacaaatgggtctgtcaaatacaccatgacttctatgaatgtccctgagccagtgatgtcattagctgttcaaccagtttcgaaggactctggcgggcaattttcaaaggcattgaatcgtttccagagagaggatcctacattccgtgtgggcttggatgcagaaagtgggcagacaattatctctggaatgggagagcttcatttggatatatatgtggaaaggatccggagagaatacaaggttgatgcaactgttggaaagcctcgtgtgaatttcagggagactataactcaacgtgctgagtttgattatctacataagaagcaatctggaggacagggtcaatatggacgagtgtgtgggtatgttgaaccacttccgcctgggtctccaattaagtttgaatttgagaacatgattgttggacaagctataccatcaaattttattcctgcgattgagaagggtttcaaagaagctgcaaattcaggttcattaattggacatccagttgaaaatatccgggttgttataactgacggtgcttctcatgcggtagattctagtgagcttgcatttaagttggcttctatctatgctttcagacagtgttatagtgctgctaggcctgtgatattggaacctattatgttggttgagttaaaagtaccgacagaatttcagggtacagtagctggtgatattaacaagaggaaaggtgttatagttggaaatgatcaagatggggatgattctgtaattactgccaatgtaccattgaacaatatgtttggttactcaacagcacttcgttcaatgacacagggtaaaggtgagttcaccatggaatacaaggagcattcaccagtttctcaggatgtgcaaatgcagttagtgaacacacacaaggccaataaagcagtagaatgaagggacggctgaagaactagccataagcccttaatagtcttttcaagtctataatttgttgtgatattcatttttgctatatttatttaggctatatgtttaatcatatagtaacatttttggaagcacaataagtttaaaccgtctgtttgttggccaacatgagccggcaaacattatataggcacctagggtgtttttttagggaatacggtactgtaaggacttatttccatactgccccaagaaagcagagaaaagaccttgcatttctggatgcagaactcatacatacagaattccatgttttttgaggatgagaacccgtaccttcaaaactttagatcctatgtatgtatattgtcatcacagtccttccgttgaacttgttctgagtcacttgaggcattggtttaaattgaattttttgcaatcgacaaagaaatggtttctttcgtctaagcttgatgaaatcacctgcgcgg

SEQ ID NO: 634 - DNA, 3066 bp, Gossypium raimondii
atgggcttatgtaaaacaaatgaagtcaccaaataggcccggacgaatatccaaattaaccgaccaccggagaaaatgaatccgaattgttcctgatccaccccattttcagaacccgaacgggaaactaaaaaccccttattttgggtttagggttttacccgtaccaagcagcactacccatattccaccatggcgcgattccaaagatccgcagtcccgcgcctcctttacaccttgtactccaccaaagcggcgccctactcttccccctccccgacggccgccctcctactcgggaacttcgaggtccgtcatttcgctgctggcaacgtcgcgcgagcaaaggacgacaaagaaccatggtggaaagagtccatggaacgactccgaaacatcggaatctccgctcacatcgactccggaaagaccacactgacagagcgggttctctattacaccggccggatccacgagatccacgaggttcgcgggaaagacggcgtcggagcaaagatggattccatggatttagaaagagagaaaggaattactatccaatctgctgccacgtattgcacctggaaagattaccagattaatataatcgatacgcctggtcacgttgattttacgattgaagtcgagagggcgctgcgtgttcttgacggtgccattttggttttgtgtagcgttggtggtgtacaaagtcagtcaattactgttgatcggcaaatgagaagatacgaggtgccaagactcgcatttattaacaagctcgatcgaatgggagctgatccatggaaagttctcaaccaggcaaggtctaagcttcggcatcatactgcggctgtgcaagttccaattggtttggaagaaaactttaagggacttatcgaccttgtgcagctaaaagcttattattttcatggttccagcggagaaaaagttgtgactgaggagataccagcagatatggaagccatagttgcagaaaagagacgtgaactaatagaagtggtttctgaagtggatgataaactagctgaagcatttctaagtgatgagcctatttcccctgctgatcttgaggaagcagttcgtagggcaaccatagcaaggaagtttgttcctgtattcatgggtagtgcattcaaaaacaagggtgtacaaccacttttagatggtgtccttagttacttgccatgtccaattgaagtcagtaactatgctcttgatcaaacaaagaatgaagaaaaggtaatgttgcctggaaccccagatggaccacttgtagcattagcttttaagctggaggaagggcggtttggtcagctaacatatctgagagtctacgagggtgtggttcgaaagggtgattttatagtcaacgtaaatacaggaaagaagattaaggtgcctcgtttggttcggatgcattctaatgaaatggaggacattcaagaggcacatgctgggcaaatagttgcagtttttggtgtagattgtgcttcaggtgacacatttacaaatgggtctgtcaaatacaccatgacttctatgaatgtccctgagccagtgatgtcattagctgttcaaccagtttcgaaggactctggcgggcaattttcaaaggcattgaatcgtttccagagagaggatcctacattccgtgtgggcttggatgcagaaagtgggcagacaattatctctggaatgggagagcttcatttggatatatatgtggaaaggatccggagagaatacaaggttgatgcaactgttggaaagcctcgtgtgaatttcagggagactataactcaacgtgctgaatttgattatctacataagaagcaatctggaggacagggtcaatatggacgagtgtgtgggtatgttgaaccacttccgcctgggtctccaattaagtttgaatttgagaacatgattgttggacaagctataccatcaaatttcattcctgcgattgagaagggtttcaaagaagctgcaaattcaggttcattaattggacatccagttgaaaatatccgggttgttataactgacggtgcttctcatgcggtagattctagtgagcttgcatttaagttggcttctatctatgctttcagacagtgttatagtgctgctaggcctgtgatattggaacctattatgttggttgagttaaaagtaccgacagaatttcagggtacagtagctggtgatattaacaagaggaaaggtgttatagttggaaatgatcaagatggggatgattctgtaattactgccaatgtaccattgaacaatatgtttggttactcaacggcacttcgttcaatgacacagggtaaaggtgagttcaccatggaatacaaggagcattcaccagtttctcaggatgtgcaaatgcagttagtgaacacacacaaggccaataaagcagtagaatgaagggacggctgaggaactaaccataagcccttaatagtcttttcaagtctataatttgttgtgatattcatttttgctatatttatttaggctatatgtttgatcatatagtaacatttttggaagcacaataagtttaaaccgtctgtttgttggccaacatgagccggcaaacatttataggcacctagggtgtttttttagggaatacggtactgtaaggacttatttccatactgtcccaaggaagcagagaaaagaccttacatttctggatgcagaacacatacatacagaattccatgttttttgaggatgagaacccttaccttcaaaactttagatcctatgtatgtatattgtcatcacagtccttccgtttaacttgttctgagtcacttgaggcattggtttaaattgaattttttagcaatcgacaaagaaatgggtttctttcgtctaagcttgatgaaatcattggagatacacgataggttatatattttggatgtatagcttctattcgtatgtagttgcattattgttgttcttttgtatgttgtgttggctataagttgataacagaagagatgttgacaaggcaaa

SEQ ID NO: 635 - DNA, 2687 bp, Gossypium hirsutum
acccgcaccaagcagcactacccatattccaccatggcgcgattccaaagatccgcagtcccgcgcctcctttacaccttgtactccaccaaagcggcgccctactcttccccctccccgacggccgccctcctacgcgggaacttcgaggtccgtcatttcgctgctggcaacgtcgcgcgagcaaaggacgacaaagaaccatggtggaaagagtccatggaacgactccgaaacatcggaatctccgctcacatcgactccggaaagaccacactgacagagcgggttctctattacaccggccggatccacgagatccacgaggttcgcgggaaagacggcgtcggagcaaagatggattccatggatttagaaagagagaaaggaattactatccaatctgctgccacgtattgcacctggaaagattaccagattaatataatcgatacgcctggtcacgttgattttacgattgaagtcgagagggcgctgcgtgttcttgacggtgccattttggttttgtgtagcgttggtggtgtacaaagtcagtcaattactgttgatcggcaaatgagaagatacgaggtgccaagactcgcatttattaacaagctcgatcgaatgggagctgatccatggaaagttctcaaccaggcaaggtctaagcttcggcatcatactgcggctgtgcaagttccaattggtttggaagaaaactttaagggacttatcgaccttgtgcagctaaaagcttattattttcatggttccagcggagaaaaaattgtgactgaggagataccagcagatatggaagccatagttgcagaaaagagacgtgaactaatagaagtggtttctgaagtggatgataaactagctgaagcatttctaagtgatgagcctatttcccctgctgatcttgaggaagcagttcgtagggcaaccatagcaaggaagtttgttcctgtattcatgggtagtgcattcaaaaacaagggtgtacaaccacttttagatggtgtccttagttacttgccatgtccaattgaagtcagtaactatgctcttgatcaaacaaagaatgaagaaaaggtaatgttgcctggaaccccagatggaccacttgtagcattagcttttaagctggaggaagggcggtttggtcagctaacatatctgagagtctacgagggtgtggttcgaaagggtgattttatagtcaacgtaaatacaggaaagaagattaaggtgcctcgtttggttcggatgcattctaatgaaatggaggacattcaagaggcacatgctgggcaaatagttgcagtttttggtgtagattgtgcttcaggtgacacatttacaaatgggtctgtcaaatacaccatgacttctatgaatgtccctgagccagtgatgtcattagctgttcaaccagtttcgaaggactctggcgggcaattttcaaaggcattgaatcgtttccagagagaggatcctacattccgtgtgggcttggatgcagaaagtgggcagacaattatctctggaatgggagagcttcatttggatatatatgtggaaaggatccggagagaatacaaggttgatgcaactgttggaaagcctcgtgtgaatttcagggagactataactcaacgtgctgaatttgattatctacataagaagcaatctggaggacagggtcaatatggacgagtgtgtgggtatgttgaaccacttccgcctgggtctccaattaagtttgaatttgagaacatgattgttggacaagctataccatcaaatttcattcctgcgattgagaagggtttcaaagaagctgcaaattcaggttcattaattggacatccagttgaaaatatccgggttgttataactgacggtgcttctcatgcggtagattctagtgagcttgcatttaagttggcttctatctatgctttcagacagtgttatagtgctgcaaggcctgtgatattggaacctattatgttggttgagttaaaagtaccaacagaatttcagggtacagtagctggtgatattaacaagaggaaaggtgttatagttggaaatgatcaagatggagatgattctgtaattaccgccaatgtaccattgaacaatatgtttggttactcaacggcacttcgttcaatgacacagggtaaaggtgagttcaccatggaatacaaggagcattcaccagtttctcaggatgtgcaaatgcagttagtgaacacacacaaggccaataaagcagtagaatgaagggacggctgaggaactaaccataagcccttaatagtcttttcaagtctataatttgttgtgatattcatttttgctatatttatttaggctatatgtttgatcatatagtaacatttttggaagcacaataagtttaaaccgtctgtttgttggccaacatgagccggcaaacatttataggcatgttttttttagggaatacggtactgtaaggacttatttccatactgtcccaaggaagcagagaaaagaccttacatttctggatgcagaacacatacatacagaattccatgttttttgaggatgagaacccttaccttcaaaactttagatcctatgtatgtaatattgccatcacagtccttccgtttaacttgttc

SEQ ID NO: 636 - DNA, 2706 bp, Gossypium raimondii
acggcgttagagaaaataaatccgatttcttccgggtcctaacccaccccatattcaaaaaaattccaagacaagtcaaaagtcaaacccccttttcttgggttcagggttttacccgcactagggaatccaccgctgcattccgttacaatggcacgattcccgagatccgcaatcccgcgcctcctctacaccttcttctccagcaaaacgaggaggttttacccctcgccaacagccgcccttctactagggaattttgaggtccgtcaattctcagctggcaacgtcgcgcgagccaaggatgccaaagaaccatggtggaaagagtccatggaacgactccgaaacatcggaatttctgcgcacatcgactcgggcaagaccactctaacggagcggattctttattataccggccggattcacgagatccacgaggttcgtggcaaagatggcgtaggagcaaagatggattccatggatttagagagagagaaagggattactatccaatctgctgccacgtattgcacctggaaggattaccagattaatattatcgatacgcctggtcatgttgattttacgattgaagtggagagggcgctgcgtgttcttgacggtgccattttagttttgtgtagtgttggtggtgtacaaagtcagtcaattactgttgatcgacaaatgagaagatatgaggttccgagactcgcctttattaacaagcttgatagaatgggagctgatccatggaaagttctcaaccaggcgaggtctaagcttcgacatcatagtgcagctgtgcaagtcccaattggccttgaagaaaactttcagggtcttatcgaccttgtgcaactaaaagcttattatttccatggatccagcggagaaaaagttgttgcggaagaaataccagcagatatggacgtgatagttgcagaaaagagacgtgaactgatagaaatggtgtctgaagtagatgataaactagctgaagcttttctaaatgatgatcctatttcatctgttgatcttgaggaagcagttcgtagggcaaccatagctcgaaaatttgtacctgtattcatgggtagtgcgttcaaaaacaagggtgtacaaccacttttggatggtgttcttagttacttgccatgtccaattgaagtcagtaactatgctcttgatcaaacaaaaaatgaagagaaggttatgttgcccggaaccccagatggaccacttgtggcattagcttttaagttggaggaaggccggtttggtcagctaacatatctaagagtctacgagggtgtgattcgaaagggtgattttatagtgaacataaacacaggcaagaagattaaggtacctcgtttggttcggatgcattctgatgaaatggaggacattcaagaggcacatgctgggcaaatagttgcagtttttggagtagactgcgcttcaggtgatacatttacaaatggatctgtcaaatacaccatgacctctatgagtgtccctgaaccagtgatgtcattagctgttcagccggtttcaaaagattcaggaggccaattttcaaaggcattgaaccgtttccagagagaggatcctacatttcgtgtagggttggatgctgaaagcgggcagacaatcatctctggaatgggggagcttcatctcgacatatatgtggaaaggatccggagagaatacaaggttgatgcaactgttggaaagcctcgtgtgaatttcagggagactataactcagcatgctgaatttgattatttacacaagaaacaatctggaggacagggtcaatatggtcgagtatgtgggtatgttgaaccacttccacctgggtctccaataaagtttgaatttgagaacatgattgttggacaagctgtaccatcaaactttattcctgcaattgagaagggtttcaaagaagctgcaaattcgggttcattaattggacatccagttgaaaatataaggattgttttgactgatggtgcatctcatgcagtagattctagtgagcttgcgtttaagttagctgctatatatgcattcagacagtgttatagtgctgcaaggcctgtgatactggaacctataatgttggttgagttgaaagtaccaacagaatttcagggtacagtagctggtgatatcaataagaggaaaggtgttattgttggaaatgaccaagatggagatgattctataattactgtcaatgtcccgttgaacaatatgtttgggtactcaacaatgcttcgatcaatgacacagggaaaaggtgaattcacaatggaatacaaggagcattcaccggtttctcaggacgtgcaaatgcaattagtgagcactcacaaggccgataaagctgaataaataacgagcaagattgcttgaagattgaagaactgggcacaagttgtataatctgtttttattaattcttgctctatttattgcagccatatgtttgatcatcttttaagtcgcaaaaattttgaaagcacaataatgtgcaaactgccgtttctcgaccatcatagatgaatgtatcttttcttagcagaataagattccatgtatttttccaacttatggctaaccatagcaactagttaaatgcttctctctgttttgtggggagctccagatttggctcagattcactga

SEQ ID NO: 637 - DNA, 2848 bp, Phaseolus coccineus
tttttacacacttgaaccgatcgatgttgcaaattggaacccattccactaggattagggttttagttccacttccctagtcaaaaccccagaagaagagacagccaaaaaccctccacccgccatggcacgcttgtcccggtcctccgcaccgcgcctcctttacgcgctctgctccaccgcgtcgcagtcaccggcggcgttcctcctgggcggttccttccagctccggcagttttcggccggtaacgcggcgcgtgcgaaggcggagaaggatccctggtggaaagagtcgatggagcggctccgcaacatcggtatctcggcgcacatcgactccgggaagacgacgctgacggagcgggttctgtactacacgggtcgaatccacgagatccacgaggtgaggggcagggatggcgttggcgccaagatggactccatggacttggagagggagaagggaatcacaattcagtctgctgccaccttctgcacttggaaggactataagattaacattattgacacacctggtcatgttgattttaccattgaggttgagagggctttgcgtgtccttgatggtgccattctcgttctttgtagtgttggtggggtgcaaagtcagtccattactgttgatcggcaaatgagaagatatgacgttccaagacttgcatttatcaacaaacttgatcggatgggagctgatccatggaaagtgttaaatcaggctagatctaagcttcgacatcatagtgctgcaatccaagttccaataggtttggaagaagattttaaaggacttattgatcttgtgcagttaaaggcctactattttcatggttcaagtggtgaaaaagttgttgctgaagacgtgcctgcagatatggaagcatttgtggcagaaaaaagacgtgaacttatagaaactgtttcagaagttgacgataaacttgctgaagcttttcttggcgatgagaccatatcagctgctgatcttcaggaagcagttcgtagggctaccttagcacagaaatttataccagtattcatgggtagtgctttcaaaaacaagggggtgcagccacttctggatggtgtacttaactatttgccatgtccaattgaagttagtaattatgcccttgaccaaaccaagaatgaagacaaggttgagttgcctggaagtcctgacgggccacttgtggcattggctttcaagttggaggaagggcggtttggtcagttaacatatctaagaatatatgagggagtaattcggaagggtgattttattgttaatgtaaacactggcaagagaatcaaggttccacgcttggttcggatgcattctgatgagatggaggacattcaagaggctcatgctgggcaaatagttgctgtatttggtgttgattgtgcatcaggagatacttttaccgatggttcagttaagtacacaatgacttctatgaatgttcctgagccagtgatgtcgttagctgttcagccggtatctaaagattctggcggacaattttcgaaagctttgaatcggttccaaagggaagatcctacttttcgtgttggcttggacccggagagtgggcagacaatcatttctggaatgggagaattgcatttagatatctatgttgaacgcataaggagagagtacaaggttgatgcttcagttggaaagccccgtgttaacttcagagaaactgttactcaacgtgctgattttgattatttgcataagaagcaaagtggagggcaaggtcaatatggtcgggtaattgggtatattgaaccactccctgcagggtcatcaactaagtttgaatttgaaaacatgcttgttggtcaagctattccatcaaattttgtccccgcaattgagaagggtttcaaagaagctgccaattctggtgccttaattggacatccagttgaaaatctccgagttgtcttgacagatggtgctgctcatgctgttgattccagtgaacttgcgtttaaattggcttctatctatgcttttagacagtgttatgcaacttccagaccagtaatattagaacctgttatgcttgttgagctgaaagtaccaacagaatttcagggagctgttgctggtgacatcaacaagagaaaaggtgtaattgttggaaatgaccaggaaggagatgattctgtcattactgctcacgtccctcttaacaatatgtttgggtactcgacagctcttcgctcaatgacacagggtaaaggtgaattcacaatggagtacaaggaacattcatcagtttctaatgatgtacagacgcaattgataaacgcgtacaagggcaacaaggcagctgaataatcagcttttgtcgatgtgcacggtcaaaatatttatgacaatcatttatccaaaaagctggacaataatatatagataaggtttgtttcattttatttggctcaaccaattttggaaaggaaataaaagttgctgtaattgtgatccggtagttaaatggtactgtacttgtagatgaggatgaagatgctcgtatttgagctattagatatgtaattttatgttcattccattcccgaattttgtactagttaccaatttggttttagggaaggagttggagagggaacgaaacagtggggtggtcccagaaaaaagaaacccttttaccagtgatatttttgggagcctggcctttaattttatttttaatgttttagtaagaagttcaaatgtttggttagattaattttattattagtattattataaattgttttgatacaatttatttattcttttcactcgtaa

SEQ ID NO: 638 - DNA, 2542 bp, Cicer arietinum
ccgaaaaccctgataccccaccatggcacgcttctcaaggtcctccgcgcagcgtcttctatacgcactctcctcctcctcttccacggtctctccatcgccggcgggatccctaatcggaggcgccttccattttcgacaattctcggcggggaacgtggcgcgagcgaaggcggcggcagacgacaaggagccgtggtggaaggaatcaatggaacggcaacgcaatatcgggatctcggcgcacatcgactccgggaagacgacgttgacggagcgggtactgttttacactggtcggattcatgagattcatgaggtgaggggaaaggatggcgttggtgctaagatggattccatggatttggagagagagaagggaatcactattcaatctgctgctacttattgtacttggaaagactataaggtcaacataattgacactcccggtcacgttgatttcaccattgaggttgagagggctttgcgtgtccttgatggtgccattcttgttctttgtagtgttggtggggtgcaaagtcagtcaattactgttgatcggcaaatgagaagatacgaggttccaagacttgcatttataaacaagcttgatcggatgggagctgatccatggaaagttttaaatcaggctagatctaagcttcggcatcatagtgctgcaattcaagttccgataggcttggaagagaactttaagggactcattgatcttgtgaagttaaaggcctattattttcatggctcaagtggcgaaaaaattgtcattgaagaagtgccttcagatatggaagccttggtggcagaaaaaagacgtgaactcatagagactgtgtcagaggttgatgatatacttgctgaagcttttcttagtgatgagcccatttcagctgctgatctagagggagcaattcgcagggctaccatagcacagaaatttataccagtattcatgggcagtgctttcaaaaacaagggggtacagccacttctggatggtgtacttagttatttgccatgtccaatggaagttagtagttatgctctcgaccaatctaagaatgaggagaaggttgagctatctggaagtcctgatgggccacttgtagcattggctttcaagttagaggaagggcggtttggtcagttaacatatctaagaatttacgagggtatcattcggaagggtgattttattattaatgttaacactggcaagaagatcaaggttcctcgtttggttcggatgcattctgatgagatggaggacattcaagaggcccatgctggccaaatagttgctgtatttggtgttgattgtgcatcaggtgatacttttaccgatgggtcagttaaatacaccatgacttctatgaatgttcctgagccagtgatgtcattagctgtacagccagtctcaaaggattctggagggcaattttcaaaagctttgaaccgcttccaaaaagaggatcctactttccgtgttggcttggatccagagagtgggcagacaattatttctggaatgggggaactgcacttagatatctatgttgaacgtattaggagggagtacaaggttgatgcttcagttggaaagccccgtgtaaacttcagagaaactgttactcaacgtgctgattttgattatttacataagaagcaaacaggaggacaaggacaatatggacgggtgattgggtatattgaaccacttcctgctgagtcagcaactaagtttgaatttgaaaacatgcttgttggtcaggctattccatcaaattttatccctgcaattgagaaaggttttaaagaagctgccaactctggggcattaattgggcatccagttgaaaatctccgagttgtcttgacagatggtgctgctcatgctgttgattccagtgaacttgcctttaagttggcttctatctatgcttttagacagtgttacccagcttccagaccagttatattagaacctgttatgcttgttgagctgaaagtaccaacagaatttcagggagctgttgccggtgacctcaacaagagaaaaggggtgattgttggcaatgatcaggaaggagatgattccgtaattacagctcatgtccctcttaacaatatgtttggatattctacagctcttcgttcgatgacacagggaaagggtgagttcacaatggaatataaggaacattcacctgtttctcatgatgtacagacccaattgataaacacatgcaagggcaataaggcagctgaatgactggccttcttgaaaacacggccctaattttttggggataatttatctaggaaaaagaattgtgacaatgatataggatataggtttggttcattttttgtggtcagccaaattttgaaagcaaataaaagttgctataattgtgatagtgtacgcataatttaatattagatgaaatagttctcagtaatctggcttctgtaagatgtaagttatgcaggctcgttagcctcttcgtgaaaatgtctc

SEQ ID NO: 639 - DNA, 2560 bp, Vitis vinifera
ctcgtgggtccagagggttttgggtttagtagtgtagcagcagttgaaaaccctaggggtttaaccagcacggcgatcaaccccgcccagaaccctaacgcccatggctccctccgcacggtctccggcaattcgcctgctatacaccctctcctccgccctcaaaacgacgtcgtcgcctcttctgactggtcaccggcggactttctcagccggcaacccagcgagagtggaggcaacatggtggaaggagtcaatggagaggcttcggaacatcggaatctctgcccacatcgattcggggaagacgacgctgacggagaggattctgtattatacgggaaggatccatgagattcatgaggttagaggccgcgatggagtaggtgcgaagatggattccatggatttagaaagagagaaggggatcacgattcagtctgctgctacctactgtacttggaaagattatcaggttaacataattgacactcctggtcatgtcgacttcaccattgaagttgagagggctttgcgtgtccttgatggtgccattcttgtcctttgtagtgttggtggtgtgcagagtcagtcaataactgttgataggcaaatgagaagatatgatgtcccaagagttgcattcattaacaaacttgatcgaatgggagcagatccatggaaagttctcagccaggcaaggtcaaagctccggcatcacagtgctgctgtgcaagttccaattgggttggaagatgattttcagggtcttgttgatcttgtgcagttaaaagcttactattttcatggttccaatggtgaaaaagttgtggccgaagaaatacctgccaatatggaggcattagttgcagaaaagcggcgtgaactcatagaaatggtttccgaggttgatgataaactagccgaagcatttctaacagatgaacctatatcatctgctagtcttgaggaggcaatccgcagggctacagttgcacagaaatttataccggtcttcatgggcagtgcattcaaaaacaagggagtgcaaccccttcttgatggtgtgcttagttatttgccttgtcctactgaagttagcaactatgctcttgaccaaaacaagaatgaagagaaggtgactatatctggaactccggttggacctcttgtcgcattggcttttaaattggaagaagggcgctttggtcaattgacatacctaagaatctacgagggtgtcattcggaagggtgattttataatcaatgtaaacacaggcaaaaagataaaggttcctcgcttggttcggatgcattctaatgagatggaggacattcaagaggcccatgctgggcaaatagttgctgtcttcggtgttgattgtgcttcaggtgatacttttactgatgggtcagtgagatacaccatgacctctatgaatgttccagaaccggtcatgtcattagctatttcacccgtttctaaggattctggaggacaattttcaaaggctttgaatcgctttcagagagaggatcctactttccgtgttgggttggacgctgagagtgggcagacaattatttctggaatgggagagctgcatttggacatttacgttgaacgcattcggagggagtataaggttgatgcaactgttggaagacctcgtgttaacttcagagagactgttacgaaacgtgctgaatttgattacttacataagaagcaaactggaggacaaggtcaatatggaagggtctgtgggtatgtagaaccactcccagaaggatccaccactaagtttgaatttgagaacatgattgtaggacaagctgtaccatccaattttatcccagccattgagaagggttttaaagaagcagccaattcgggttcactgatagggcatccagttgaaaatattcgtatcgttttaacagacggtgctgcccatgctgtggattctagtgaacttgcatttaagttagctgcaatttatgcttttagacagtgctatacagcagccaaacctgtgatattggaacctgtaatgcttgtggaattgaaagcgccaacagaatttcagggcactgttactggtgacatcaataagaggaaaggtgtgatcgttggaaatgaccaggatggagacgattctgtaattactgcccatgtccctctaaacaatatgtttgggtactcaacatcacttcgttcaatgactcaggggaaaggtgaattcacaatggaatacaaagagcattcaccggtttctcaagatgtgcagctgcaattagtgaacacctacaaggccaataaggcagctgaaaatagttaggattctgctgtgactttgaggaacacgtccctacattcatagtgtaagccatatcttattttttgatatttatccgggccaaaagtgttctggtccataaattttgaaaagccaaataattgttacctacattctttaatacgaataatgtatgaaatgactgtactttaaacaggtattcatcacagtcaaattgtcttaatatttatgacaaag

SEQ ID NO: 640 - DNA, 2611 bp, Fagus grandifolia
gcatatggccctttcacccgatccatttcatttctgtctctgaacctaaaactaaaaccccagaaccaccatctctttgacctccttctcaaacacacactgacacagtcctgtggggtttagggttttagctccaccctccaaacccctcaaaccacaacatggcacgcttcccaagaccctccacacctcgcttactctacaccctctactcctcccccaccaaaacgacaccgtctcactcccactcccactcccattcccaatcctcaatcaccacatttctcctcaacaacaacctccacatcctccgccatttctcttcagggaacttggcacgtgccacgacgtcgaaggatgacaaggacccgtggtggaaggaatccatgaatcgcctccgaaacatcgggatttcggcccacatcgactccgggaaaaccacgctcaccgagcgggtcctcttctacacgggtcggatccacgagatccacgaggttcgaggcagagacggcgttggcgccaaaatggactccatggatttggagagagagaagggcatcactatccaatccgccgccacgtactgcacttggaaagacttccaggttaacataatcgatactcccggtcacgttgatttcacaatcgaggtcgagagggcattgcgtgttcttgatggcgccattcttgtcctttgtagtgttggcggtgttcagagtcagtcgatcactgttgatcggcaaatgagaagatatgaggttccgagacttgcgtttattaacaaactcgatcggatgggagctgatccatggaaagttctcaaccaggcaaggtctaagctccggcatcacagtgctgccatgcaagttccaattgggttggaggaggatttcaagggtcttattgaccttgtgcaattaaaagcatattattttcgtggctccagtggtgaaaatgtagttgctgaagacatacctgccgatatggaggccttagttgcagaaaagagacgggaactaatagaggctgtttctgaagttgatgataaacttgctgaaccatttctcaatgatgagcctataacgtcaacggatcttgaggaagcaattcgcagagcaactgtagcacggaaatttgtacctgtattcatgggtagtgcatttaaaaacaagggagtacaaccacttctggatgctgtacttagttatttgccttgtccaactgaagtcagtaattttgctcttgaccaaactaagaatgaagagaaggttacattgtctggaactccagatgggcctcttgtggcattagcttttaaattggaggaagggagatttggtcagttgacctatctaagaatttatgaaggtgttattcggaagggtgattttatacataacataaatacaggaaagaagattaagattcctcgcttggttcggatgcactccaatgagatggaggacattccagaggcacatgctgggcaaatagttgctgtatttggtgtggattgtgcatcaggagatacatttactgatgggtcagttaaatacacaatgacttctatgaatgtccctgagccagtgatgtctttagcggttcaaccagtttcaaaagattcaggaggacaattttcaaaggctttgaatcgtttccagagagaggatcctactttccgagttgggttggatgctgagagtgggcagacaattatttctggaatgggagagctgcatttggacatatatgttgaacgcattcggagagagtataaggttgatgcaactgttggtaagcctcatgtaaacttcagagaaaccgtaacacaacgggctgaatttgattatttacataagaagcaatcaggtggacaaggtcaatatggacgagtatgcggatatattgaaccacttcctccggggtcatcaactaagtttgaatttgacaacatgattgttgggcaagctataccatcaaactttatcccagcaattgagaaaggttttaaagaagcagcaaactcgggttcattaattggacatccagtcgaaaatcttcgtgttgttttaacagatggtgcttcccattctgtggattccagtgagcttgcattcaagttagcttcaatatatgcatttagacagtgctatacagttgccagaccggtaattttggagcctgtcatgatggtggagttgaaagttccaacagaatttcagggcactgttgctggtgatatcaacaagagaaaaggtattatcgttggaaatgaccaggatggagatgattctgttattactgcccatgtccctctgaataacatgtttgggtactcaacagctcttcggtcaatgacacagggaaagggtgaatttacaatggaatacaaagagcattcagcagtttctaatgacgtgcagatgcaattagttaacacttacaagggcacaaaagcaactgactagttgggagtttcaattgaagcatttgcccttataatcattgatagggtatatttgtcatgttatagattttttattttatttcaaattcaaagcttattgtgataatttatttaggttataaatttgatccatgatgatcaatg

SEQ ID NO: 641 - DNA, 3729 bp, Gossypium hirsutum
cccctcgccgaccgccgcccttctactagggaattttgaggtccgtcaattctcagctggcaacgtcgcgcgagccaaggatgccaaagaaccatggtggaaagagtccatggaacgactccgaaacatcggaatttctgctcacatcgactcgggcaagaccactctaacggagcggattctttattatacgggccggattcacgagatccacgaggttcgtggcaaagatggcgtcggagcaaagatggattccatggatttagagagagagaaagggattactatccaatctgctgccacgtattgcacctggaaggattaccagattaatattatcgatacgcctggtcatgttgattttacgattgaagtggagagggcgctgcgtgttcttgacggtgccattttagttttgtgtagtgttggtggtgtacaaagtcagtcaattactgttgatcgacaaatgagaagatatgaggttccgagactcgcctttattaacaagcttgatagaatgggagctgatccatggaaagttctcaaccaggcgaggtctaagcttcgacatcatagtgcagctgtgcaagtcccaattggccttgaagaaaactttcagggtcttatcgaccttgtgcaactaaaagcttattatttccatggatccagcggagaaaaagttgttgcggaagaaataccagcagatatggacgcgatagttgcagaaaagagacgtgaactgatagaaatggtgtctgaagtagatgataaactagctgaagcttttctaaatgatgagcctatttcatctgttgatcttgaggaagcagttcgtagggcaaccatagctcgaaaatttgtacctgtattcatgggtagtgcgttcaaaaacaagggtgtacaaccacttttggatggtgttcttagttgcttgccatgtccaattgaagtcagtaactatgctcttgatcaaacaaagaatgaagtgaaggttatgttgcccggaaccccggatggaccacttgtggcattagcttttaagttggaggaaggccggtttggtcagctaacatatctaagagtctacgagggtgtgattcgaaagggtgattttatagtgaacataaacacaggcaagaagattaaggtacctcgtttggttcggatgcattctgatgaaatggaggacattcaagaggcacatgctgggcaaatagttgcagtttttggagtagactgcgcttcaggtgatacatttacaaatggatctgtcaaatacaccatgacctctatgagtgtccctgaaccagtgatgtcattagctgttcagccggtttcaaaagattcaggaggccaattttcaaaggcattgaaccgtttccagagagaggatcctacatttcatgtagggttggatgctgaaagcgggcagacaatcatctctggaatgggagagcttcatctcgacatatatgtggaaaggatccggagagaatacaaggttgatgcaattgttggaaagcctcgtgtgaatttcagggagactataactcagcatgctgaatttgattatttacacaagaaacaatctggaggacagggtcaatatggtcgagtatgtgggtatgttgaaccacttccacctgggtctccaataaagtttgaatttgagaacatgattgttggacaagctgtaccatcaaactttattcctgcaattgagaagggtttcaaagaagctgcaaattcgggttcattaattggacatccagttgaaaatataaggattgttttgactgatggtgcatctcatgcagtagattctagtgagcttgcgtttaagttagctgctatatatgcattcagacagtgttatagtgctgcaaggcctgtgatactggaacctataatgttggttgagttgaaagtaccaacagaatttcagggtacagtagctggtgatatcaataagaggaaaggtgttattgttggaaatgaccaagatggagatgattctataattactgtcaatgtcccgttgaacaatatgtttgggtactcaacaatgcttcgatcaatgacacagggaaaaggtgaattcacaatggaatacaaggagcattcaccggtttctcaggacgtgcaaatgcaattagtgagcactcacaaggccgataaagctgaataaataacgaccaagattgcttgaagattgaagaactgggcacaagttgtataatctgtttttattaattcttgctctatttattgcagccatatgtttcatcatcttttaagttcgcaaaatttttgaaagcacaataatgtgcaaactgccgtttctcgaccatcatagatgaatgtatcttttcttagcagaataagattccatgtatatttccaacttatggctaaccatagcaactagttaaatgcttctctctgttttgtggggagctccagatttggctcagattcactgaggggtgcaaagtactgatccaccatatcgtccgacactttttctaagcttggaggttcccactttggagcagagtctttgtgcaccactcgtgctctgacaccctcgcagaagtcattagagattcgcttagatatcccttgaagggacatccgatactcacgaaccaagcactggtcaaaggtttgaaatctgccttctcgtaccgatctcaaagacaccttcaagctcaatggtgaagcttctttaagtttctttaatgtggaattgcaccatgcatcatttgttgcagatgcctcactttccacagcatcgataatttccccaactgtgtcatggccgaaacatttattgagcacttcaatcctgtgcagcgcactgatcttttcaggatagactgcatcactatatttctccaaacaagactcaatgacagaaggatcatcggtaaccaaatttccaagctcttcttcaatcagtggaagcttatcagtgtttgagtagtgtgtcgcaagcccgcaagaaaccatttcagccccactgagttttgctcctgtcagacccaagtactctcctaagtgaccaggtagacgagagagatgaaaggatgctccggcatcaggatggaagccaatttgagtttcaggggtagcaaaaacggttctatcagtcgcaagccgaaatgtcccaggtatcgaaattccagctccaccacccatagtaatgccatttaaaatagacacatgaggcttcaaatatgtaccaagatggtatataaagctatacaacgtcctaaaaaagcccttacacttttctatcttcccttcatttatcaaatgataaagagcaacaatatctccacctgcacaaaatgcccttccactgcccttcatgaccacaaatccaatattgggatcatcttcccaagatgcgtacaattcatgcaacctagcgcctatatttgtattgagagcattgagagacgaaggtctgttgagaatcgctactcgagaactcgctttaccttcaaccagcacttgattttgaagatcaccagcagaagaattgattggaagcgaggataggtttctcttcaaccggattagactgtcacgacgacgacttgttaccaaacgctttaagctctgcatttcggatttgcactctaagccttagctcaaaattgagcaactgcgaaaagaggaagccaaaagaaatgccgtgtagttgtattattagcctatcag

SEQ ID NO: 642 - DNA, 2678 bp, Malus domestica
gctaaagggttcagggttttacctcaaacccccccccccccataaaccctaaaaccagagacccccacaaccatgacgcgcttccctccaccctccacgccacgcctcctttacaccctctacagatctagaacggcgccgtctcctccttccccgtccccatcggcagcctcttccctcctcatcggctccttccacttccgtcaattctcctccggcaacctcgcgcgcgccaaggaggacaaggagccatggtggaaggactccatggacaagcttcggaacatcggaatctcggcccacatcgactccggcaagaccactctcaccgagagagttctgttttacaccgggaagatccacgagattcacgaggttcgaggcagagacggcgtgggtgcgaaaatggattccatggatttggagagggagaaggggatcaccattcagtctgctgccacttactgtacttggaatggctatcagattaacataattgacaccccaggtcacgttgatttcaccatcgaggttgagagagctctgcgtgtccttgatggtgccattcttgtcctttgtagtgttggtggagtgcaaagtcagtcaattactgttgatcggcaaatgaaaagatacgaggttccaagaattgcatttataaacaaacttgaccgaatgggagcagatccctggaaagttctgaatcaggcacgggctaagctccgccatcacagtgctgccatgcaagttccaattgggttggaagaagattttaagggtcttattgaccttgtgcagatgaaagcttactattttcatggtcccaatggtgaaaacattgttactgaagaagttcctgctgatatggaggagttcgtcacagaaaagaggcgcgagctaattgaagttgtatctgaagttgatgacaaactagctgaagcattccttgatgatgagcccatatcacctactgatcttgaggaagctgtgcggagggctactgtagcaaggaaatttatccccgtgttcatgggtagtgcatttaaaaacaagggtgtacagccacttttgaatgctgttcttaattatttgccttgtccgactgaagtcagtaactatgctcttgaccagactaaggatgaagagaaggttacattgggtggaactccggatgggcctcttgtagcattggctttcaaattggaggaagggcgttttggtcagttaacatatctaagaatctatgaaggtgtcattcggaagggtgattttatttttaacattaataccggtaaaaggattaaggttcctcgcttggttcggatgcattccaatgagatggaggatattcaagaggcacatgctggacaaatcgttgctgtttttggcgtggactgtgcatcaggagatacctttactgatgggttggttaaatatacaatgacttctatgagtgtccctgagccagtgatgtcgttagctgttcaaccagtttcaaaagattctggaggacaattttcaaaggctttgaatcgttttcagaaagaggatccaacatttcgtgttggcttggatcctgagagcggacagacaatcatctctgggatgggagagctgcatttggacatttatgttgaacgcattcggagagaatataaggttgatgccactgttggaaagcctcgtgttaacttcagagagactgttactcagcgggctgagtttgattatttacataagaagcaatctggaggacaaggtcaatatgggcgggtatgtgggtatattgaaccactccctgctgactcacagaccaagtttgaatttgaaaacattattgtgggacaagctataccatcaaattttattccagctattgagaagggtttcaaagaagcagccaattcgggttcattaattggacatccagttgagcatgttcgtattgtattaaccgatggcgcttcccatgccgtggactccagtgaacttgcctttaaattagctgcaatatatgcatttagaaagtgctatacggcggcaagaccagtgatattggagcctgttatgctggtggaattgaaagtacctatagagtttcagggtactgttgctggcgatcttaacaagagaaaaggtatcattattggaaatgaccaggaaggagatgactctgttattactgcccaagtccctctgaacaacatgtttgggtattcgacttctcttcggtcaatgactcagggaaaaggcgaattcacaatggagtacaaagagcactcgccggtttctaatgatgtgcaggcgcaactggtcaagaactacaagggcaccactgctgctgaatagcttacgacgtgcagatggaattgataaacaactacaagagcaccactgctgctaaacagcaagtgtttcgaccgatacgtttactcctgccggaggccgctgttttttgtacaacgctgtttttcgaccttcaattttgttaaattttttaggaagaaagagtcaggtaatttgcatgatccataattttgaaagaccagaacaaccctaaattgcttataggctgatattctgcatcaactgtgtatcatatagtttacacttttccattatttttggttgaataattttactatttaccattaaataatattaaaagttcgcccctc

SEQ ID NO: 643 - DNA, 3298 bp, Citrus clementina
aacagtacaacaaaccctcgaaccccaaacccttaaaaaatctcagggtttagggttttagataaaaaaaagcgatggctagattcccacgatctccagcaccacgtctcctctacactctcttctcctcttcgagaacgacaccgaccaaatcctcaccccaatctccgtctgcagccctcctccaaggaaacttccacctccagtcgcggcagttctcggcgggaggaaacctcgcacgtgcgaaggatgataaggagccatggtggaaggaatcaatggagcggctccgaaatatcggaatctcggcgcatatcgattccggaaaaactacactaaccgagcgaattctgttttacactggacggattcacgagattcacgaggttcgagggcgagacggcgtcggcgccaaaatggattctatggatttggagcgtgagaaaggtatcacaattcagtcagccgccactagctgtgcttggaaggattaccagattaatataattgacactcctggacacgtagacttcacagttgaagtagaaagggctttgcgagttcttgatggcgcaattcttgtgctttgtagtgttggtggcgtgcaaagtcaatcaattaccgttgaccggcaaatgaggagatacgaggtgccaaggctggctttcattaacaaacttgatagaatgggagctgatccatggaaagttttggatcaggcaaggtctaagctgcggcaccactgtgctgctgtgcaagttccaatgggattggaagatcagtttcagggtcttgtggaccttgtgcagttaacagcttattattttcatggttccaatggtgaaaaaattgtcactggagaagttccggctgatatggagacctttgttgctgaaaagaggcgtgaactaattgagttggtttctgaagttgatgataaacttggtgatatgtttctcagtgacgagcctatatcatctggtgatcttgaggaagcaattcgcagagccacggtagcacggaaatttatcccagtatttatgggcagtgcattcaagaacaagggggtgcagccacttctggatggtgtacttagttatttgccttgcccaactgaagttagtaactatgctctagaccaaaaaaataatgaagagaaggttattttatctggaaatccagatggacccctagttgcattggcttttaagttggaggaaggacgctttggtcagttgacatatctaagaatatacgagggtgtgattcggaagggtgatttcataattaatgtaaacacaggcaagaagattaaggttcctcgtttggtgcggatgcattctaatgagatggaggatatacaggaagcccatgctggccaaatagttgctgtctttggtgtagattgtgcatcaggagatacatttactgacgggtctgttaaatacaccatgacttcgatgcatgttcctgaaccagtaatgtcactagctgttcaaccagtttcaaaagattcggggggacaattctcaaaagcattgaatcgtttccaaaaagaggatcctacctttcgtgttggcttggatgccgaaagtggacagacaattatttctggaatgggagagctgcacttggacatatatgttgaacgcatcaggagagaatataaggttgacgcaactgttgggaagcctcgtgtaaacttcagggaggctgttacaaaacgtgctgaatttgactatttgcataaaaaacaatctgggggacaaggtcaatatgggcgggttattgggtatatcgagcctcttccactggggtcaccagctaagttcgaatttgaaaatttacttgtcggacaagctataccatcgaattttatcccagcaattgaaaagggttttaaggaagctgccaattcgggttccttaattggacatccggtggaatatcttcgtgtcgtcttaactgatggtgcatctcatgccgtggattctagtgaacttgcatttaaaatggctgcaatatatgcttttagacagtgctacgctgctgcaaagcctgtgattttagaacctgttatgctggttgagttgaaagtgcccacagaatttcagggtagcgttgctggggatatcaacaagaggaaaggtatgattgttggaaatgatcaagagggagatgactctgtaattactgcgcatgtccctttgaacaatatgtttggatattcaacagcacttcgttcaatgacacaagggaaaggtgaattcacaatggaatataaagaacatgcgccagtttctcaggacgttcagttgcaattggtaaaaactcacaatgctggcaggggagccgaatagttggcgctaagcaacgtccaatgcccctatattttttgtgaccaataagtattcagtcaattgttatataatttacttgaacagacaaaatttagattttttgagaggagacaaacttaagattgatccttctagtggtcaaaaaaactattggaaaaggcaataattgttttttagggggacacgtgtgtgtgcgtataagagagtatgtcctgtatatttttacattgtatggtaggtatcaccggcacagcaagtttttagttgcatgaagttatggtgttacatttaagacttgacaagaaacttgagaatgacagaagagagaacactagaaacgtgcaatgaaaaacacggtacaatgcattagtctcgactctgtttggtcacgaatagacctctaagcaggaaaagcatacgtagaggccagtgtagccaaccgaaatgttttggcccagccgctgagactccagtcccaatcacgtttatttcgagtcatgaaacctttataattccctttggcgccattggaaaagattgatcatcttataaattcttagctgttcatcgtccaaacaaacctatctttcaataatttagctgccaattcattagcagcatccaaccactttcagcttttgaaagcatttagccaaccaaaagaaacaatgatgtgctaagaaaacattagttaaatgcttctcgcagttttgtgggcagctctagatccagctctgattcactaagtggggaaaagtaatgatccaccatgtcttctgacacttgttccaaacttggtggactccactgcataatatagaaccatgaaaacatatattacaccattagtaatacacttatgaaatattagtgtatcatgattcatcagtcgacatattattaatatgacatgtatcacaatctttaaaaaatttaac

SEQ ID NO: 644 - DNA, 3298 bp, Citrus sinensis
aacagtacaacagatcctcgaaccccaaacccttaaaaaatctcagggtttagggttttagataaaaaaaagcgatggctagattcccacgatctccagcaccacgtctcctctacactctcttctcctcttcgagaacgacaccgaccaaatcctcaccccaatctccgtctgcagccctcctccaaggaaacttccacctccagtcgcggcagttctcggcgggaggaaacctcgcacgtgcgaaggatgataaggagccatggtggaaggaatcaatggagcggctccgaaatatcggaatctcggcgcatatcgattccggaaaaactacactaaccgagcgaattctgttttacactggacggattcacgagattcacgaggttcgagggcgagacggcgtcggcgccaaaatggattctatggatttggagcgtgagaaaggtatcacaattcagtcagccgccactagctgtgcttggaaggattaccagattaatataattgacactcctggacacgtagacttcacagttgaagtagaaagggctttgcgagttcttgatggcgcaattcttgtgctttgtagtgttggtggcgtgcaaagtcaatcaattaccgttgaccggcaaatgaggagatacgaggtgccaaggctggctttcattaacaaacttgatagaatgggagctgatccatggaaagttttggatcaggcaaggtctaagctgcggcaccactgtgctgctgtgcaagttccaatgggattggaagatcagtttcagggtcttgtggaccttgtgcagttaacagcttattattttcatggttccaatggtgaaaaaattgtcactggagaagttccggctgatatggagacctttgttgctgaaaagaggcgtgaactaattgagttggtttctgaagttgatgataaacttggtgatatgtttctcagtgacgagcctatatcatctggtgatcttgaggaagcaattcgcagagccacggtagcacggaaatttatcccagtatttatgggcagtgcattcaagaacaagggggtgcagccacttctggatggtgtacttagttatttgccttgcccaactgaagttagtaactatgctctagaccaaaaaaataatgaagagaaggttattttatctggaaatccagatggacccctagttgcattggcttttaagttggaggaaggacgctttggtcagttgacatatctaagaatatacgagggtgtgattcggaagggtgatttcataattaatgtaaacacaggcaagaagattaaggttcctcgtttggtgcggatgcattctaatgagatggaggatatacaggaagcccatgctggccaaatagttgctgtctttggtgtagattgtgcatcaggagatacatttactgacgggtctgttaaatacaccatgacttcgatgcatgttcctgaaccagtaatgtcactagctgttcaaccagtttcaaaagattcggggggacaattctcaaaagcattgaatcgtttccaaaaagaggatcctacctttcgtgttggcttggatgccgaaagtggacagacaattatttctggaatgggagagctgcacttggacatatatgttgaacgcatcaggagagaatataaggttgacgcaactgttgggaagcctcgtgtaaacttcagggaggctgttacaaaacgtgctgaatttgactatttgcataaaaaacaatctggtggacaaggtcaatatgggcgggttattgggtatatcgagcctcttccactggggtcaccagctaagttcgaatttgaaaatttacttgtcggacaagctataccatcgaattttatcccagcaattgaaaagggttttaaggaagctgccaattcgggttccttaattggacatcccgtggaatatcttcgtgtcgtcttaactgatggtgcatctcatgccgtggattctagtgaacttgcatttaaaatggctgcaatatatgcttttagacagtgctacgctgctgcaaagcctgtgattttagaacctgttatgctggttgagttgaaagtgcccacagaatttcagggtagcgttgctggggatatcaacaagaggaaaggtatgattgttggaaatgatcaagagggagatgactctgtaattactgcgcatgtccctttgaacaatatgtttggatattcaacagcacttcgttcaatgacacaagggaaaggtgaattcacaatggaatataaagaacatgcgccagtttctcaggacgttcagttgcaattggtaaaaactcacaatgctggcaggggagccgaatagttggcgctaagcaacgtccaatgcccctatattttttgtgaccaataagtattcagtcaattgttatataatttacttgaacagacaaaatttagattttttgagaggagacaaacttaagattgatccttctagtggtcaaaaaaactattggaaaaggcaataattgttttttagggggacacgtgtgtgtgcgtataagagagtatgtcctgtatatttttacattgtatggtaggtatcaccggcacagcaagtttttagttgcatgaagttatggtgttacatttaagacttgacaagaaacttgagaatgacagaagagagaacactagaaacgtgcaatgaaaaactcggtacaatgcattagtctcgactctgtttggtcacgaatagacctctaagcagaaaaagcatacgtagaggccagtgtagccaaccgaaatgttttggcccagccgctgagactccagtcccaatcacgtttatttcgagtcatgaaacctttataattccctttggcgccattggaaaagattgatcatcttataaattcttagctgttcatcgtccaaacaaacctatctttcaataatttagctgccaattcattagcagcatccaaccactttcagcttttgaaagcatttagccaaccaaaagaaacaatgatgtgctaagaaaacattagttaaatgcttctcgcagttttgtgggcagctctagatccagctctgattcactaagtggggaaaagtaacgatccaccatgtcttctgacacttgttccaaacttggtggactccactgcataatatagaaccatgaaaacacatattacaccattagtaatacacttatgaaatattagtgtatcatgattcatcagtcgacatattattaatatgacatgtatcacaatctttaaaaaatttaac

SEQ ID NO: 645 - DNA, 2524 bp, Cucumis sativus
aacccctcttttccgtcgccatggccggcttccggagaacctccacaccgcgccttctttattctttttactcttccaccctcacccattcttcatctccatcaccctcctccgctctcctccttgggaatttccacctccgccattcttccagtgctgcccgtgtgaaggaggataaggaaccatggtggaaggaatccatggagaaggtccggaacatcgggatctccgcacatattgactcgggtaagacgacgctgactgagagagttttgtattacacgggtagaatccatgaaatccacgaggttagaggaaaagatggggttggtgctaagatggattctatggatttggagagagagaaggggatcacaattcagtccgctgctacttactgtacttggaatggttatcagattaacattatcgacacccctggtcacgttgatttcacaatcgaggtagaaagagctttgcgtgttcttgatggtgccattctcgtcctttgtagtgttggtggtgtgcagagtcagtctattactgttgatcggcagatgagaagatatgaagttcctaggcttgcatttatcaataaacttgataggatgggtgctgatccgtggaaggttttgaaccaggcaaggtctaaactccggcatcatagtgctgctgtgcaagttccaatcggcttggaagagcaatttaagggtcttgttgaccttgtacaacttaaagcctactattttcttggatccaatggtgagaaagttaccgctgaagaagttcctgcagacatggaagctttagtcacagaaaagaggcgtgaactaattgaaatggtttcagaagtcgatgataaacttgctgaagcatttcttagtgatgaacctatatcacctgaagatctcgaggctgcagttcgaagggctactgttgcacggaagtttatacctgtattcatgggtagtgcatttaaaaacaagggagttcagccacttttagatggagtacttaattatttgccttgtccagttgaagttagcaattatgctttggaccaaacaaagaatgaagagaagattgcactgagtggttctccagatggacggcttgtggcattagcatttaaattggaggaaggtcgttttggtcagctaacttatttgagaatctatgaaggtgtcatcaagaagggcgagttcattgtcaatgtaaacacaggcaagaggattaaggttcctcgcttggtccggatgcattctaatgaaatggaggatattcaagagggacatgcagggcaaatagttgcagtttttggggtagattgtgcatcaggagatacatttacggatgggtcaattaaatacaccatgacttctatgaacgtcccggagccggtgatgtcattggcggtacaaccagtttcaaaagattctggaggacagttctcaaaggctttgaatcggtttcaaaaagaggaccctactttccgtgttggattagatccagagagcgggcagacaataatttcagggatgggtgagttacatttggatatttatgttgaacgcatcaggagagagtacaaggttgatgcaactgttggaaagccacgtgtcaacttcagagagactgtcactcaacgtgctgaatttgattatttacataaaaaacagacaggaggccaagggcagtatggacgagtatgtggatatattgaaccacttcctcctggatcaacagctaaatttgagtttgagaacataattgtaggacaagctataccgtcaaattttatcccagcaatcgagaagggttttagggaagctgccaactctggttccttgattgggcatcctgttgagaacgttcgtgttaccttgactgatggtgcttctcacgctgttgattccagcgaacttgcatttaagttggctgctatatatgcatttagaaagtgttatacagctgctaggccggtgatattggagcctgttatgctggtagaagtaaaagtacctacagaatttcaaggcactgttggtggtgacatcaacaagcgaaaaggtattattgttggaaatgaccaggatggagacgactctataattacggcacatgttccgttaaataacatgtttgggtactcgacatctctccgctcgatgactcagggcaaaggagagttcaccatggagtacaaagagcattcaccagtttctaatgatgtccaaatgcaattagtaagcaactacaaaggcagcaagccagctgagtagactacttggatacatttgggtgtgttgtttcttgtcatatccaaagatacgtaagcctattgttttcatttattattttgtctgatgataggcaataaattttgaatcaactaaatagaataataactcttttattattttttcctcactagaatccttgcccttatcttgtgtcatggcatgaagtggcttgtaatagttattgaatcaaaatatatatatggggtcttcctttgagcttt

SEQ ID NO: 646 - DNA, 2629 bp, Amsonia hubrichtii
cttcactcagtttccactctccacgcggactgggttaccaaacctaaacgatcccatggcttggagatcacgatcctctgcgacgcggttattgtacagtctttgctcgaggacgaaagcaactcccgaatgtacacagaaaggctcaagcgcggctttattggccgggaacttccacctccgctacttctccgccagcagcgcggctgctagattgagggaagagaaggaggtagcgtggaaggaatcaatgtcaaagcttcgaaatattggaatttcggctcatattgactccggtaagaccaccctgactgagagggttctgtactatactggccggattcacgagattcacgaggtccgtgggaaagatggagttggggcgaaaatggattcaatggatttagagagagaaaaagggatcactatacagtccgctgcaacttactgtacttggagagattatcaggtgaatattattgacacaccggggcacgttgacttcaccattgaagttgagagggctttgcgtgtccttgatggtgccattcttgtactctgtagtgttggtggtgtacagagtcagtcaattactgttgacaggcaaatgagaagatatgaggttccaagacttgctttcattaacaagctagatcgaatgggggcagatccatggaaagttcttgatcaggcaagaaccaagcttcgacatcatagtgctgctgtgcaagttccaattggtctggaagatgaatttcagggtcttgttgatcttgtgcaattaaaagcttactattttcatggttccagtggggagaatgtggtcattgaagaagttcctgcggacatggaagatctagtcacacaaaaacgaaagagctcattgaagcaatttctgaggtcgatgaacaacttgctgaatcatacatcaatgacgagccgatatcatcgactgatcttgaggaggcgatcaggagagctactatagcacgaaagtttgtgcctgttttcatgggtagtgcattcaaaaacaagggagttcaacctcttcttgatggtgttcttagttatttgccgtgtccaacagaagttaataactatgcacttgatcaaacaaagaatgaagaaaagatcatgttatctggtaacccgtcaggaccattggttgctttggctttcaaattggaagaaggtcgttttggtcaattaacatatttaaggatttatgaaggtgtcattcggaagggtgattttatgatcaacgtaaacacaggcaagaagattaaggttcctcgtctcgttcggatgcatgctgatgaaatggaggacattcaagaggctcatgctggacaaataattgctgtatttggtgtagattgtgcctcaggagatacatttactgatggatcagtcaaatacaccatgacgtctatgaatgttcccgagccagtgatgtccttagctctttcaccagtttcgaaagattctggagggcaattttcaaaagcactgaatcgctttcagaaagaagatcccacttttcgtgttggtttagatccggagagtggccagacaattatttctggaatgggggaattgcatttggacatatacgttgaacgcatacgaagagaatataaggttgatgcaactgttggtaaacctcgtgtcaacttcagagagactattactcaaagggcccaatttgattatttgcataagaaacaaagtggaggacagggtcagtatggaagggtaattgggtatgtggagccacttccaccagggtcgtcaaccaagtttgaatttgataacatgattgttggacaaaatattccatcaggttttatcccagcaattgagaagggctttaaagaagctgccaactccggttctttaattggccatccagtagaaaatattcgtatcgttttgactgacggtgcatcccatgctgtagattcaagtgaacttgcattcaagttagctgcaatatatgctttccgacagtgctataccacagcaaaacctgttatattggaacctataatgctggtggaattgaaagtaccaatggaattccagggaactgtaaccggtgatatcaataagaggaaaggcatgattgttgggaatgaccaggacggggatgactctgttattactgcgaatgtccctctcaataatatgtttggatactcaacagctcttcgttcaatgacccaggggaaaggtgaattcacaatggaatacgttgaacattcgccagtcccgcaggatgttcagacacaactgattaatgcatacaaggccactaagggaactgcataattggtgtctttttgaagcataactcctcgatatactatttttgtaaagatcaattgtatcatttaattccttattcatatccttagggaccaaaagtggtcaatcaattttgaaaagctcgaataaaagtttgtactaataatactaatatagatgcctcaattcgcttgtttggagtaggtgggatattggagtttggatgagattttctgtcacttgttggagacttgaagagagcctacgggcggctaaaaggccttaagatgcagttaatacaaaaatctttcttcttgtaccg

SEQ ID NO: 647 - DNA, 2511 bp, Populus trichocarpa
tcgggaatcaatccaccaccatgacccgattccaaaatggatcacgcctcctctcctacaccttctcccgctccaaaacgaagtcctcagtgtctccaaccaccgctctcctccagggcaacttccaaatccagcactcccgccacttctccaacctcgcaagcgccaccacaaaagaagaaaaggagccatggtggaaggactcgatggaccgattaagaaatattggtatctcagctcatatcgattccggtaaaaccacactcactgaacgcatactgttttacactggtcgaattcacgagattcatgaggttcgcggccgtgatggcgttggggccaagatggattccatggatttggagagagagaaagggatcactattcaatccgctgctacttactgcacttggaatggatatcaggtgaatataattgatacaccaggacatgtggattttacaatagaggtggagagggcactgagagtgttggatggtgcaattctggttttgtgtagtgtgggcggagtgcaaagtcagtctattactgtggataggcaaatgaggagatacgaggtgcctaggcttgcttttattaataaacttgatcgaatgggagctgatccttggaaagttttgaaccaggcaaggtctaaactaagacatcatagtgcagcagttcaagttccaattgggttggaagaggattttcaaggccttatcgatcttgtaaaaatgaaagcttattatttccatggctcaaatggtgaaaaaattgtcactgcagaaataccagttgagattgaggccttggctgcagaaaaacggcgtgaactaatagaaacagtttctgaagttgatgataaacttgcagatgcttttctcgcagatgaatctatttcaacctctgaccttgaggaggcaattcgcagggctactgtagcaaagaaatttgttcctgtattcatgggcagtgcattcaagaacaagggagtgcagccacttttagatggtgtacttagctatttgccttgtccccttgaagttagtaactatgctcttgaccaaaccaaggatgaagagaaggttgtcttgtctggaactccagatggaccacttgtggcattggcttttaaattagaagaagggcgttttggtcagttgacatatctaagaatctatgagggtgtaattcgcaagggtgattttatagttaatgttaacacaggcaagaagatcaaggttcctcgcttggttcggatgcactctaatgaaatggaggacattcaagaggcacatgttgggcaaatagttgctgtatttggtgttgattgtgcttcaggtgatactttcacagatggatcagttagatacactatgacatctatgaatgtccctgagccagttatgtcactggccattcaaccagtttcaaaagactccggaggacaattttcaaaagctttgaatcgttttcagaaagaggatcccactttccgtgttggcttggatcctgagagtgctcagaccataatttctggaatgggagagttgcatttggacatatatgtggaacggattaggagagagtacaaggttgatgcaagtgttgggaaacctcgtgtgaacttcagggaaaccattactcagcgtgctgaatttgattatttacataagaagcaaagtggagggcaaggacaatatggacgagtatgcgggtacattgagccaattccacaagggtcaatgactaagttcgagtttgataacatgatcgtgggacaggttataccatcaaattttattcctgcaattgagaagggcttcaaagaagctgccaattctggttctttaatagggcacccggtagaaaatcttcgaattgctttgactgatggtgttgcccatgctgtggattctagcgaacttgcatttaaattagcagcaatatatgcttttagacagtgttacgttgctgcaaaacctgtgatactggaacctgtaatgctggtggaactgaaagtaccaacagagtttcagggtacagttgcaggtgacattaacaagaggaaaggtgtgatagttggaaatgaccaggatggggatgactctataataacagcccatgtgcctttgaacaatatgtttggttactcgactgctctacgttcaatgacgcaggggaaaggggaattcacaatggaatataaagaacattcagctgtctctcaggatgtgcaaatgcaattggtaaacacctacaaggccagcaagacagctgaataggagaagatttccataaaatcatatgcccctgtagtccttacacaagccccatggggtttttgtatttttttgatgaccaagtctactgttatagtaatattcatctagttcgatcagatttggatcaatcagttttggaatatgccgtggggcactttcttcaatattcttgttataataatgtttattgtattattttattaatgagttaagattttaaaga

SEQ ID NO: 648 - DNA, 2574 bp, Aquilegia formosa
gagagaagaagaagatttgagaaatcgaagaagatgatggcgagaagagcaacaagatcttctgcaactcgattgctctacgcatctttatgttctgaaaacacaattacattgacttcatcatcatcatcttcttcttcacctttcgctcttctcattttcgaaaatggccaacgacgacgtaatttctcagctagtaatttagctagagcaaagagtgataaagaagcttggtggaaagatgcaatggaaaaacttcgaaatattggaatttcagcacatattgattcagggaaaacaacacttactgaaagagttttgttttatactggtagaattcatgaaattcatgaagttagaggtagagatggtgttggtgctaagatggattctatggatttggaaagagaaaaaggaattacgattcaatctgctgcaacttattgtacttggaaagattatcaggttaatataattgacactcccggccacgttgatttcacgattgaagttgaaagagctttgcgtgtgttagatggtgccatacttgtcctatgtagtgtcggtggggtgcaaagtcagtcaattactgttgatcggcaaatgagaagatatggtgttcctagacttgcatttatcaacaaacttgatcgaatgggagcagatccatggaaagttcttaatcaggcaagggctaagctccggcatcacagtgcagcagtgcaaattccaatcggtttagaagagcactttcagggtcttatagaccttgtacacttaaaagcttattactttcatgggtccagtggtgaaacgattgtcacttcagatattcctgcggatatggagcctatggctacagaaaagcggcgtgaacttatagaaacagtgtccgaggttgacgatcaacttgctgaggctttcctaggcgatgagcctatatcacccagtgatcttgatatggcaattcgcagagctacaatagcacaaaagtttgtacctgtattcatgggtagtgctttcaaaaacaagggtgtacaacccctgttagatggggtaatcagctatttgccatgtccaactgaagttagtaaccatgctcttgaccaaaccaaagatgaggagaaggttgtgttatcgggtactccagctggacctctcgttgcattggcttttaaattggaagaaggacgttttggccagttgacatttttaagaatctatgaaggcatcatccgaaagggtgattttataatcaacgtgaacactggaaagaaacttaaggttcctcgcttggttcgtatgcattctaacgatatggaggacattcaagaggcacatgcagggcaaattgttgcagtatttggtgtggactgtgcatcgggagatacgtttaccgatggatctgtcaagtacaccatgacttcgatgaatgtcccagagccagtgatgtctttagctgtctcacccgtatccaaagatgctggaggacaattctcaaaagctttgaatcgctttcagagagaggatccaactttccgtgttggcttggatcctgagagtggccagactattatatctggaatgggagagctgcatctggacatctatgttgaacgcatccgcagggagtataaggttgatgcaactgttgggaagcctcgcgttaacttcagagagactgttacgaagcgcgctgaatttgattatttacataaaaagcaaagtggtggacaaggtcaatatggacgggtatgcgggtatattgagccattgccaccagggtcacccattaagtttgagtttgataacatgattatagggcaggctataccatcgaacttcatcccagctattgagaaaggtttcaaagaagcaagcaactcggggcaattgatagggcatcctgttgaaaatgtgcgtattgttttgactgatggtgcatcacacgctgtggattcgagtgaactggcctttaaattagcagcaatatatgcattcagacagtgttatttaacagcaaagcctgtaatattggaacctgtgatgctggtggagttgaaggtaccaacagaattccagggtaccgttactggagatatcaataagagaaaaggtgtgattgtagggaatgaccaggatggagatgattctgtaatcacaacacatgtccctctgaacaatatgtttggttactccacggctcttcgttcaatgacacaggggaaaggtgagtttacgatggaatacaaggagcactctgcagtttctcaagatgtacagacacagcttgtaaacacttaccaggccaccaaaggagctgagtaaaatccagggattcatttgaaggagcggattccgcagtgtatgggcccatgtaacgttctagtctaacttataattatcatcatttttgagaactttttcttactttttcatttcgtcacatttcattaaatattacatagtcatgtgaataataaacagcaatcatgcatgttgctgtccacaaatttaggcatacacgaataatataaatccttattcttttgccagtatggctgggtatcttct

SEQ ID NO: 649 - DNA, 2680 bp, Eucalyptus grandis
gccgccgcctccgccatggcgcggctctcgaaatcgtcggcgtcgcgcctcctctacacgctctgcgcctcgcctcccctctcctcgccgtcggccgcgcaccacctccaatcgccgctcgcgtcgctgctcctctgcggctcccgcctccggcacttctcgacggggaacctcgcccgggcggcggcggcggcggcgaaggacgacaaggagccgtggtggaaggagaatttggacaagctccgcaacatcgggatctctgcccacatcgactccggcaagacgaccctcaccgagaggattctcttctacactggcaagatccatgagatccacgaggtccgagggagggatgggatcggcgcgacgatggactcgatggatttggaaagggagaaggggatcaccatccagtccgccgccacttactgcacttggaaggggtatcaggttaacattattgacacacctgggcatgttgactttacgatagaggtggagagggctttacgtgttctcgatggggctattcttgtcctttgtagtgttggtggcgtacaaagtcaatctataactgttgaccgtcaaatgagaagatatgaagttcccagagttgcatttataaataaacttgatcgaatgggagcagatccttggaaagttcttaaccaggcaaggtctaaacttcgacaccatagcgctgctgttcaagttccaattggtttggaagaagaatttcagggtcttgttgacctagtacagttgaaagcctattattttcatggttccaatggtgaaaatgttgtcactgctgaggtacctgccaatatggaaaatctggtcacagaaaagaggcgtgaactaattgagatggtttcggaagttgatgataaacttgccgaagcatttatcagtgatgagcctatatcatctgctgatcttgaggaagccatacgcagggccaccatagcaaaaaaatttgtacctgttttcatgggtagtgcattcaaaaataagggagttcaacctcttttggatggtgtcctcagttatttgccctgtccaattgaagtcagtaattatgctcttgatcaaaacaagcaggaagaaaaggttgcgttgactggaactccagatggaccattagtagcattggccttcaaattggaggaagggcgatttggtcagttaacatatttaagaatttacgagggtgtcattcgaaagggggactttgtcatcaatgtaaacactggaaagaagttgaaggttcctcgcctcggacggatgcattctaatgagatggaggatattccagaggcacatgccgggcaaattgttgctgtttttggaatggattgtgcctcaggcgatacattcactgatgggaaagttaaatacaccatgacctccatgaatgtgcctgatccggtgatgtccttggctgtttccccagtttcaaaagattctgggggccaattttcaaaagctttgaaccgtttccaaagggaggatcctaccttccgcgtgggtttggatgctgagagtgggcagaccatcatatctggtatgggagagttgcatttggaggtatacgttgaacgaattcgcagggagtacaaggtagaggcaactgtcggaaagcctcgtgtgaatttcagagaaactgttacacagcgtgctgaatttgattacttgcataagaaacaaactggaggacagggtcaatatggtagagtatgtgggtatgttgaacctcttccagaagggtcgccggtaaagtttgaatttgaaaacatgattgttgggcaggccataccttccaattttatccctgcaattgagaaaggcttcaaagaagctgccaactcggggtcattgattggtcatcctgttgaaaatattcgcattgttctgactgatggtgcttcacataatgtggattctagtgagctggcttttaagttggccgccatctatgcatttagacagtgctattcagcttcaaaacctgtaatcttggaaccgataatgctggtggagttaaaagttccaacagagtttcagggaactgttgctggtgatatcaataagaggaaaggtataatcgtaggcaatgaccaggatggagatgaaacagtaattgtggctcaggtccctctgaacaatatgtttggctactccacttctcttcgttcaatgacacagggcaaaggcgagttcacaatggaatacaaggaacattcagctgtctctcaggatgtgcaaatgcagttggtaaatgcacacaaggctagtaaggctgaatagctttgggataaataatcccaatacccattctgtgaggatcaaaatgtctatttattctttttcctttacgtcgtgtaatattctttgttcaagaagagagatatgttagtaatgtaccacaggtgatccggttgtgtgatcagataaattttgtaaactcaaataatctccatgtattgataataacatacacatgctcgccctcgcgaagtaggcgatggagcacccatatattttccaatcccttacgttatgaatgcgtcgatgggttagttatgcgtgtacgtgcgcaatgtttctctgaagacatcttttgctggagcatttataaggtaacaagacaggaactctcctgctacttttttcccct

SEQ ID NO: 650 - DNA, 2727 bp, Citrullus lanatus
gggaacacattaatccccatcgtcgaacggcaaattaaaagagaagaacgaagacagttcagcagtgaagttccacaagaacataaagtaaatacgaagggtttagggtttagccctccaaacccccgtttccatcgccatggccggcttccggagaacctccacaccgcgccttctctattctttctattcctctaccctctctcattccaacctctcttcgtctccctcacccgccaccgctctcctccttgggaatttccacctccgccactcttccagtgcggctcgtgtgaaggaggataaggagccatggtggaaggaatccatggagaagctccgcaacatcgggatctctgcgcatattgattcgggcaagacgacgctgactgagagagttctgtattacacgggtagaatccatgaaatccatgaggttagaggaaaagatggggttggtgccaagatggactctatggatttagagagagagaaggggatcacaattcagtccgctgctacttactgtacttggaatggttaccagattaacattattgacacccctggtcacgttgatttcacaatcgaggtagaaagagctttgcgtgttcttgatggtgccattctcgtcctttgtagtgttggtggtgtgcagagtcagtctattactgtcgatcggcagatgagaagatatgaggttcctaggcttgcgtttattaataaacttgataggatgggtgctgatccgtggaaggtcttgaaccaggcaaggtctaaactccggcatcatagtgctgctgtgcaagttccaatcggcttagaagaggaatttaagggtcttgttgaccttgtacaactcaaagcttactattttcatggttccaatggtgagaaatttaccactgaagaagttcctgcagacatggaagctttagtcacagaaaagaggcgtgaactaattgaaatggtttcagaagtcgatgataaacttgctgaagcatttcttagtgatgaacctatatcacctgcagatcttgaggctgcagttcggagggctactgttgcacggaagtttatacctgtattcatgggtagtgcatttaaaaacaagggagttcaaccacttctaaatggagtgcttagttacttaccttgtccaattgaagttagcaattatgctttggaccaaacaaaaaatgaagagaagattacattgagtggtactccagatggacggcttgtggcattagcatttaagttggaggagggtcgttttggtcagttgacatatttgagaatctatgaaggtgtcataaagaagggagaattcattgtcaatgtaaacacaggcaagaagattaaggttcctcgcttggtccgaatgcattcggatgagatggaggatattcaagaggcacatgctgggcaaatagttgcagtttttggggtggactgtgcatcaggagatacatttacggatgggtcagttaaatacaccatgacctctatgaatgtccctgagccagtgatgtcattggcggtacaaccggtttcaaaagattctggtggacagttctcaaaggcattgaatcggtttcaaaaagaggaccctactttccgtgttggattagatccagagagtgggcagacaataatttcagggatgggagagttgcatttggatatttatgttgagcgcattaggagagagtacaaggttgacgcaactgttggaaagcctcgtgtgaacttcagagagactgtcactcaacgtgctgaatttgattatttacataaaaaacagacgggaggccaagggcagtatggacgagtatgtggatatattgaacctcttcctcatggatcgtcgactaaatttgagtttgagaacataattgttggacaagctataccggcaaattttatcccagcaatcgagaagggttttagggaagctgccaactctggctcattaattgggcatcctgtcgagaaccttcgtgttatcttgactgatggtgcttctcacgctgttgattctagcgaacttgcatttaagttggctgcaatatatgcattcagacagtgttatgcagctgcaagaccggtgatattggagcctgttatgctggtagaagttaaagtacctacagaatttcagggcaccgttggtggtgatatcaacaagcgaaaaggtgttattgttggaaatgaccaggatggagatgactctataattactgcacatgttccgctaaataatatgtttggatactcgacatctctccgttcgatgactcagggtaaaggagagttcaccatggagtacaaagagcatttgccagtttctaatgatgtccaaatgcaattaataagcaactacaaaggcagcaatccagccgagtagagtagttggatacattttggtatgttgtttctggtcacagccaaaatataaaaggtttttcttttaatttattattattgttattatttgtctgatgataggcaataaattttgatacagccaagtagaataatggtactttttttttttttttaaaaaaaaatttattattattatttaaaaaaatatagaatacttgccattgtcttgtgttatggcataaagtggcttgtaatagttattgaatcaaaatatataaggtcttccttagagcttttgtacttaattttgaaggtgacagttataacatttggata

SEQ ID NO: 651 - DNA, 2724 bp, Prunus persica
actgcgagacagcagagagggcagtgtgccaaagggttcagggttttacgtcaaaccccccaaaagccctaaaaccggacaccacaaccatggcgcgcttctctcgaccctccacaccacgcctcctctacaccctctacaccagcccatccaaaacggtacagtctccttctccatccccatctccctctccatcaccagcctcctctctcctcctcggctctttccacttccgccaattctcttccggcaatctcgcacgtgccaaggaggacaaagagccatggtggaaggactccatggacaagctccgaaacatcggaatatcggcccacatagactccggcaagaccaccctcaccgagagagttctgttttacactgggaagatccatgagattcatgaggttagaggcagagatggagttggcgcgaaaatggattccatggatttggaaagagagaaggggattaccattcagtctgctgccacttattgtacttggaatggctatcaggttaacataatagacacccctggtcacgttgatttcaccattgaggttgagagagctttgcgtgttcttgatggtgccattcttgtcctttgtagtgttggtggtgtgcaaagtcagtcaattactgttgatcgacaaatgagaagatatgaggttccaagacttgcatttataaacaaacttgaccgtatgggagcagatccgtggaaagttctgaaccaggcaagggctaagctccggcatcacagtgctgccatgcaagttccaattgggttggaagaagattttaagggtcttgttgaccttgtgcagatgaaagctttgtattttcatggttccagtggtgaaaaaatcgttattgaagaagttcctgctgatatggaggcattagtcacagaaaagaggcgtgagctaattgaggttgtatctgaagttgatgacaaactagctgaagcatttcttgctgatgaacctatatcgtccactgatcttgaggaagctgtgcggagggctactatagcacagaaattcatacctgtgttcatgggtagtgcatttaaaaacaagggtgtacagccacttttgaatgctgtacttagttatttgccctgtccaattgaagtcagtaactatgctcttgaccagactaagaatgaagagaaggttgcattgggtggaactccagatgggcctcttgtagcactggctttcaaattggaggaagggcgttttggtcagttaacatatctaagaatctatgaaggtgtcattcggaagggtgattttattttcaacattaacactggtaagaagattaaggtccctcgcttggtccggatgcattcagatgagatggaggatattcaagaagcacatgctgggcaaatcgttgctgtatttggtgtagactgtgcatcaggagatacatttactgatgggtcagttaaatatacaatgacttctatgaatgtccctgagccagtgatgtcattagctgttcaaccagtttcaaaagattctggaggacaattttcgaaggctttgaatcgttttcagaaagaggatcctacattccgtgttggcttggaccctgagagtggacagacaatcatctctggaatgggagagctgcatttggacatttatgttgaacgcattcggagagaatataaggttgatgccactgttggaaaacctcgtgtaaacttcagagagactgttactcaacgggctgaatttgattatttacataagaagcaatctggaggacaaggtcaatatgggcgggtatgtggatatgttgaaccgctgcctgccgggtcaccaaccaagtttgaatttgaaaacatgattgtgggacaagctataccatcaaattttatcccagctattgagaagggtttcaaagaagcagccaattcgggttccttaattggacatccagttgaacacgttcatgttgttttaaccgatggcgctgcccatgctgtggattccagtgaacttgcctttaaattagctgcaatatatgcatttagaaagtgctatgcggctgcaaaaccagtgatattggagcctgttatgctcgttgagttgaaagtacctatggagtttcagggaactgtagcgggtgatattaataagaggaaaggtgttattattggaaatgaccaggagggagatgactctgttattactgcccatgttcctctgaacaatatgtttgggtattcaactgcccttcgatcaatgacacagggaaaaggtgaattcacaatggagtacaaagagcactcgccggtttctcacgacgtgcaaacgcaattgataaacaattacaagggcacccatgctgctgaatagcacacgatgtccagacacagttgataaacaattacaagggcagcagtgctgctgaatagcatgtgtttcgtcgaatgcatttgctccttttttaagttgctggagtccaatatgtttgttataatgttaaaattttggaactttaatattattaattcttttaggaaaagagtaatctgtgttacatgatccataattttgaaaagcaccaataaaactcaaattgcctattaagggctgagatgatgtatcactttctcctgaactgtgtatcatatagtttcctttcattattttgggctgaatacttgtactgtaccattattataaaaagataaagggt

SEQ ID NO: 652 - DNA, 2478 bp, Euphorbia peplus
tttccaccaccgccatgttccgatcaagaggatactccacctcccgtctcctcttctccgccgccgccaactcaccatctccgccttccaattcccccgccgcctccctcctcctcggcaacttccacctccgccacttctccaacgccgcccgcgtcaaggaagacaaggagccatggtggaaggaatccatggaacgtgttcggaatattggaatttcagctcacatcgattccggcaagacgactctcaccgagcgcatcctctactacaccggtcgcatccacgagatccacgaggtccgcggccgcgatggagtcggagctaagatggattctatggacctcgagagagaaaaagggatcactattcagtccgccgctacgtactgtacttggaaggactatcaggtgaatataattgatacaccggggcacgttgattttacaattgaggtggagagggcgttgcgtgtgctggatggagcaattcttgtgctgtgtagtgttggtggagttcagagtcagtctattactgtggataggcaaatgaggagatatgaagttccgagagttgcgtttattaataaacttgatcgaatgggagctgatccatggaaagttttgaaccaagcaagatctaaattgaggcatcacagtgcagctgtgcaagtcccaattgggttggaggaagactttaaaggcctaattgatcttgtgaagatgaaagcatactattttcatggttctagtggtgaaaatattgtgactgaagaaattccagctgatatggaagccattgttgcagaaaaacgacatgaacttatagaagcaatttctgaagttgatgatcaacttgccgatgcttttctcgcggatgagcctatttcatcaactgatcttgaggatgcaattcgcagggctacagtagcacaaaaatttattccagtattcatgggtagtgcattcaaaaacaagggagtgcaaccgcttttggatggtgtgcttagttatttgccttgtcctattgaagttagtaactatgctcttaaccaatccaaagatgaagagaaggtcttgttaactggatctccagatggacggcttgtggccttggcttttaaattagaagaggggcgttatggtcaattgacttacctaaggatttatgaaggtgtcattcgcaagggtgattttatcgttaacattaacacaggcaagaagcttaagattcctcgcttggttcggatgcattccaatgatatggaggacattcaagaggcacatgctggacaaatcgtagctgtttttggtgtggaatgcgcttcaggagatacttttacggatggttcaatcagatacactatgacatctatgaatgtacctgaaccagtaatgtcattagctgttcaacctgtttcaaaagacgctggtggacaattttcaaaagctttgagtcgttttcaaagagaggatccaacattccgtgttggtttggatcctgagagtgggcagacaattatttctggaatgggagagttgcatttggacatatatgtggaacgcatacggagagagtacaaggttgatgcaactgttgggaaacctcgtgtgaactttagagaaactgttaccaggcgtgcagaatttgattatttacataagaaacaaagtggaggacaaggtcaatatggacgagtaattgggttcattgagccacttcccgaaggctcaacaaccaaatttgagtttgacaatatgatagttggacaagctataccatcagggtttattccagcaattgagaagggatttagagaagctgctaattcgggttctttaattgggcatccagttgaaaacgtccgcattgctttaatagatggtgctgcccatacagtggattctagtgaacttgcatttaaattggcatcaatatatgcttttcgacagtgctactcagctgcaaaaccaactatattggaaccaatcatgttggtggagctgaaagtaccaacagaatttcagggcacagttgctggtgatcttaacaagaggaaaggagtgattgttggaaatgaccaggaaggggatgactctgtaattactgctcatgtacctctaaataatatgttcgggtactcgacttctctacgttcaatgacacagggaaaaggtgaattcaccatggaatacaaagagcattcagcagtttcacaggatgtgcaagcgcaactggtaaatgcctacaccgcaagcaagggtactgaatagatggggattttggaaccctcggcaggccccggaattatttataggtaatattagtcataattttttctcctcaaaatatagatacttcaatgttattgagaataattaagttttgattatttgatatagactatttgaggataataattgaaattgcctagacatgtaaattaacatttgttaccactcataagtcactaggctt

SEQ ID NO: 653 - DNA, 2295 bp, Manihot esculenta
cacctccgccatggctccatttcacagaggatccgccacatcgcgcctcctcttctccttttattctgccaccgcgaaagcgacagcgacagctccgtcttctcattccccgaccactgcccttctcctcggacacttccgagtccaccaatactccaacctcgctcgcgccaaggaagagaaggagccatggtggaaggagtccatggaacgccttcggaacatcggaatctcagctcacatcgactcaggcaagaccactctcaccgagcgcatcctctactacactggtcgtatccatgagatccacgaggtccgcggccgcgatggagtcggcgccaagatggattcgatggacttagaaagagaaaagggcattactatccagtccgccgccacatactgtacttggaatggctatcagataaacataattgatacaccggggcacgttgactttaccatagaggtggagagggctttgcgagtgctggatggtgcaattcttgtgctttgtagtgtgggtggagtgcagagtcagtctataacggtggataggcaaatgaggagatatgaggtccctcgacttgcctttattaacaaacttgatcgaatgggggctgatccatggaaggttctcaaccaggcaaggtctaaactgaggcatcacagtgcagctgttcaggttccaattggtttggaggatgattttcaaggccttattgatcttgtgaagttgaaaacttattatttccaaggctccaatggtgaaaaggttgttgctgaggaagtgccagctaatatggaggccatagttgctgaaaaacgacgtgaacttatagaagttgtttctgaagttgacgataaactcgcagatgcttttctttcagatgagcctatttcatctgctgatcttgcggaggcaattcgcagggctactgtagcaaagaaatttattcctgtattcatgggaagcgcattcaagaacaagggggtgcaaccactcctggatggtgtgcttagttatttgccttgtcctactgaagttggtaactatgctcttgaccaatctaaaaatgaagagaaggtcttgttgggaggaaatccagatggaaaactcgttgcattggcttttaaattagaggaagggcgttttggtcagttgacatttctaagaatatatgagggtgtaattcgcaagggtgattttattgtgaacataaacacaggcaagaagattaaggttcctcgcttggttcggatgcattctgatgaaatggaggacattcaagaggcacatgctgggcaaatagttgcagtatttggtgtggattgtgcttcaggagatacttttacggatggatcaattagatacactatgacatccatgaatgtccctgagccagttatgtcattagctgttcaacctgtttcaaaagactcagggggccaattttcgaaagctttgaatcgttttcagaaagaggatcctactttccgtgttggtttggatcctgaaagtggacagacaattatttctggcatgggggagctgcatctagacatatatgtggagcgcattcggagagaatacaaggtcgatgcaactgttggaaaacctcgtgtgaactttagagaaactgttactcagcgtgcagaatttgattatttgcataagaagcaaactggaggccaaggccaatatggaagagtaattgggttcattgagccacttccagcagactcaccaaccaaattcctcttcgaaaacatgatggttggacaagctataccatcaggttttattcctgcaattgagaagggcttcaaagaagctgccaattcgggttccttaattgggcatccagttgaaaatgtccgtattgttttaacagatggtgcttcccatgctgtggattctagtgaacttgcttttaagttagcatcaatatatgcctttagacagtgctatgcagctgcaaggcctgttatattggaacctataatgttggtggaactgaaagtaccaacagagtttcagggtactgtagctggtgatattaacaagaggaaaggtgtgatagttggaaatgaccaggatggtgatgactctgtaataactgcccatgttcctctaaacaatatgtttgggtactcgacatctcttcgttccatgacacagggaaaaggtgaatttacaatggaatacaaagagcattcgcctgtatcacaagatgtgcagatgcaattggtgaacacatacaaggccaacaaggctgctgaataaatggggat

SEQ ID NO: 654 - DNA, 2673 bp, Fragaria vesca
ccaccaccgccacaaccgccatgccgcgcttcccgcgcttcgccaccacacgcctcctctactccctccacgcctccaaaacgacgccgtccccttccccttcctcctcctcgctcctcctcggctcgttccacctccgccaattctccgccggcaacagcctcgcgcgcgccaaggacgacaaggacgtatggtggacggaggtcatggcgaagctccgcaacatcggaatctcggcgcatatcgactccggcaagacgactctcaccgagaggattctatactacaccggaaagatccacgagattcacgaggtccggggacgcgacggcgtcggcgctaaaatggactccatggatttggagcgggagaagggaattaccattcagtctgcggcgacttactgtacttggaatggttatcagattaacataattgacacccctggtcacgttgatttcaccattgaggttgagagagctttgcgtgttcttgatggagccatccttgtcctttgtagcgttggtggtgtacagagtcagtcaattactgttgatcggcaaatgaaaagatatgaggttccaagaatagcatttataaacaaacttgatcgaatgggagcagatccatggaaagttttgaatcagatgaggtcgaagctccggcatcatgctgctgcattgcaacttcctattgggttggaagatgattttaagggtctcattgatcttgtgcagttaaaagcgttgtattttcacgggtctagcggtcaggaaattgtcattgaagatattccttctgatatggaggtgttagtcgcagaaaaaaggcgtgagctaattgaaattgtatccgaagttgatgaccaacttgctgaagcatttcttgaagatgtgcctattacatctactgatctggaggaagctatacgaagggctaccattgcaaggaaatttatacctgtgttcatgggcagtgcatttaaaaacaagggtgtacaaccacttttgaatggcgtacttggttatttgccttgtccaactgaagtcagtaactatgctcttgaccagactaaggatgaagagaaggttatattaggtggaactccagatggacctcttgtagcattagcctttaaattggaggaagggcgttttggtcagttaacctttctaagaatctatgaaggtgttatacggaagggtgatttcatttttaacattaacactggcaagaagcttaaggttcctcgcttggtccggatgcattccgatgagatggaggatattcaagaggcgcatgctgggcaaatagttgctgtatttggtgtggattgtgcatcaggagatacatttactgatggttcagttaaatataccatgacttctatgaatgtccctgagccagtgatgtcattagcagttcagccagtttcaaaagattcaggaggccaattttcaaaggctttaaatcgttttcagaaagaagatcctaccttccgagttggcttggaccgtgagagtggacagacaatcatatcgggaatgggagagctgcatttggaagtttatgttgaacgcattcggagagaatataaggttgatgcaactgttggaaagcctcgtgtaaacttcagagagactgttactcaacgtgccgactttgattatttacataaaaagcaatctggaggacagggtcaatatgggcgagtaactggatttatcgaaccactgcctgcaggatcaatcacaaagtttgaatttgaaaacagtattgtgggacaagctataccatcaaattttatcccagccattgagaagggtttcaaagaagcagccaattcgggctcattaattggccatccagttgaaaatgttcgcattgttttaactgatggtgcttcccatgctgtggattctagtgaacttgccttcaaattagctgcaatatatgcctttagaaagtgctatacggtagcaaagccggtgatactggagcctgttatgttggtggagttgaaagtacctacagaatttcagggtactgttgctggtgatattaacaagaggaaaggtgttattattggaaacgatcaggagggggatgactctgttattacagcccaagtccctttgaacaatatgtttggctattccacatctcttcgatcgatgacacagggaaaaggtgaattcacaatggagtacaaagagcattctcccgtttctcatgatgtgcaggcgcagttagtaaacaactacaagggacctaatgccactgaatagtctggctatatgcttcgtcaaaagcattgctcttttttgtctcgcctgattctaatgtatttgtcatatcatattcttctggacttcacggttgttaaattcttcataggaagaagggtcatgtatttaacatgatctataattttgaaaagcgccaataaagtctaattcaaccctttcaggctgagatgaaaatgtattaaactgtactctcttgaactgtgtatcatgtagttgaagtcttctacaccagttttgctgattaggaactagatggtgttacgttgttgcagtgttgtacgtaattgcgtagcaaatcatatattgattttgtcgctttgcccaactccaaaagtaaggatattttggtaccaccaaattgcta

SEQ ID NO: 655 - DNA, 2566 bp, Solanum lycopersicum
ttaagaaaaaagcctctgaaacatttcttccacgccggagcaaatttccacagggtttaaccaaaaaccctaaaccccccatggctcgatcagctagatcctctacgacgcgcctattctactccctatgttcctcaaccaaaaggacgccgttgactcctcaacacccaccgccaaccccagtcgccgccttattggccggaaacttccagctgcgccactacgccgccagtagtgccaccgctagagtgagagaggagaaagatgcggtatggagggagtcgctagaaaaagtacggaatattgggatttcagctcatattgactccggtaagactacactgacagagagggtattgttttatactggccggatccatgagatccatgaagttaggggtaaagatggagttggtgcaaagatggattccatggatttagaaagagaaaaagggattactatacagtctgctgctacttactgcacttggaaggactaccaggtgaacataatagacacaccaggtcatgttgatttcacaattgaggtggaaagagctttgcgtgtccttgatggagccattcttgtcctttgtagtgttggtggtgtgcaaagtcaatctatcactgttgataggcaaatgagaagatatgaagtcccaagacttgcttttattaataaacttgatcggatgggggcagacccttggaaagttcttaaccaggcaagagcaaagcttcggcatcacagtgctgctgtgcaagttcctattgggttagaagatgacttcaagggtcttattgatctcgtgcagtcaaaagcttactatttccatggttccaatggtgagaagattgtcgcagaagatattcctgctgatatggaagcaattgcttctgagaagcggcgagagctaattgaagcagtctctgaggttgatgataagcttgccgaatcatttctgaatgatgagcctatatcatctgctgatcttgaggcagccataaggagagcgacaatagcacggaagtttgttcctttttttatgggtagtgctttcaagaacaagggagttcaaacacttcttgatggcgttctcagttacttgccttgtccagttgaagttagcaactatgctctggatcaaacaaaggatgaagagaaggttaccttaaccggaaacccttctggccctttggttgccctggcatttaaattagaggaaggccgttttggtcaattgacctatttaagaatctatgaaggtgtcatccggaagggcgattttataatcaacgtgaacacgggaaagaagattaagattcctcgcttggtgagaatgcattcaaatgagatggaggatatccaagaggctcatgctgggcagatagttgctgtgtttggcgtagattgtgcatcaggggatacttttactgatggatcagtcaaatacactatgacttctatgaatgtacctgaaccagtgatgtcattagctgtttcacctgtttctaaagattctggtggacaattttcaaaagctttgaatcgttttcagaaggaggaccctacattccgtgtgggtttagatgctgagagtggtgagacaatcatatctggcatgggggagctgcatctggacatatatgttgagcgcatccggagagaatataaggttgaagctcaggttggaaagcctcgtgtaaacttcagggaaaccatcactaagcgagcagattttgattatctacacaagaagcaaagtggtgggcaaggtcaatatggtagagtaattgggtatgttgaacctcttgaaccagggtcaggcagtaagtttgaatttgagaacatgcttgtgggacaaactattccgtcaaactatgtccctgcaattgaaaagggtttcagggaggctgccaattcgggctctctgattggtcatcctgttgaaaatatccgtgttgttttgacggatggtgcctcacataatgttgattcaagtgaacttgcattcaaattagcttctatttatgcttttagacagtgttatactgcagccaagcctataattttagaacctgtgatgctggtggatataaaagtgccaacagaatttcagggcactgttactggggatatcaataagaggaaaggtgtcataatcggcaatgaccaggaaggagatgactctgtaattactgccaatgttcctctcaacatgatgtttgggtactcaacatctcttcgatcaatgacacaggggaaaggtgagttcacaatggaatacagagagcatgccccagtttcaggagatacacaaacgcaacttgttaacgcatacaaggccagcaaagaaaattgaaaagatggtgtgcctttgaagctcctgcaactacatcctgtttaattatttttttttatgaatttgtctccttgggtgggagcaatgttgtgaaatccttaggaccagaactggtcagtcaattttgatatgctgaataaaacagtaaaattccataatgtatacaaataattgcttatatacatacatataggttgtgtatt

SEQ ID NO: 656 - DNA, 2583 bp, Papaver somniferum
aagattagggctttacagagagatcgcgaccttgttcttcgtcacagagcttcgatcatggcgatgacgaggtctgcaaagagctcggcaactcggttactctacgctctatgttcagaaaagacactcatttcatccctctcttcttcttcttcctctccatttgcttttctggttctcgaaaatggcggccaaagccgtaaattttcatcatctagtgctgtagctaaatcaaaagatgaaaaagaagcttggtggaaagaaaccatggaaaaacttagaaatattggtatctcagcacatattgattcgggaaaaacaactcttaccgaaagggtattatattatactggtaaaattcatgagattcatgaagttagaggtagagatggtgttggtgctaagatggattctatggatttagaaagagaaaaaggaattactattcaatctgctgctacttattgtacctggaaagattatcaggttaatataattgatacaccaggtcacgttgatttcacgattgaagttgaaagagctttgcgtgttcttgatggtgcaatccttgttctgtgtagtgttgggggtgttcagagtcagtcaattactgttgacagacaaatgagaagatatgaggtgccaagagttgcattcattaacaaacttgatcgaatgggagcagatccatggaaagtcctcaatcaggcaagggcaaagctccgtcatcacagtgctgcggttcaagttccaattggtttagaagatgattttcagggtcttattgatcttgtgcaattaaaaacttactcatttcagggttctagtggtgaaaaagttacaatcactgatgttcctgctgatatggaggttttagttgctgaaaagcgtcgtgaacttattgaaaccgtatctgaagttgatgatcagctggctgaggctttcctcaatgacgagcctatatctgccgaggaacttgatgcagcgatccgcagggctacattagcaaataaattcgtacctgtatttatgggcagtgcttttaagaacaagggagtgcaacctctgttggatggggtccttaactacttaccgtgtccagtagaagttggaaactacgctcttgatcaaacaaaaatgaagaaaaggttttgttatctggaactccagctggacctcttgtagcactggcattcaaattggaagaagggcgttttggtcaactaacctatttaagaatctacgagggtatcattcgaaagggtgattttattcttaacgtaaacacaggcaagaagataaagattcctcgccttgtccgcatgcattccaatgagatggaggatattcaagaggcacatgctgggcaaatagtcgctgtgtttggtgtggattgtgcatcaggggatactttcaccgatggttctgttaaatacacaatgacgtccatgaatgttcctgaacctgtgatgtctttagcacttcaacctgtttcaaaagattctggaggacaattttcaaaagctttgaatcgtttccaaagagaggatccaacttttcgtgttggcttggatgctgagagtggtcagacaatcatatctgggatgggagagctgcacttggaagtttacgtggagcgcattcgcagggagtataaggttgatgctactgttggtaagcctcgggttaactttagagagacggttaccaagcgtgctgagtttgattatctacataaaaagcaatctggtggacaagggcagtatggaagggtttgcgggtatattgaacctcttgaaccgggttcaaccaccaagtttgagtttgaaaacatgattatagggcaagtcatcccatcaaactttattccagcaattgagaagggttttaaagaagccgccaactcgggttcacttattggatttccagttgagaatgttcgtgtggttttgacggatggtgcagctcatgctgtggattcaagtgaacttgcatttaagctggcatcaatctatgcatttagacagtgctatacagcagcaaagcctgtcatattggaacctgtgatgcttgtagagctgaaagcgccaacagaattccagggtactgttactggtgatttaaacaagagaaaaggtgtgatcgttggaaatgaccaagatggagatgatgctgtacttacagcttatgtccctctaaacaacatgtttggatactccacctctctgcggtctatgacacaggggaaaggtgaattcacaatggaatacaaagagcattcaccagtttcccaagatgtgcagttgcaattggttaatgctttcaaaggcaccaaaggtccagagtagactagagtagaccaagctgtgccgaaaacagaaaaagcacatacctctgtattcatttattccatcacgtcgagtgtttttggtttctatttttctcttcaattttgtgatatttgtcaaagtaaaaattagcttgtctttaaatagtaaattaagatactcagatgcaatcataactatagtcatcattgttgtggataaattataaattttgatataagcaaataaacttggg

SEQ ID NO: 657 - DNA, 2281 bp, Musa acuminata
gcaccaaatccgccgccgtctacgatggcgagatcctccgccacccgcctcctctcctccctccgccgctcggagagcaacaggttctgcccgctcaccgtcctcgtcctcaatggcgccgcgctgggcagcggctggcgggggatgtcgaccgcggcgcgggccaatgaggaaaaggagccatggtggaaggaggcaatggatagggtgcggaacatcgggatctccgcccacatcgactcggggaagaccaccctcaccgagcgggtgctcttttacacgggaaggatccacgagatccatgaggtccgagggagggacggagttggcgcgaagatggattcgatggacttggagagggagaaggggatcaccatccagtccgcagctacctactgcacttggaacggatatcagattaatatcattgatactccaggccacgtggatttcaccattgaagttgaaagagctttgcgtgttcttgacggtgctattttggtgctctgtagtgttggaggtgtacaaagtcaatcaatcacggttgatcgccagatgagaagatatgaagttccaagacttgctttcatcaacaagttagatcgaatgggagctgatccctggaaggttcttaatcaggcaaggtctaagcttcgtcatcatagtgcagcggtgcaagttccaattggattggaagaggagtttcaggggcttgtagatcttgtagaaatgaaagcatattacttccatggagccaatggtgagaaagtcacagcagctgatatcccacaaaatttggaggcattggttacagaaaagcggcgcgagcttattgaagttgtttctgaagtagatgatcaacttgctgaagcttttctgaatgatgaaccaatatctcctgttgacctcaggatggcaattcgcagagcaacagtcgcacgcaaatttgttccagtctacatgggaagtgctttcaagaataagggcgtacaaccgcttttagatggagttctcaattatttgccatgtccaactgaagttgagaactatgccctcgatcaaaacaaatctgaagaaaagattttgttgcctggaactccatcagggccacttgttgccttggctttcaaactggaagaaggacgttttggtcagctgacatatctaagaatctatgaaggtgttattcgaaaaggtgactttattatcaatgtaaacaccgggaagaagattaaagttccacgtttggttaggatgcattctgacgagatggaggatattcaagaagcccatgctgggcagattgtcgcagtctttggtgtggattgtgcatcaggtgatacctttacagatggttcagttagatatacaatgacatctatgagtgttcctgaaccagtgatgtctttggcggtttcacctgtatctaaagattctggtggacaattttcaaaagctctaaatcgatttcagaaagaggatccaacgtttcgtgttggattggatgttgaaagtggtcagacaattatatctggaatgggagagttgcatttggacatttatgttgagcgcatacgaagagagtacaaagtcgatgcaaaagttggaaagcctcgggttaattttagggagacaattacacaacgtgctgagtttgattatcttcataagaagcaaagtggaggtcaaggtcaatatggacgtgtttgtggatatattgaacctctaccattgggttcttctacgaagtttgaatttgacaatcatatcattgggcaagcaataccttcaaacttcatccctgctattgagaaagggttcacagaagctagcaactcgggttcattgatcgggcatcctgttgaaaatgttcgaatagtactgacagatggagcctcgcatgctgttgattccagtgagcttgcatttaagctagcagcgatctatgcatttagaaagtgttattctgcagcaaaccctgtcattttagaacctgtgatgaaagtggaattgaaagtgccaacagaattccagggcactgtaactggtgatattaacaagaggaaaggtatcattgttggtaatgatcaggatggtgatgatactgtggttgttgctcatgtccctctaaacaatatgttcggatattctacagcccttcgctccatgacacagggtaaaggcgaattcactatggaatacatggagcactcacctgtttcccaagatgtacagaagcaactcataaatgcacacggtgccaacaaggcttcggaataga

SEQ ID NO: 658 - DNA, 2538 bp, Vinca minor
atggcttggagatcacgatcatctacgacgcggttactgtacagattctgctccagcaccaccaaaacaactccggaatgtacacagaaatctccaatcacggcggctttgttcgccggaaacttccacctccgatcctattcctccggcggtgcagcagcttctagattgagagaagagaaggaggtatcatggaaggaatcaatgggaaagcttcggaacattggaatttcagctcatattgattcaggcaagaccaccttgacggagcgggttctgtattacacgggtcggatccatgagattcatgaagttcgtgggaaagatggagtcggcgcgaaaatggattcaatggatttagagagagaaaaagggattacgatacagtccgctgctacttactgtacttggagagattatcaggtgaatattattgacacacctggtcacgttgatttcaccattgaagttgagagggctttacgtgtcctcgatggtgctattcttgtactctgtagtgttggtggtgtacagagtcagtcaattactgttgacaggcaaatgagaagatatgaagttccaagacttgcattcatcaataaactagatcgaatgggtgcagatccttggaaagttcttgatcaggcaagaaccaagcttcgacaccatagtgctgctgtgcaagttccaattgggttggaagatgaatttcagggtcttgttgatcttgtgcaattaaaagcttactattttcatggtgccagcggggatgaagtggtcactgaagaagttcctgctaacatgtcagatttagtcacacagaagcggaaggaactcattgaagcaatttccgaagtggatgaagaacttgctgaagcatatatcaacgacgaacctatatcatccgctaatcttgaggaggcaatcaggagggctaccatagctcaaaaatttattcctgtattcatgggtagtgcatttaaaaacaagggagttcaaccactccttgatggtgttcttagttatttgccttgtccaacagaagtttgtaattatgcacttgatcaaacaaagaatgaagagaagatcatgttatctggtaacccatcaggaccattagttgctttggctttcaagctggaggaaggtcgttttggtcaattaacatatttaaggatctatgaaggtgtcattcggaagggagattatatggtcaacataaacacaggcaagaagatcaaagttcctcgtctggttcggatgcattctgatgaattggaggacattcaagaggctcatgctggacaaatagttgctgtatttggggtagattgtgcctcaggagatacatttactgatggatcagtcagatacaccatgacatctatgaatgtccccgagccagtgatgtccttagctgtttcaccagtttctaaagatactggaggacaattttcaaaagcactgaatcgcttccagaaagaagatcccactttccgtgttggtctagatccagagagtagccagaccattatttctggaatgggagaattgcatttggaagtatacgttgaacgcataagaagagaatataaggttgatgcaactgttggtaaacctcgtgtcaacttcagagagactattactcaaagggctcagtttgattatttgcataagaagcaaagtggaggacaaggtcaatacggaagggtaattgggtatgtagaaccacttccagcgggatcatcgatgaagtttgagtttgataacatgattgttggacaaaacattccatcaggctttatccccgcaattgagaagggctttaaagaagctgcgaactccggttctttaattggtcatccagtagaaaatattcgtatcgttttgactgatggtgcatcccatgctgttgattcaagtgaacttgcattcaagttagctgcaatatatgcttttagacagtgctatactgcagcaaaacccgttatcttggaacctataatgctggtggaattaaaagtaccaacagaattccaggggaccgtaaccggtgatatcaacaagaggaagggaatgattgttgggaatgaccaggatggagatgactctgttattactgccaatgtccctctgaacaatatgtttggatactcaacagctcttcgttcaatgacacaggggaaaggtgaattcacaatggaatacgtggagcattcgccagtttctcaggatgttcaggcacaactgattaatgcatacaagggtacaaagggaactgcataatttgtgtaatttggaattgtaatgctcgcattaataccaatttttttgtactaaattaattgtaccatatgatttcatttcttagtcatactcatagagccaaaagttggtcaatcggttttagaaaaaaacccgaataaatattttacacctagatatagttacaataggcatcttttccagtagataagttataatgcctatagttggctcaattttcttgtatcaaataggtagactggttcatgagtt

SEQ ID NO: 659 - DNA, 2526 bp, Valeriana officinalis
ccgtaaaccctcttatcatcaacaatggttcgatccatcagatcctctacatcacgtctattatacaccatatgctcctccaaatccacgccgactttatcaccaccaccatgtccgtcaccaattactgccctcctcctcggaaacttccacctccggcagtattccgccggaagcgccgctaaagtgaaagacgagaaagagccttggtggacggaatcaatgcagaaacttcgaaatataggaatctctgcacatattgattcggggaaaccactcttacagagaggattttgtattatactggtaagattcatgagattcatgaggttagaggtaaggatggcgttggagctaaaatggattccatggatttggagagggagaaaggaattacgattcaatctgcagctacttactgcacttggaatgattatcaggtgaatataattgatactcccggtcacgttgatttcacaattgaagtggagagagcattgagagttcttgatggtgcgattctagttttgtgtagtgttggcggcgttcaaagtcaatcgatcactgttgaccgtcagatgagaagatacgaggttccaaggcttgcttttatcaacaaacttgatcgaatgggtgcagatccatggaaagtgctcaatcaggcaagagcaaagcttaggcacaacagtgctgcagtgcaagtgccgattgggttagaagaagactttgaaggtcttgttgaccttgtgaagtcaaaggcttattactttcatggttccagcggtgaaaagattgtcaccgaggaaataccagctgatatggaagaactagttgcagaaaagcgtcgtgaattgattgaagtagtttctgaagttgatgatcaacttgctgaaatttttttagccgatgagccaatttcgcctatccaactcgaggaggcaatacggagagctaccatagcccaaaagtttatccctgtatttatgggtagtgcatttaaaaataagggggtgcaaccgcttcttgacggtgttattagttatttgccttgcccagttgaagttagtaaccaagctctcgatcaaaagagagatgaagagaaggtaatcttgtcggggactcctgctggacctctggttgcgcttgcttttaaattagaagaagggcggtttggtcaactgacatatttaagaatctatgaaggtgttataaagaagggtgattttataatcaatgttaacacgggcaagaaagttaaaatacctcgtttggttcgaatgcattcaaatgagatggaggatattccacaggcacatgccggtcaaattgtagctgtatttggtgtcgattgtgcttcaggagatacttttaccgatggatccgttaaatataccatgacctcaatgaatgttcccgagccggtgatgtcacttgctttgtcacctgtatctaaagattccggaggacaattttcgaaagccttgagtcggttccagagagaagatcctacattccgtgttggtttagatgttgagagtggccagacaattatatctggaatgggagaattgcatttggaggtatatgtagaacgtatccggagggagtataaggttgatgctacagttggaaaacctcgtgttaacttccgagaaactattactaaacgcgctgaatttgattatatacataaaaagcaaagtggaggccaaggtcaatacggacgagtaattgggtatgtggaaccacttccagccggttcaccaacaaagtttgaatttgaaaacgagatttgtggacaagctataccttttaattttattccagctatcgagaaaggtttcaaagaagctgctaattcgggatcattaataggtttcccagttgaaaacttcagagttgttttatcggatggtgcagcgcatgctgttgattccagtgaacttgctttcaagttggcttctatttatgccttcagacagtgttatacggcagcaaagcctgttgtattggagcctgtaatgcttgtcgaattaaaagcaccaagtgaatttcaaggaactgtttccggtgatatcaacaagagaaaaggtataattgttggaaccgaccaagaaggagacgattgtgtaatcactgctcaagtgcccctcaacaatatgttcggatactcaacatcacttcgatcaatgacacagggaaaaggagaatttacaatggaatacaaagaacatttaccggtttcgaatgatgtccaaacacaattagtaaacactttcaaggcgactaagggatgatcagcttagtttttctatttggacttaaggttaaacattcttcaaggccgagtttcggtcagtagttttgataggcaaattataatttatgattgatgatttgatgacttgatttatcttataaagttatgtaggacttgtatcaaaatttgatagttcaacaaaatgtagcaatataggtcttagtgcttatttatttttcttagttaaaatacattagaaataatac

SEQ ID NO: 660 - DNA, 2483 bp, Solanum tuberosum
atggctagatcagctagatcctctacgacgcgcctattctacaccctctgctcctcaaccaaaaggacgccgttgactcctcaacacccaccgccaactccagtcgccgccttattggccggaaacttccagctccgccactacgccgccggcagtgccaccgctagagtgagagaagagaaagatgcggtatggagggagtcgctcgaaaaagtgcggaatattgggatttcagctcatattgactccggtaagactacactgacagagagggtattgttttatacgggccggatccatgagatccatgaagttaggggtaaagatggagttggtgcaaagatggattccatggatttagaaagagaaaaggggattactatacagtctgctgctacttactgcacttggaaggactaccaggtgaacataatagacacacctggtcatgttgatttcacaattgaggtggaaagagccttgcgtgtccttgatggagccattcttgttctttgtagtgttggtggtgtgcaaagtcagtctatcactgttgataggcaaatgagaagatatgatgtcccaagacttgcttttattaataaacttgatcggatgggggcagacccttggaaagttcttaaccaggcaagatcaaagcttcggcatcacagtgctgctgtgcaagttccgattgggctagaagatgacttcaagggtcttattgatctcgtgcagtcaaaagcttactatttccatggttccaatggtgagaagattgtcacagaagatattcctgctgatatggaagcaattacttctgagaagcggcgagagctaattgaagcagtctctgaggttgatgataagcttgctgaatcatttctgaacgatgagcctatatcatctgctgatcttgaggcagccataaggagagcgacaatagcacggaagtttgttcctttttttatgggtagtgctttcaagaacaagggagttcaaacacttcttgatggcgttctcagttacttgccttgtccagttgaagttagcaactatgctctggatcaaacaaaggacgaagagaaggttaccttaaccggaaacccttctggccctttggttgccttggcatttaaattagaggaagggcgttttggtcaattgacctatttaagaatctatgaaggtgtcatccggaagggcgattttataatcaacgtgaacacgggaaagaagattaagattcctcgtttggttagaatgcattcaaatgagatggaggatatccaagaggctcatgctgggcagatagttgctgtgtttggcgtagattgtgcctcaggggatacttttactgatggatcagtcaaatacactatgacttctatgaatgtccctgaaccagtgatgtcattagctgtttcacctgtttctaaagactctggtggacaattttccaaagctttgaatcgttttcagaaggaggatcctacattccgtgtgggtttagatgctgagagtggtgagacaatcatatctggcatgggggagctgcatctggacatatatgttgagcgcatccggagagaatataaggttgaagctcaggttggaaagcctcgtgtaaacttcagggaaaccatcactaagcgagcagattttgattatctacacaagaagcaaagtggtgggcaaggtcaatatggtagagtaattgggtatgttgaacctcttgaaccaggttcaggcagtaagtttgaatttgagaacatgcttgttggacaaactgttccgtcaaactatgtccctgcaattgaaaagggtttcagggaggctgccaattcgggttctctgattggtcatcctgttgaaaatatccgtgttgttttgacggatggtgcctcacataatgttgattcaagtgaacttgcattcaaattagcttctatttatgcttttagacagtgttatactgcggccaagcctatcattttagaacctgtgatgctggtggatataaaagtgccaacagaatttcagggcactgttactggggatatcaataagaggaaaggtgtcataatcggcaatgaccaggaaggagatgactctgtaattactgccaatgttcctctcaacatgatgtttgggtactcaacatctcttcgatcaatgacacaggggaaaggtgagttcacaatggaatacagagagcatgccccggtttcaggagatacgcaaacgcaacttgttaacacatacaaggccagcaaagaaagttgaaaaaatggtgtgcctttgaagctcctgcgactacatcctgtttaattattttttttatgaatttgtctccttgggtgggagcaatgttgtgaaatctttaggaccagaactggtcagtcaattttgatatgctgaataaaacagtaacatgccataatgtatacaaataattgcttatatacatacatataggttgtgta

SEQ ID NO: 661 - DNA, 2546 bp, Solanum phureja
aacatttcttccacgccggagcagatttccacagggtttaaccgaaaaccctaaacccccatggctagatcagctagatcctctacgacgcgcctattctacaccctctgctcctcaaccaaaaggacgccgttgactcctcaacacccaccgccaactccagtcgccgccttattggccggaaacttccagctccgccactacgccgccggcagtgccaccgctagagtgagagaagagaaagatgcggtatggagggagtcgctcgaaaaagtgcggaatattgggatttcagctcatattgactccggtaagactacactgacagagagggtattgttttatacgggccggatccatgagatccatgaagttaggggtaaagatggagttggtgcaaagatggattccatggatttagaaagagaaaaggggattactatacagtctgctgctacttactgcacttggaaggactaccaggtgaacataatagacacacctggtcatgttgatttcacaattgaggtggaaagagccttgcgtgtccttgatggagccattcttgttctttgtagtgttggtggtgtgcaaagtcagtctatcactgttgataggcaaatgagaagatatgatgtcccaagacttgcttttattaataaacttgatcggatgggggcagacccttggaaagttcttaaccaggcaagatcaaagcttcggcatcacagtgctgctgtgcaagttccgattgggctagaagatgacttcaagggtcttattgatctcgtgcagtcaaaagcttactatttccatggttccaatggtgagaagattgtcacagaagatattcctgctgatatggaagcaattacttctgagaagcggcgagagctaattgaagcagtctctgaggttgatgataagcttgctgaatcatttctgaacgatgagcctatatcatctgctgatcttgaggcagccataaggagagcgacaatagcacggaagtttgttcctttttttatgggtagtgctttcaagaacaagggagttcaaacacttcttgatggcgttctcagttacttgccttgtccagttgaagttagcaactatgctctggatcaaacaaaggacgaagagaaggttaccttaaccggaaacccttctggccctttggttgccttggcatttaaattagaggaagggcgttttggtcaattgacctatttaagaatctatgaaggtgtcatccggaagggcgattttataatcaacgtgaacacgggaaagaagattaagattcctcgtttggttagaatgcattcaaatgagatggaggatatccaagaggctcatgctgggcagatagttgctgtgtttggcgtagattgtgcctcaggggatacttttactgatggatcagtcaaatacactatgacttctatgaatgtccctgaaccagtgatgtcattagctgtttcacctgtttctaaagactctggtggacaattttccaaagctttgaatcgttttcagaaggaggatcctacattccgtgtgggtttagatgctgagagtggtgagacaatcatatctggcatgggggagctgcatctggacatatatgttgagcgcatccggagagaatataaggttgaagctcaggttggaaagcctcgtgtaaacttcagggaaaccatcactaagcgagcagattttgattatctacacaagaagcaaagtggtgggcaaggtcaatatggtagagtaattgggtatgttgaacctcttgaaccaggttcaggcagtaagtttgaatttgagaacatgcttgttggacaaactgttccgtcaaactatgtccctgcaattgaaaagggtttcagggaggctgccaattcgggttctctgattggtcatcctgttgaaaatatccgtgttgttttgacggatggtgcctcacataatgttgattcaagtgaacttgcattcaaattagcttctatttatgcttttagacagtgttatactgcggccaagcctatcattttagaacctgtgatgctggtggatataaaagtgccaacagaatttcagggcactgttactggggatatcaataagaggaaaggtgtcataatcggcaatgaccaggaaggagatgactctgtaattactgccaatgttcctctcaacatgatgtttgggtactcaacatctcttcgatcaatgacacaggggaaaggtgagttcacaatggaatacagagagcatgccccggtttcaggagatacgcaaacgcaacttgttaacacatacaaggccagcaaagaaagttgaaaaaatggtgtgcctttgaagctcctgcgactacatcctgtttaattattttttttatgaatttgtctccttgggtgggagcaatgttgtgaaatctttaggaccagaactggtcagtcaattttgatatgctgaataaaacagtaacatgccataatgtatacaaataattgcttatatacatacatataggttgtgtattc

SEQ ID NO: 662 - DNA, 2651 bp, Medicago truncatula
tctcttcaaacccaaaacccccatacttcaccaccaccatgacacgcttctccaaatcctccgcccagcgcctcctctacgcccttacctccaccaccaccggtgctccgtccctccttgccgccacctcccacctccggcacttctcatccggcaacctcgcgcgagcaaaagcagccacaaccgacaaagaaccatggtggaaggaatcaatggaaatgatccggaacatagggatttcggcgcatattgattccggtaagacgacgttgacggagcgagttttgttttataccggaaggattcatgagattcatgaggttagagggaaagatggagttggtgcgaagatggattctatggatttggagagagagaaagggattactattaaatctgctgctacttgttgtaattggaaagattatacgatcaacataattgacacacctggtcacgttgatttcaccattgaggtcgagagggctttgcgtgtccttgatggtgccattcttgttttttgtagtgttggtggggtgcaaagtcagtccattactgttgatcggcaaatgaaaagatacgaggttccaagacttgcatttatcaacaagcttgatcgaatgggagcagatccatggaaagttttaaatcaggcgagatctaagcttcggcatcatagtgctgcaattcaaattccaataggtttggaagaaaattttaagggacttgttgatcttgtgaagttaaaggcctattattttgatggttccaatggagaaaaacttaccattgaagaagtgccttcagatatggaagccttggtggcagaaaaaagacatgaactaatagaaactgtgtcagaggttgatgatatacttgcggaagcgtttcttagtgatgagcctgtttcagatgttgatcttgagggagccattcgtagggctaccgtggcgcggaaatttataccggtattcatgggtagtgctttcaaaaacaaggggatacaaccacttctggatggtgtacttagttatttgccatgtccaattgaagttaataattatgcccttgaccaatctaataaggaggagaaggttgagctgcctggtaatcctgatgggccccttgtagcattggctttcaagttggaggaaagtaagtttggtcagctaacatatttaagaatttatgagggcgtcattcggaagggtgatttcattattaatgttaacactggcaagaagaacaaggttcctcgcttgggtcggatgcattctaatgagatggaggaaattgatgaggctcatgctggccaaatagttgctgtatttggtgttgattgtgcatcaggagatacttttactgatgggtctgttaaatatacaatgacttcaatgagtgttcctgagcctgtgatgtcattagctgtacagccagtctcaaaagattctggagggcaattttcaaaagctttgaaccgcttccaaagagaggatcctactttccgtgttggcttggacccagagagtgggcagacaattatttctggaatgggagaactgcacttagatatctatgttgaacgcattagaagggaatataaggttgatgctacagttggaaagccccgtgtaaacttcagagaaactgttactcaacgtgctgattttgattatttacataagaagcaatccggagggcaaggacaatatggacgggtgattgggtatattgaaccactccctgctgggtcagaaactaagtttgaatttgaaaacatgcttgttggtcaagctattccatcaaattttttcgctgcaattgagaaaggttttatagaagctgccaactccggttccttaattggacatcccgttgaaaatctccgagttgtcttgacagatggtgctgctcatgctgttgattccagtgagcttgcctttaagatggcttctatctatgcttttagacagtgttacactgcttccagaccaactatattagagcctgttatgcttgttgagctaaaagtaccaaatgaatttcagggagctgttgctggtgacctcaacaagagaaagggtatgattgttggcaatgatcaggatggagatgactctgtcattatagctcatgtccctcttaacaatatgtttgggtactctacagctcttcgttcgatgacacagggaaagggtgaatttacaatggaatataaggaacattcacctgtttctcatgatgtacagacccaattggtaaacgcatacaagggcaataaggcacctgaatgatgactttgttgaagtatacggtcctatattttttgggagtaatttatctaggaaaaagatttgtgacaattatagggatataggtttggttcattttttagggtcaaccaaattttgaaggcaaataagaaggtgctataattgtacgattaagtaatattatagatttttcccttgaaaaaagtaatattattatagatgaaataattgctaagtgcctaagtaatctggcttctgtaagatgtaagctatgtaactttaattacaattattcaatttcaagttttcgaagattcataatctcaggaatcacttggtctggtttctttagaaactagaaaatcattttttttatta

SEQ ID NO: 663 - DNA, 2743 bp, Populus trichocarpa
aaaagacccttttacccgacccgactagaccggccaccactcctgccactgcatttctcaaaccccatattctaaacctctcttcgggtttagggttttacggaatcgggaatccatcgaccaccatgacccgattccaaaatggatcacgcctcctctcctacaccttcttccgctccaaaaagacaccgtcaacttccccaaacgccgctctcctccagggcaacttccaaatccagcaacaccgccacttctccaaccttgcacgcgtcaccactaaagaagaaaaggagccacggtggaaggactcgatggacagactaagaaacattggtatctcagctcatatcgactccggtaaaaccactcttactgaacgcatactctattacactggtcgaattcacgagattcatgaggttcgcggtcgtgatggagttggggctaagatggattccatggacttggagagagagaaggggatcactatccagtctgctgctacttactgcacgtggaatggatatcaggtgaatataattgatacgccaggacatgtggattttacaatagaggtggagagggctctgagagtgttggatggtgcaattctggttttgtgtagcgtgggtggagtgcaaagtcagtctattactgtggataggcaaatgaggagatatgaggtgcctaggcttgcttttattaataaacttgatcgaatgggagctgatccctggaaagttttaaaccaggcaaggtctaaactaagacatcatagtgcagcagtgcaagttccaattgggctggaagatgatttgcaaggccttattgatcttgtaaagatgaaagcatattatttccatggctcaaatggtgaaaaagttgtcactgcagaaataccagctgagatggaggccttagctgcagaaaaacggcgtgaactagtagaaacagtttctgaagttgatgataaacttgcagatgcttttctcacagatgagcctatttcatcctctgaccttgaggaggcaattcgcagggctactgtagcgaagaaatttgtacctgtattcatgggcagtgcattcaagaacaagatggtgtacttagttatttgccttgtcccactgaagttggtaactatgctcttgaccaaaccaaggatgaagagaaggttgtgttgtctggaactccagatggaccacttgtggcattggcttttaaattagaagaaggtcgttttggtcagttgacatatctaaggcatgacttattgctggtttaaatctacgagggtgtaattcgcaagggtgattttataattaatgtaaacacaggcaagaagatcaagattcctcgtttggttcggatgcactctgatgaaatggaggacattcaagaggcacatgcggggcaaatagttgctgtgttcggtgtggattgtgcttcaggagacacttttactgatggatcagttaaatacactatgacctctatgaatgtccctgagccagttatgtcattggccattcaaccaatctcaaaagactctggaggacaattttcaaaagctttgaatcgttttcagaaagaggatcccactttccgtgttggcttggatcctgagagtgggcagaccataatttctggaatgggagagttgcatttggacatatatgtggaacggattaggagagagtacaaggtagatgcaagtgttgggaagcctcgtgtgaacttcagagaaacaatcactcagcgtgctgaatttgattatttacataagaagcaaactggaggacaaggacaatatggacgggtatgcgggtacattgagccgcttccacaggggtcaacaactaagtttgagtttgataacatgattgtaggacaggttataccatcaaacttcattccttctattgagaagggattcaaggaagctgccaattcgggttctttaattggacatccagtagaaaatcttcgaattgctttgacagatggcgctgcccatgctgtggattctagtgaacttgcatttaaattagcatcaatatatgcttttagacagtgttacgcagctgcaaaacctgtgatactggaacctgtaatgctggtggaactgaaagtaccaacagagtttcagggaaccgtagcgggtgacattaacaagaggaaaggagtgattgttggaaatgaccaggatggggatgactctataataaccgtccatgtgcctttgaacaatatgtttggttactcaacttctcttcgttcaatgacacagggaaagggtgaattcacaatggaatacaaagaacattcacctgtttctcaggatgtgcaaatgcaattagtcaacacctacatggccagcaagggtgctgaataatgaagatttccgttaaagcaaatgcccctatattccgtacataagcctcaaaggttttatatatatatcctttttgacgaccaagtgtattgttatagaaatattcataagttagatcaatcagttttgggatacaaaataaatttgtattgccctgtgggtgtacatgcattaactcaactttctactcaacaagtcaaaatgaaatagctaaattttgtcctttgatctatttgttttcctttacatgtaaaaaactatgaaaaactggttccgaggtttccttttgtcagtttgtgtagcaaatatgctcggaaaaactgtagaaaacaaaccggcttttattcc

SEQ ID NO: 664 - DNA, 2435 bp, Lactuca sativa
tgcgcatctaaacccccaacaccatggctggatcacgatcctctacgacgcgcctactatacactctacgttcatccatctatccatcatcaagatcgccaacaccaccatcacccattactgctctcctccatctccaccgtcactactccgctgcaccagccgtgagggcgaaggatgataaggaaccatggtggaaggagtcgatggaaaaagtgagaaacatcggaatatcggcgcatattgattcgggaaaaacgacgcttacggagagggttttgttttacacggggaggattcatgagattcatgaggtcagagggaaagatggcgttggtgcaaagatggactcgatggaattggagcgagagaaagggattactattcagtccgcagctacttattgcacttggaaagattatcaggtaaatataatcgatactccaggtcacgtggacttcacaattgaagttgagagagctctgcgtgttcttgatggagcaattcttgtcctctgtagtgttggtggtgttcaaagtcagtcaattactgttgatagacaaatgagaagatatgaagttccaagagttgcttttatcaacaaacttgatcgaatgggggcagatccatggaaggttctcaatcaggcaaggaaaaagcttcgacatcacagtgctgcagtgcaaatgccaataggattggaagaggactttcagggtcttgtggatcttgtgcaactaaaggcttatttctttcatggctctagcggtgaaaaagttgtaacagaagaaattccagctgatatgcaagcaatggctgcagaaaagagacgtgagttaattgaagcagtctctgatgttgatgatcagcttgctgaagtattcctcaatgatgaacctatatcagctgctgatcttgaggcagccattcgtagagcaactatagcccggaaatttataccagtatttatgggtagtgcatttaagaataagggagtacaaccgcttcttgatggcgttctttgttatttgcctaatccacttgaagttgacaattttgcccttgaccaatctaacaaggaagaaaaggtcaagctgtctggaacgccagctggaccaatggttgcattggcttttaaactggaagaacgacaattcggtcaactgacatatttaagaatctatgaaggtattctcaggaaaggcgaattcataacaaacattaatacaggaaagaaaattaaagtatcgaaactaggccggatgcattcagattctatggaggacattcaagaagctcatgcaggtcaaattgtagcagtatttggattagattgtgcatcaggagatactttcacagacggatcagtcaaatacaccatgacttccatgaatgttccggaacctgttgtgtcattagctgtttcaccagtttcaaaagattccggaaaacaattctcaaaagctttgaatcgtttccaaagagaggaccccacattccgtgttggattggaccctgagagtggtcagacaattatatcgggaatgggagagttgcatttggaggtttatgtggaacgcattaagagggaatataaggttgatgcaactgttggaaagcctcgtgtgaacttcagagagacaattacacaacgcgcagaatttgattatttacataagaagcaaagtggaggccaaggtcaatatggaagggtggttgggtatatggagccactgccagctggatcagagaggaaatttgaatttgagaacatgataataggacaagctataccctccaacttcatcccacacattgagaagggtttcagggaagctgccaattcgggttctttgattggattcccagttgaaaatattcgtgtggttatgacagatggtgcttctcatgctgtggattccagtgaactagctttcagattagcttcaatttatgcttttagacagtgttatgcaaaatgcaagccagtgatactggagcctatgatgttggtagaattgaaagtgccaactgaatttcagggcactgttgctggtgacttgaacaggagaaaaggcataattgttggaaatgatcaagatggagatgattctgtcatcaatgcccttgtcccactgaacaatatgtttggatactcaacagctcttcgttccatgacacagggaaagggtgaattcaccatggaatacaaagaacactcaccagtttctgcagatgtgcaaacacaattgatcaacgcccataaacccaaggctgaataatctcatgggaaacatattttattattatttttttaaagaaatttctaggatatatttgtactaagagcttgttatttgttgagacccaagttggtcagtaattttgtaacaaccaaataatccctcatagaatatacaagtttttactaaact

SEQ ID NO: 665 - DNA, 2684 bp, Beta vulgaris
acccccatcagtagggtttagtaaaagcaaataacgcatagtgagggtttaacttctaaacccggacctattcatctcaatctccaagctcagtagctctaacaatggcgagatcagctagatcctcagcttctcgccttctctacaccttattcacttcatctcccacacaccaatctctctcctcttcatctcccgtccaacttcaccgccatttccgattattttccgccggcagcgctgcgcgcgtcaaagaagacaaagctgcgctgttgcaggattcattatcaaaggtccgaaacattggaatttccgcgcatattgattctggaaagaccacgttgacggagcgagttcttttttacactggacgaatccatgagattcacgaggttagaggaagagatggagttggtgccaagatggattctatggatttggagagagaaaaggggatcactatccaatctgctgctacttactgcacttggaaggattttcaggtcaatatcatcgacactccaggtcacgttgattttaccattgaagtagagcgtgccttgcgtgtccttgatggtgccgttctcgtcctttgtagtgttggtggtgttcaaagccaatcgataactgttgatcggcaaatgaggagatatgaagttcctagagttgcattcatcaataaattggaccgaatgggagctgatccgtggaaggttctgaatcaggctaggttaaagcttaggcatcacagtgctgcggtacaagtgcctattggtctggaagaagattttcagggtcttgtggatctggtgcaattgaaagcttattattttcatggatcaaatggtgaaaaagttgtcgctgctgaagtacctacagatatggaagctttagtggcagaaaagcggcatgagcttatagaggcagtctctgaggttgatgataaactggctgagctgtttttggctgatgaacccatatcgtcgtctgaccttgaggaagcaatacgtagggctactgtagcacggaaattcgttcctttcttcatgggaagtgctttcaagaacaagggtgttcagccacttcttgatggagttctcagttacctgccatgtccaaccgaagtcagcaactatgctttggatcaaaacaataatgaagagaaggtattgttatctggggcaccaagtggacctcttgtagcgctagcatttaaactagaagaaggaagatttggtcaattgacatttttaagaatatatgagggcattatcaagaaaggagacttcatacacaatatcaacactggcaagagactcaaggttcctcgccttgttcggatgcattctagtgagatggaggacattcaagaggcacatgctggacaaatagttgctgtattcggagttgattgtgctacaggagacacttttactgatggaacagtcaaatataccatgacttctatgaatgttcctgagccagtgatgtcattggctgtttcaccagtgtctaaggattctggagggcagttttcaaaagcattgaaccgtttccagaaggaggacccgaccttccgtgttggattagatccagagagtggtcagacaattatttctggaatgggagaactacatttagccatttatgttgagcgcatccgaagagaatataaggttgaaacacaaacaggaaagcctcgtgttaatttcagagaagctattactcaacgtgcggaattcgattatttgcataagaagcaaagtggaggtcaggggcaatacggaagagtaacaggctttgttgaaccactccccctgggatcagcaaccaagtttgagtttgaaaacttgatagtaggacaagctattccttcaaacttcataccagcaattgagaaaggatttaaagaagctgcaaactcgggttcccttattggacatccggtggagtatgttcgtgtttgtttaacagatggggcatcccacgctgtggattctagtgaacttgcattcaagttggcttctatatatgccttcagacagtgctatacgaaagcaaagcctgtggtattagaaccaataatgttggtggaggtgaaggtaccatcagaattccagggttccgtgactggtgatatcaacaagaggaaaggtgtgattattggtaacgatcaggatggtgatgattctgttattattgcacatatccctctgaacaagatgtttggatattccacagacctgcgctcaatgacgcagggaaaaggtgaattcactatggaatacaaagagcattctccagttcctcaagatgtgcagatggaattgatgaatgactacaaggctacaaaggcagctgaacaatgatggatctgcttacaaaaaggaaaactttacattatacacacttttctttttgaatcttcaacttcttcagtgaacaatcattcaattagcttgtaggtgaaatccatgtcttatgttaaaacagagcattttggcagccggaataatatgccgaatgatataccctaggttcctctgatactggagggatctaaatcattcctttttgggaagatgagttcctttgtatagtttttattaattattgtagcagcttatagtcgaagctgtatttgcagtttgaaaatctgaaaacctatgttcactatattccac

SEQ ID NO: 666 - DNA, 2519 bp, Phalaenopsis aphrodite
gctcagccaaattgaggtgtttaatgggttcgttaagggttttatcaggttagggttttagattgtcgttggacgcgaccttcaacctcctcgccagtcgacgatgggcagaaccagcgtcacccgcatcctctcctccctccgccgcgcggcgagtcagagaagcgatgccccttctccagccatcgccctatttttcattgacgatgcagcctgccgtggccggcggggctactcaacggcgagcatggcccgtgctaaggaggagaaggaggcttggtggaaggagacgttggataaggtgaggaacatcgggatttcggctcacatcgactccggcaagaccacgcttactgagaggattctcttctacaccggtcgcatccacgagatacacgaggtgagaggtcgggatggtgttggtgccaagatggattccatggacctcgagcgggagaaggggatcaccatccagtcagctgctacttactgcacctggaaagattatcaggttaatataattgataccccgggtcatgtggactttactattgaggttgagagagctcttcgtgttcttgatggtgccatactcgtcctttgcagcgttggcggcgttcagagtcagtctataacagttgatcgccagatgaggaggtatgaggttccaaggcttgcttttatcaataagttagatcgaatgggtgcagatccgtggaaagttctgaatcaggcaagatcgaagcttcggcaccattctgcagcggttcaagttccaattggattggaagaggagtttcagggccttgtggatcttgttgaaatgaaagcttattattttcatggatccaatggtgagaatattgttacatctgatgtcccttcagatattgaggcattggtcgcagaaaagagacacgaacttatagaagttgtttctgaagttgatgatcaacttgctgagtcttttcttaatgatgagtctatatcatcagatgatctcaagatggctatccgcagggctacagtttcacgaaaatttgtgccagtttatatgggaagtgcttttaagaacaagggtgtacaacctcttcttgatggagttgttaactttttgccctgtcccactgaagttgaaaatcatgcactggaccaggatcagtctgaagtcaaggttcggttatctggaaatcctgctggacctcttgttgctctggctttcaaattggaagagggccgctttggccaattgacctatttaagaatctatgaaggtattataaaaaagggcgacttcatcatcaacataaatacagggaaaaagatcaaggttcctcgtttagttcgtatgcattctaatgaaatggaggatattcaagaagctcatgctgggcagattgtagcggtttttggcattgattgtgcttcaggggacacattcacagatgggtctgtgaggtacactatgacatctatgaatgttcctgagccagttatgtcattggctgtttcacccatttctaaagattatggagcacagttctcgaaagctcttaatagatttcagaaagaggaccctacttttcgtgttggtttggatccagaaagtgggcagactatcatttctgggatgggggagctgcacttggatatttatgttgaacgcattagaagggagtataaggttgacgcacaaactggaaggcctcgtgtaaactttagagagaccataacacagcgggcagaatttgattacttgcataagaaacagactggtgggcaaggccaatacggacgtgtttgtggatatatagagcccctttcagcagacgcagcaacaaaatttgaatttgataacatgataattgggcaagcaatcccatcaaactttattccagccatcgagaaaggtttcaaggaagcttgcaactcgggttcattgatagggcatcccgttgagaatattagaatagtcttgacagatggtgcttcacatgctgttgattccagtgaacttgctttcaagttggcatctatctatgctttgagacagtgttatgctgcagcaaagccagtcatattggaacctgttatgaaggtagaattgaaatttccaactgagtttcagggcaccgttactggtgatattaacaagagaaaaggaattattgttggaaatgaccaggagggtgatgatacggtaattgttacccatgtaccgttaaataatatgtttggctattcaacctccttgcggtccatgacccaggggaaaggggaattcaccatggaatacctggagcactcagcagtttcccaagatgtgcagacgcagctcatcaacacctacaaggctagcaagggaacaacagattaagttcaattacaaacacagccagggttcttacagcaggttaattatataaagttataagtttacgtttgatcctttctttttttttttttttttacttttgcgattagatgcaatttatgtgagagttgattatggtcaggtc

SEQ ID NO: 667 - DNA, 2380 bp, Trigonella foenum-graecum
cttcaaacccaaaaaccccaatggcacgcttctccaaatcctctgcccagcgtctcctctacgccctcaccaccaccaccacaaccacaaccgcctctgcatccccgtcaacctccctaatcacctcctccttccacctccgccacttctcatccgggaacctcgcgcgagcaaaagcggcgacaaccgacaaagagccatggtggaaggagtcgatggaaatgatccggaacatcgggatctcggcgcatattgattccgggaagacgacgttgacagagcgggttttgttttatactggaaggattcatgagattcatgaggttagagggaaggatggagttggtgctaagatggattcgatggatttggagagagagaaagggattactattaagtctgctgctacttgttgtacttggaaggattatacgatcaacataattgacacacctggtcacgttgatttcactattgaggtcgagagggctttgcgtgtccttgatggtgccattcttgttttttgtagtgttggtggggtgcaaagtcagtccattacagttgatcggcaaatgaaaagatatgaggttccaagacttgcatttatcaacaagcttgatcgaatgggagcagatccatggaaagttttaaatcaggctagatctaagcttcggcatcatagtgctgcaattcaagttccaataggtttggaagaacgttttgaaggacttgttgatcttgtgaagttaaaggcctattattttgatggtccaaatggagaaaaacttaccattaaagaagtgccttcagatatggaagccttggtggcagaaaaaagacatgaactaatagaaactgtgtcagaggttgatgatatacttgctgaagcgtttcttagtgatgagcccatttcagatgttgatcttgagggagcaattcgtagggctaccgtagcgcggaaatttatacctgtattcatggggagtgctttcaaaaacaaggggatacagccacttctggatggtgtacttagttatttgccatgtccagttgaagttaataattatgctcttgaccaatctaagaaggaagagaagattgagctccctggaaatcctgatggcccccttgtagcattggctttcaagttggaggaaagtaagtttggtcagttaacatatttaagaatttatgagggcgtcattcggaagggtgatttttatcattaacgtcaacactggcaagaagaacaaggttcctcgcttgggtcggatgcattcgaatgagatggaggacattgaagaggctcatgctggccaaatagttgctgtatttggtgttgattgtgcatcaggagatacttttactgatgggtcggttaaatacacaatgacttcaatgagtgttcctgagcccgtgatgtcattagctgtacagccagtctcaaaagattctggagggcaattttcaaaagctttgaaccgcttccaaagagaggatcctactttccgtgttggcttggacccagagagtgggcagacaattatttctggaatgggagaactgcacttagatatctatgttgaacgcattaagagggagtacaaggtcgatgcttcagttggaaaaccccgtgtaaacttcagagaaactgttactcaacgtgctgattttgattatttacataagaagcaatccggagggcaaggacaatatggacgggtgattgggtatattgaaccactccctgctgggtcggaaactaagtttgaatttgaaaacatgcttgttggtcaagctattccatcaaattttttcgctgcaattgagaaaggttttatagaagctgccaactccggttccttaattggacatcccgttgaaaatctccgagttgtcttgacagatggtgctgctcatgctgttgattccagtgagcttgcctttaagatggcttctatctatgcttttagacagtgttacgcagctgccagaccaactatattagaacctgttatgcttgttgagctgaaagtaccaaatgaatttcaaggagctgttgctggtgacctcaacaagagaaaaggtatgattgttggcaatgatcaggacggagatgattctgtcattatagctcatgtccctcttaacaatatgtttgggtactctacagctcttcgctcgatgacacagggaaaaggtgagttcacaatggaatataaggaacattcacccgtttctcatgatgtacagacccaattgataaacgcatacaagggcaataaggcggctgaatgatctggccttgtagaagtatacggtcctaaaatttttgggagtaatttctccaggaaaaagaattgtgacaataatagggata

SEQ ID NO: 668 - DNA, 2838 bp, Elaeis guineensis
ccgaagcctcagaccgcagacgacgatggcgaggtcgtctgccacccgcctcctctccactctccgccgggggcacaagaattctctctccccactccaccccctcgccgtcctcatccttgacggcgcccctctcggcagccggcgggggctggcaacgtcaagcgcggcgcgggtcaaggaggagaaggaggcatggtggaaggaggcgatggagaggatgaggaacatcgggatctcggcccacatcgactccgggaagacgaccctcaccgagaggatcctctactacacggggaggatccacgagatccacgaagtccgcgggagggacggagtcggcgccaagatggattccatggatctcgagagggagaagggaatcaccatccagtccgccgccacctactgcaaatggaatgattaccagattaatataattgacactccaggacatgtggatttcaccattgaagttgagagagctctgcgagttcttgatggagctattctcgttctttgtagtgttggaggcgtacagagccagtcaattactgttgatcgtcagatgaggagatatgaagttccaagacttgcattcattaacaagttagatcgaatgggagcagatccttggaaggttcttaatcaggcaagatctaagcttcggcatcacagtgcagctgtacaagttcctatcgggttggaagaggaatttcaaggcctcgtggatcttgttgaattgcaagcttattacttccatggtgccaatggtgagaaagttgtcacagaagatatacctcccaagttggaagcactagtcactgaaaagaggcgtgaactaattgaagttgtttctgaagtggatgataagcttgctgaagcttttcttaatgatgaaccaatatcatccagtgacctcaagatggcaatccgcagggctacaacagcacgcaaattcgtacccttttttatgggaagtgcattcaaaaataagggggtacaacctcttcttgatggagtacttaactatttgccctgtcccactgaggttgaaaactatgccctagaccaaaacaagtcggaagagaaggttttattacctggcactccggttgggccatttgttgctttagctttcaaattggaagaagggcgttttggtcagttgacttatttaagaatctatgaaggtgttatacggaagggagactttatgatcaatgtgaacacaggaaagaagattaaagttcctcgtttagttcggatgcatgctgatgagatggaggatatccaagaagctcatgctgggcagattgctgcagtctttggtgtagattgtgcatcaggtgacaccttcacagatgggtcagtcagatacactatgacttctatgaatgttcctgagccagtgatgtcactggctgtgtcacccgtatccaaagattctggaggacaattttcaaaagctttaaatcgttttcagaaagaggatccaacttttcgtgttggtttggatgttgagagtgggcagacaattatttctgggatgggagagctgcatttggacatttatgttgagcgcatccgaagggagtataaggttgatgcaaaagttggaaaacctcgtgttaactttagggagactgtcactcagcgtgctgagtttgattatttgcataaaaaacaatcaggaggtcaaggtcaatatggacgggtttgtggatatattgaacctcttccaatggattcacctgcaaagtttgaatttgagaatatggtcatagggcaagcaatcccttcaaactttatccctgcaattgagaaaggtttcaaagaagctagcaactcgggttcattgatagggcatcctgtcgaatatgttagagtagtcctcacagatggggcatcgcatgctgtggattctagtgagcttgcctttaagttggcagcaatttatgcattcagacagtgttatgctgctgccaagcctgtcatactggaaccggtgatgaaggtggaactgaaagcaccaacagagttccagggtacagttactggtgacattaataagaggaaaggtatgattgttggaaatgaccaggagggtgatgataccgtggtcgttgctcatgtaccactcaacaatatgtttgggtactcaacagcacttcgctccatgacgcagggcaagggtgaattcaccatggaatacctagagcactcacctgtctctcaagatgtacagatgcaacttgtgaacacttataaggccaccaagggtacagaatgagccatttttttctggataataagattgcctgttttttaacggtggattttgatagtctccacttgagccacatgcaatgttctatttctaatttattttaagttttggaatgaggtaaaatatttattctttcctgtgggggatctgccaccatgctgatggtagaatcctcttatgaacaggtaaatataagccagggttcccacttattaagtaaacttgttgcaataagtgggaacccttcttgtcatagtgttttttttgtcagtgtttcttgtagaacaggtacggacatgaattaaatgtttgttttcatgagatgctgtcatcaggaaatcattaatgacatcttgtattctcctttggagttctgtgtctcttagatgggtgtgtttccatgtacgagttgttacggtgaggaagctgcccctagattttgaggcttggttttcgggtcggtattctgccacttttgtgtgaaaatgtgaaaaacctttttctgttgagtttcattgaagcagtgttatataacaaaaaaaaaaaaa

SEQ ID NO: 669 - DNA, 2888 bp, Brachypodium distachyon
aggccaggactgtaggagtttattggacgagctcctagggctttagtgcaacgagatcaaaacccgccgcctccgccgccgccgagaatttcctagcggcgatggccatggcccgtcgttccgcctcccacctcctctgctccttccgccctttctctctactcctgcagcccctgaccgatgcgcccacgcccgcagccgcggccgcagcagcatcggctcgacgggcaatgtcctctgcgtcggctctgcgggcacggggagacgacaaggagttggctcggtggcgggagtccatggatcggatgcggaacatcgggatatccgcgcacatcgactccggaaagacgacactgacggagcgggtcttgtactacactggccggatccatgagatccacgaggtgcgtggccgtgatggcgtcggcgcaaaaatggactccatggatctcgaacgcgagaagggcatcaccatccagtcggccgcgacctactgtacctggaatgactatcaggttaatattattgataccccaggtcacgtggatttcaccattgaggttgaaagggcccttcgtgttcttgatggtgctatacttgtgctatgtagtgtcggtggcgtacaaagtcaatcgattactgtcgatcgacagatgaaaagatatgagatcccaagggttgcatttattaacaagttagaccgtatgggagccgatccatggaaagttcttaaccaggctcggtctaaactccggcaccacagtgcagctctacaagtgcccataggattagaagaggagtttgagggccttgtggatcttgtggagttgaaggcttataatttcgagggtggaagtggacaggatgtcgttacatctgatgtcccatccaacatgcaagatttagtcacggacaagagacgtgaacttattgaagttgtttcagaagtcgatgatcagcttgccgaagcttttctcaatgatgagccaatatcagctaatgagcttaaggctgctatccgaagagcaacagtagcacgcaagttcataccagtatacatgggaagtgcattcaaaaataagggtgttcaacctcttcttaatggtgtgcttgactatctaccttgtccagcggaagttgaaaactacgccctcgaccaaaacaaatcagaagagaaggtcttattgggtggaacgccagctgggcctcttgtagcattagcatttaagcttgaggaaggccgctttggtcagttgacatatctaagaatctacgatggtgtgatacggaaaggtgatttcatatacaatgtgaatacaggaaaaaagatcaaagttcctcgtttggtaaggatgcactccaatgagatggaggatattcaagaagcgcatgctggacaaattgttgctgtgtttggtgttgattgcgcatcaggtgatacatttacagacgggtcggtcaaatatactatgacttcaatgaatgtccctgaacctgtgatgtccttggctgttaacccgatatctaaagattctggtggacaattttcgaaagccctgaatcgattccagagagaagatcccactttccgtgtaggtctggatccagagagtggacagacaatcatttctggtatgggtgagttgcatttggacatctatgttgaacgcatcaggagagagtacaaggttgatgcaaaggttgggaaacctcgtgtgaacttcagggaaactatcactcagcgtgctgagtttgattacttgcacaaaaagcaatctggcggtcaaggtcaatatggacgagtatgtgggtatattgaacctcttccatcaggttctgacggtaagttcgaatttgataacatgattattggacaagcgattccgtccaacttcataccagcaatcgagaagggttttaaggaagcttgcaattcgggttcattgatagggcatccagttgagaatatccggattacgctgaccgatggggcttcacatgcagtggattccagtgagcttgcttttaagctagctgctatctatgcttttagacagtgttacactgctgctaaacctgtaatactagaacccgtgatgaaggtggaactaaaagttccaacagagtttcagggcacagtaactggggacatgaacaagagaaaaggtattattgttggaaatgatcaggaaggcgatgacacagttgtagtatgccatgttccgctaaacaatatgtttggatattcaacagcacttcgttcaatgacacagggaaaaggtgaatttacgatggagtatatggagcacaacactgtctcgcaggatgtacagatgcagcttgtaaattcacacaaggccactaagagcccagagtgattcttctagggcagaggaaacaaatttttgttccattttatatgtccatttgttctcgaatgatgggttaggacatcactaatagcctgtatttgtagaatcacatagggttgttaacacagcaatagatatcggacgcaataatccggaattcctcgctacacgcagaatattgcagctcgctacagtgaagttgaagagcgaagcaagctcccttggttttgtcgtatgtctttttggaggaaatactgttcatgaaacatgattattcagcctctgtaccttgtatagagcctaattaatgattttgtagctgcaccctataggccgactgttggtctagggtttaccagcttggcacattatcatcgttctagcgtgggacattgcacactttgccggttttgatttttctttatgtatgtatttaactctgcgtgattaaatatcaaactagtaacaatattttgtgaactgatcgtccttttttttcacttagtaataaaccgt

SEQ ID NO: 670 - DNA, 2789 bp, Brachypodium distachyon
ccgccgcctccgccgccgccgagaatttcctagcggcgatggccatggcccgtcgttccgcctcccacctcctctgctccttccgccctttctctctactcctgcagcccctgaccgatgcgcccacgcccgcagccgcggccgcagcagcatcggctcgacgggcaatgtcctctgcgtcggctctgcgggcacggggagacgacaaggagttggctcggtggcgggagtccatggatcggatgcggaacatcgggatatccgcgcacatcgactccggaaagacgacactgacggagcgggtcttgtactacactggccggatccatgagatccacgaggtgcgtggccgtgatggcgtcggcgcaaaaatggactccatggatctcgaacgcgagaagggcatcaccatccagtcggccgcgacctactgtacctggaatgactatcaggttaatattattgataccccaggtcacgtggatttcaccattgaggttgaaagggcccttcgtgttcttgatggtgctatacttgtgctatgtagtgtcggtggcgtacaaagtcaatcgattactgtcgatcgacagatgaaaagatatgagatcccaagggttgcatttattaacaagttagaccgtatgggagccgatccatggaaagttcttaaccaggctcggtctaaactccggcaccacagtgcagctctacaagtgcccataggattagaagaggagtttgagggccttgtggatcttgtggagttgaaggcttataatttcgagggtggaagtggacaggatgtcgttacatctgatgtcccatccaacatgcaagatttagtcacggacaagagacgtgaacttattgaagttgtttcagaagtcgatgatcagcttgccgaagcttttctcaatgatgagccaatatcagctaatgagcttaaggctgctatccgaagagcaacagtagcacgcaagttcataccagtatacatgggaagtgcattcaaaaataagggtgttcaacctcttcttaatggtgtgcttgactatctaccttgtccagcggaagttgaaaactacgccctcgaccaaaacaaatcagaagagaaggtcttattgggtggaacgccagctgggcctcttgtagcattagcatttaagcttgaggaaggccgctttggtcagttgacatatctaagaatctacgatggtgtgatacggaaaggtgatttcatatacaatgtgaatacaggaaaaaagatcaaagttcctcgtttggtaaggatgcactccaatgagatggaggatattcaagaagcgcatgctggacaaattgttgctgtgtttggtgttgattgcgcatcaggtgatacatttacagacgggtcggtcaaatatactatgacttcaatgaatgtccctgaacctgtgatgtccttggctgttaacccgatatctaaagattctggtggacaattttcgaaagccctgaatcgattccagagagaagatcccactttccgtgtaggtctggatccagagagtggacagacaatcatttctggtatgggtgagttgcatttggacatctatgttgaacgcatcaggagagagtacaaggttgatgcaaaggttgggaaacctcgtgtgaacttcagggaaactatcactcagcgtgctgagtttgattacttgcacaaaaagcaatctggcggtcaaggtcaatatggacgagtatgtgggtatattgaacctcttccatcaggttctgacggtaagttcgaatttgataacatgattattggacaagcgattccgtccaacttcataccagcaatcgagaagggttttaaggaagcttgcaattcgggttcattgatagggcatccagttgagaatatccggattacgctgaccgatggggcttcacatgcagtggattccagtgagcttgcttttaagctagctgctatctatgcttttagacagtgttacactgctgctaaacctgtaatactagaacccgtgatgaaggtggaactaaaagttccaacagagtttcagggcacagtaactggggacatgaacaagagaaaaggtattattgttggaaatgatcaggaaggcgatgacacagttgtagtatgccatgttccgctaaacaatatgtttggatattcaacagcacttcgttcaatgacacagggaaaaggtgaatttacgatggagtatatggagcacaacactgtctcgcaggatgtacagatgcagcttgtaaattcacacaaggccactaagagcccagagtgattcttctagggcagaggaaacaaatttttgttccattttatatgtccatttgttctcgaatgatgggttaggacatcactaatagcctgtatttgtagaatcacatagggttgttaacacagcaatagatatcggacgcaataatccggaattcctcgctacacgcagaatattgcagctcgctacagtgaagttgaagagcgaagcaagctcccttggttttgtcgtatgtctttttggaggaaatactgttcatgaaacatgattattcagcctctgtaccttgtatagagcctaattaatgattttgtagctgcaccctataggccgactgttggtctagggtttaccagcttggcacattatcatcgttctagcgtgggacattgcacactttgccggttttgatttttctttatgtatgtatttaactctgcgtgattaaatatcaaactagtaacaatattttgtgaa

SEQ ID NO: 671 - DNA, 2405 bp, Flaveria ramosissima
caccatggttcgatctcgatcctctacgacgcgtctactgtacaccctccgttcatccatctatcaatcgtcaagatcaccgtcgccaccgtcaccaatcaccgccctcctccacctccaccgtcactactccgccgcaccgtcactgagagcgaaggaagataaggagccatggtggaaggagtcgatggagagggtgagaaacattgggatatcggctcatattgattcggggaagacgacgcttacggagagggttttgttttacaccggaaggattcatgagattcatgaggttagagggaaagatggagttggggccaagatggattcgatggaattggaaagagagaaggggattactattcagtctgcagctacttattgcacctggaaagattatcagattaatataattgatactcctggtcacgtggacttcacaattgaagttgagagagctttacgtgttcttgatggtgcaatccttgttctctgtagcgttggtggtgtgcaaagtcaatcaattactgttgatagacaaatgagaagatatgaggttcctagggttgcttttattaacaaacttgatcgaatgggagcagatccttggaaggttctcaatcaggcaaggaaaaaacttcgacatcacagtgctgcagtgcaaattccaattggtctagaagaggattttcagggtcttgtggatcttgtacaacaaaaggcgtattattttcatggttctagtggtgaaaaagttgtaaatgaagatattccggctgatatgctaacaatggttacagaaaaacgacgagaattaattgaagcggtctctgatgttgatgatcaacttgctgaattgttcctcagtgatgaacctatatcatctgctgatctcgaggcagctattcgtcgagcaactgtagcaaggaaatttattccggtatttatgggtagtgcatttaagaacaagggagtgcaaccgcttcttgatggtgttctttcttatttgccttgtccacttgaagtagacaattttgcccttgaccagtcgaagaaagaagagaaggttaagttatctggaacaccagctggacatatggttgctttggcttttaaacttgaagaacgccaatttggtcagttgacttatttaagaatttatgaaggtgtactcaggaaaggtgattttataacaaatatcaacaccgggaagaaaattaaggtatcaaaactaggccggatgcattcagattccatggaggacattcaagaagctcatgctggtcaaattgtagcagtatttggtttagattgtgcatcaggagatacttttactgatggatcagttaaatacaccatgacttctatgaatgttccagaaccggttgtttcattagcagtttcaccagtttctaaagattctggaaaacaattctcaaaagctttaaatcggtttcaaagagaggatcctacattccgtgttggattagaccctgagagtggtcagacaatcatatctggaatgggagagttacatttggaagtttatgtggagcgcattaagagggaatacaaggttgatgcaactgttggaaaacctcgtgtcaacttcagggagacaattacacaacgtgcagaatttgattatttacataaaaagcaaagtggaggtcaaggtcaatacggaagggtgtgcgggtatatggaaccccttccagcaggatcagagaccaagtttgaatttgaaaatatgatgataggacaggctataccctccaattttatcccacatattgagaagggattcagggaagctgctaattctggttctttgattggattcccagttgaaaatattcgtgttgttctgacagatggtgcttctcatgctgtggattctagtgaacttgctttcagattagcttcaatatatgcttttagacagtgttatgctaaatgcaaacctgtaatattggaacctgtgatgttggtagaactgaaagtgcctacagaatttcagggcactgttgctggggacttaaacaggagaaaaggtataatcgttggtaacgaccaggaaggagatgattctgtaattaacgcccttgtaccactgaacaatatgttcggatactccacatctcttcgttccatgacacagggaaagggtgaattcaccatggaatacaaagaacactcccctgtttcagctgatgtgcaaacacaattgatcaatgctcataaacccaagaactctgaataattagtcacagtggcttatctcgattttgcaacaattttctttcctaggatatatgtgatccgttctatcaaacgagaattacctgttatttgttgagaccgaattgtggtcagtgattttgtataagcgaataaatcct

SEQ ID NO: 672 - DNA, 2450 bp, Flaveria ramosissima
tctatccctaaattaaacaatatacttatttaaaatccgatctcgccgcattcatcttccgatacttcttcccaaataaccagttggggtttatcactgccccaatctaaaccctaacaccatggttcgatctcgatcctctacgacgcggctactgtacaccctccgttcatccatctatccatcatcaagatcaccgtcgccaccgtcaccaatcaccgccctcctccacctccaccgtcactactccgccgcaccatcactgagagcgaaggaagataaggagccatggtggaaggagtcgatggaaagggtgagaaacattgggatatcggctcatattgattcggggaagacgacgcttacggagagggttttgttttacaccggaaggattcatgagattcatgaggttagagggaaagatggagttggggccaagatggattcgatggaattggaaagagagaaggggattactattcagtctgcagctacttattgcacttggaaagattatcagattaatataattgatactcctggtcacgtggacttcacaattgaagttgagagagctttacgtgttcttgatggtgcaatccttgttctctgtagcgttggtggtgtgcaaagtcaatcaattactgttgatagacaaatgagaagatatgaggttcctagggttgcttttattaacaaacttgatcgaatgggagcagatccttggaaggttctcaatcaggcaaggaaaaaacttcgacatcacagtgctgcagtgcaaattccaattggtctagaagaggattttcagggtcttgtggatcttgtacaactaaaggcgtattattttcatggttctagcggtgaaaaagttgtaactgaagaaattccggctgatatgctaacaatggttacagaaaaacgacgagagttaattgaagcggtctctgatgttgatgatcaacttgctgaattgttcctcagtgatgaacctatatcatctgctgatctcgaggcggctattcgtcgagcaactgtagcaaggaagtttattccggtatttatgggtagtgcatttaagaacaagggagtgcaaccgcttcttgatggtgttctttcttatttgccttgtccacttgaagttgacaattttgcccttgaccagtcgaagaaagaagagaaggttaagttatctggaacaccagccggacatatggttgctttggcttttaaacttgaagaacgccaatttggtcagttgacttatttaagaatctatgaaggtgtactcaggaaaggtgattttataacaaatatcaataccgggaagaaaattaaagtatcaaaactaggccggatgcattcagattccatggaggacattcaagaagctcatgctggtcaaattgtagcagtatttggtttagattgtgcatcaggagatacttttacagatggatcagttaaatacaccatgacttctatgaatgttccagaacctgttgtttcattagcagtatcaccagtttcaaaagattctggaaaacaattctcaaaagctttaaatcggtttcaaagagaggatcctacattccgtgttggattagaccctgagagtggtcagacaatcatatctggaatgggagagttacatttggaagtttatgtggagcgcattaagagggaatacaaggttgatgcaactgttggaaaacctcgtgtcaacttcagggagacaattacacaacgtgcagaatttgattatttacataaaaagcaaagtggaggtcaaggtcaatacggaagggtgtgcgggtatatggaaccccttccagcaggatcagagaccaagtttgaatttgaaaatatgatgataggacaggctataccctccaattttatcccacatattgagaagggattcagggaagctgctaattctggttctttgattggattcccagttgaaaatattcgcgttgttctaacagatggcgcgtctcatgctgtggattctagtgaacttgctttcagattagcttcaatatatgcttttagacagtgttatgcaaaatgcaaacctgtaatattggaacctgtgatgttggtagaactgaaagtgcctacagaatttcagggcactgttgctggggacttaaacaggagaaaaggtataatcgttggtaacgaccaggaaggagatgattctgtaattaacgcccttgtaccactgaacaatatgttcggatactcaacatctcttcgttccatgacacagggaaagggtgaattcaccatggaatacaaagaacactcccctgtttcagctgatgtgcaaacacaattgatcaatgctcataaacccaagaactctgaataattaatcacaatgacttatctcgattttgcaacaattttctttcctaggatatatgtgatcccttcta

SEQ ID NO: 673 - DNA, 2510 bp, Mimulus guttatus
aaaaaatggcagcacgctcggcccgatccaaatcgacgcgcctcctctactccctctgcacggctgccgccgccgcacggctgagggaggagaaggatacctggtggaaagactccctgcagaagctccgcaacatcgggatttcggctcatatcgattcgggtaagacgacgctcacggagcgggtgttgttctacacgggtcggatccacgagattcatgaggtccgagggaaggatggggttggagcgaaaatggattccatggatttggagagagagaaagggattactatacaatctgccgctacatactgtacctggaaggattatcaggttaacataattgatacaccgggccacgtcgatttcactattgaagttgagagagctttacgtgtacttgatggtgccattcttgtcctgtgtagtgttggtggtgtacaaagtcagtcaattactgttgataggcaaatgagaagatatgaggttccacgacttgcttttattaacaaacttgaccgaatgggggctgatccgtggaaagttctgaaccaggcgagaacgaaacttcgacaccacagtgctgctgtgcagatgccaattggtttggaggaagacttcaagggtcttattgatcttgtcaacatgaaagcttgttactttcatggttccagtggtgagaccattgtatctgaagatattcctgctgatctcgaagcattagctctagaaaagcggcgtgaactggttgaagcagtctcagaggttgatgataagcttgcggaagcatttcttagcgatgagcctatattagctgctgatcttgatgaggcaattcgaagagctaccatatcacgaaaatttgtgcccgtgttcatggggagtgctttcaagaacaagggcgttcaaccacttcttgatggtgtacttagctacttgccttgtccaactgaagttactaatcaagctcttgaccagtctaaggatgaggaaaaggttgagttatctggaagtccagctggtcctcttgttgccttagctttcaagttagaagaagggcgatttggtcagttgacatatctgagaatctacgaaggtgtcattaagaagggggactttatagttaatgtgaacacaggcaagaaggttaaggttcctcgcttggttcggatgcattcaaatgaaatggaggacattcaacaagctcatgcaggacagatagttgctgtatttggtgtagattgtgcttctggggatacatttaccgatgggtcagtcagatatacaatgacctctatgagtgtgcctgagccagttatgtcactagcaatatcagcagtgtctaaagactctggaggaaacttttcaaaggctttgaatcgctttcagagggaggatccaactttccgtgttggtttagaccctgagagttcgcagacaattatatcgggaatgggagaactccatttggacatatatgttgagcgcatgaagagggagtacaaggttgaagcaactgttgggaagcctcgtgtcaacttcagggagacaattactcaacgtgccgagtttgattatctacataagaagcagagtggaggacaaggtcaatatggaagagttacggggtttatggaaccacttccaccaggctcgggaactaaattcgaattcgataacatgcttgtaggacaagctataccgtcaaattttgtgccagcaattgaaaagggtttcaaagaagctgccaactcgggttctcttataggccatcctgttgaaaatatacgtattgcattgaccgacggtgcagctcatactgtggattctagtgaacttgcttttaagttggctgctatatatgccttcagacagtgctatgaactctgcaaacctgttatattggaacctgtgatgctggtggagttaaaattcccctcagaatttcagggcactgtcactggtgatattaacaagaggaaaggcatgattgttgggaatgaccaagaagcagacgattgtgtaataactgcacatgtaccactcaacaatatgtttggttactcgactgccctccgctcaatgacacagggtaaaggtgaattcacaatggaatatttagagcatatgcaagtttctcaggatgtgcagacacaactggtgaatgcttacaaggctacaagaactggagaataatagcccatctgactgtatttgaactgtcggaccgtttattaggtcaaaagtcgagtgtgtgacatttcttcacttagttaggtttatagatattatttattaaggccaaaaagtctttattcaattttggaaaagcattaaacataaccacattgcaataatcagaacttgttctgactgggttttgtacaatatgcagaacataaatatatagttacaggtatttgcttatatgtattatttatttatttattagacattttgtaaattgctgcaattttaggcatgataataattgacatagatttgatc

SEQ ID NO: 674 - DNA, 2300 bp, Arnica chamissonis
catcatggctcgatctcgatcctctacgacgcgtctactgtacaccttgcgttcatccatctatccatcatctagatcaccgacaccaccatcaccaatcaccgctctcctccatctccaccgtcactactccgctgcaccatccctgagagaaaaggatgataaggatccatggtggaaggagtcgatggagaaggtaagaaacattggaatatcggctcatattgattcagggaaaacgacgcttacggagagggtttgttttacacgggaaggattcatgagattcatgaggttagagggaaagatggcgttggcgcaaagatggattcgatggaattggagcgagagaaagggatcactatccaatctgcagctacttattgcacttggaaagattatcagattaatataattgatactcctggtcacgtggacttcacaattgaagttgagagagctttgcgtgttcttgatggtgcaatccttgttctctgtagtgttggtggtgtgcaaagtcaatcaattactgttgatagacaaatgagaagatatgaggttcctagggttgcttttattaacaaacttgatcgcatgggagcagatccttggaaggttctcaatcaggcaaggaaaaagcttcgacatcacagtgctgcagtgcaaattccaatcgggttggaagaggattttgagggtcttgtggatcttgtgcaactaaaggcgtattattttcatggttctagcggggaaaaagttgtagccgaagatattccgggtgatatgctagcaatggttacagaaaaacgacgagaattaattgaaacagtctctgatgttgatgatcaacttgctgagttattcctcagtgatgaacctatatcatctgctgatcttgaggctgctattcgtcgagcaactatagcaaggaaatttataccagtattcatgggtagtgcatttaagaacaagggagtacaaccacttcttgatggtgttctttgttatttgccttgtccacttgaagttgacaattttgcccttgaccagtcgaataaagaagagaaggttaagttatctggaacgccagctgggcatatggttgcattggcttttaaacttgaagaacgccaatttggtcagttgacctatttaagaatctatgaaggtgtactcaggaaaggtgattttataacaaatatcaacacgggggaagaaaaattaaagtatctaaactaggtcggatgcattcagattccatggaggacattcaagaagctcatgcgggtcaaattgtagcagtatttggtttagattgtgcatcaggagatacttttacagacggatcagttaaatacacaatgacttctatgaatgttccagaaccagtcgtttcattagcagtttcaccagtttcaaaagattctggaaaacaattctcaaaagctttaaatcggtttcaaagagaggatcctacattccgtgttggattagaccctgagagtggtcagacaatcatatctggaatgggagagttacatttggaagtttatgtggagcgcattaagagggaatataaggttgatgcaactgttggaaaacctcgtgtcaacttcagagagacaattacacaacgtgcagaatttgattatctacacaaaaagcaaagtggaggtcaaggtcaatatggaagggtgtgcgggtatatggagccacttcctgcgggatcagagaccaagtttgagtttgagaatatgatgataggacaagctgtgccctccaattttatcccacatatagagaagggtttcagggaagctgttaattcgggttctttgattggatttccagttgagaatattcgtgttgttctgacagatggtgcatctcatgctgtggattctagtgaacttgctttcagattagcttcgatatatgcttttagacagtgttatgcaaaatgcaaacctgttatattggaacctgtgatgctggttgaattgaaagtgccaacagaatttcagggcactgttgctggggacttgaacaggagaaaaggtataatcgttggaaacgaccaggaaggagatgattctgtaattaacgcgcttgtcccactgaacaatatgtttggatactcgacatctcttcggtccatgacacagggaaagggtgaattcaccatggaatacaaagaacactcccctgtttctgctgatgtgcaaacacaattgatcaatgctcataaacccaagaccgccgaataattaacgcagcagctcgtgggccatttttttttc

SEQ ID NO: 675 - DNA, 2771 bp, Sorghum bicolor
ctagggttttctgtaacagagccaggccacccaaagtcccaagtccaaaacccagccagagccagagccaccatcgccgccgcctcggtcgcgattcctaggcggcaatggccatggcccggcgttctgcctcccatctcctatcctccttccgccccttttccctcctcctccagccgcacctcgctgactccccctcgccggcggccgcggccgcggcggcgtcagctcggcgggcgatgtcggcggcgtcggccctacgtgcacgggacgagaaggatgtggcgcggtggcgggagtcgatggcccggatgcggaatatcggcatctccgcgcacatcgactctgggaagacgacgctcacagagcgggtcctctactacaccggcaggatccacgagatccacgaggtgcgcggccgtgacggcgtcggcgctaagatggactccatggacctcgagcgcgaaaaggggattaccattcagtctgctgccacctactgcacctggaaggattaccagattaatattattgatactccaggtcacgtggatttcaccattgaggttgaaagggcactccgtgttcttgatggtgctatacttgtgctatgtagtgttggtggtgtacaaagtcagtcgatcactgttgatcggcaaatgagaagatatgacatcccaagggttgctttcattaacaagttggaccgtatgggagctgatccatggaaggttcttaaccaggcgcgatccaagctccgtcaccacaatgcagctgtacaagtacccataggattagaagaggagtttgagggccttgttgaccttgtagaaatgaaggcttataagttcgagggttctagtggccagaatgtaactgcttctgatattccattgaacatggaggatttagtcactgagaagcgtcgtgaacttattgaagttgtttctgaagtagatgatcagcttgctgaagcttttctcaatgatgagccaataacagctaatcagcttaaggctgctattcgaagagctacagtggcacagaagttcataccagtatacatgggaagtgcattcaaaaataagggtgttcaaccgcttcttgatggcgtgctggattatctaccatgcccgttggaggttgataactacgcccttgatcaaaacaaatccgaagagaaggtactattggctggaactccagctgaaccacttgtggcattagcgtttaagctagaggaaggtcgttttggtcagctgacctatctaagaatctatgatggtgttataaggaagggtgacttcatatacaatgtcaatacagggaagaaaatcaaagttcctcgcttggtaaggatgcactctaatgagatggaggatattcaagaagcatatgctggccaaattgttgctgtttttggtgttgattgtgcatcaggcgatacatttacggatggaacagtgaaatatactatgacttcaatgaatgtccctgaacctgtgatgtccttggcagtttcacctatatctaaagactctggaggacaattttcgaaagctctgaatcgcttccaaaaggaggatcctactttccgtgtgggtttggatgctgagagtggccagacaattatttcagggatgggtgagctgcatctggatatatatgttgaacgtattaagagagagtacaaggtggatgcaaaggtaggaaaacctcgtgttaacttcagggaaacaatcacccagcgtgctgaatttgattatttgcacaaaaagcaatctggcggtcaaggtcagtatggacgagtttgtgggtacattgagcctcttccatcaggttctgatggtaaattcgaatttgataacatgattattggacaagcaattccttcaaactttataccagcaatagagaagggttttagggaagcttgcaattcgggttcattgatcggtcatcctgttgaaaatttaagaattgtactgactgatggggcttcacatcaggtggattccagtgaacttgcttttaagctagctgctatctatgcttttcgacagtgttacacttctgccaaacctgtaatattagaacctgtgatgaaggtggaactcaaatttccaacagagttccagggcaccgtaactggtgatatgaacaagagaaaagggatcattgttggaaatgagcaggaaggtgacgacaccattgtagtttgccatgttccgctaaacaatatgtttggatatgcaacagctattcgatcagtgactcaggggaaaggtgaatttacgatggagtacctggagcataatgttgtctcgcaggatgtacagatgcaattagtgaactcatacaaggcggccaagggcacagagtgattcttctttttgcagaagaataaattttgtttacaaactttcagtagcatcgaattcccggtcctcgggacatcacaaatagtaggcgataattcaaactatatggtttctcagtgaaaatacaagggagctatgctgcaataattggcattcccacagtagaattgtacaatatctagcaaatgtcggaagtttagtttgtaatgattaccatgtcttggcatgggaacatcttgtgcaatttctcccaaaaaaatatgggacactttcaatccatatatcttttgctctccttgttgttgtacttatttcctgaatttcataaactgtaaagtaaatggcaggaacgatcgaggtataaaatgctcaagttcaaagagtttggtt

SEQ ID NO: 676 - DNA, 2815 bp, Sorghum bicolor
agacaaagagcgaggtggcgatgaggtgcaaggcttgttaaggactagggttttctgtaacagagccaggccacccaaagtcccaagtccaaaacccagccagagccagagccaccatcgccgccgcctcggtcgcgattcctaggcggcaatggccatggcccggcgttctgcctcccatctcctatcctccttccgccccttttccctcctcctccagccgcacctcgctgactccccctcgccggcggccgcggccgcggcggcgtcagctcggcgggcgatgtcggcggcgtcggccctacgtgcacgggacgagaaggatgtggcgcggtggcgggagtcgatggcccggatgcggaatatcggcatctccgcgcacatcgactctgggaagacgacgctcacagagcgggtcctctactacaccggcaggatccacgagatccacgaggtgcgcggccgtgacggcgtcggcgctaagatggactccatggacctcgagcgcgaaaaggggattaccattcagtctgctgccacctactgcacctggaaggattaccagattaatattattgatactccaggtcacgtggatttcaccattgaggttgaaagggcactccgtgttcttgatggtgctatacttgtgctatgtagtgttggtggtgtacaaagtcagtcgatcactgttgatcggcaaatgagaagatatgacatcccaagggttgctttcattaacaagttggaccgtatgggagctgatccatggaaggttcttaaccaggcgcgatccaagctccgtcaccacaatgcagctgtacaagtacccataggattagaagaggagtttgagggccttgttgaccttgtagaaatgaaggcttataagttcgagggttctagtggccagaatgtaactgcttctgatattccattgaacatggaggatttagtcactgagaagcgtcgtgaacttattgaagttgtttctgaagtagatgatcagcttgctgaagcttttctcaatgatgagccaataacagctaatcagcttaaggctgctattcgaagagctacagtggcacagaagttcataccagtatacatgggaagtgcattcaaaaataagggtgttcaaccgcttcttgatggcgtgctggattatctaccatgcccgttggaggttgataactacgcccttgatcaaaacaaatccgaagagaaggtactattggctggaactccagctgaaccacttgtggcattagcgtttaagctagaggaaggtcgttttggtcagctgacctatctaagaatctatgatggtgttataaggaagggtgacttcatatacaatgtcaatacagggaagaaaatcaaagttcctcgcttggtaaggatgcactctaatgagatggaggatattcaagaagcatatgctggccaaattgttgctgtttttggtgttgattgtgcatcaggcgatacatttacggatggaacagtgaaatatactatgacttcaatgaatgtccctgaacctgtgatgtccttggcagtttcacctatatctaaagactctggaggacaattttcgaaagctctgaatcgcttccaaaaggaggatcctactttccgtgtgggtttggatgctgagagtggccagacaattatttcagggatgggtgagctgcatctggatatatatgttgaacgtattaagagagagtacaaggtggatgcaaaggtaggaaaacctcgtgttaacttcagggaaacaatcacccagcgtgctgaatttgattatttgcacaaaaagcaatctggcggtcaaggtcagtatggacgagtttgtgggtacattgagcctcttccatcaggttctgatggtaaattcgaatttgataacatgattattggacaagcaattccttcaaactttataccagcaatagagaagggttttagggaagcttgcaattcgggttcattgatcggtcatcctgttgaaaatttaagaattgtactgactgatggggcttcacatcaggtggattccagtgaacttgcttttaagctagctgctatctatgcttttcgacagtgttacacttctgccaaacctgtaatattagaacctgtgatgaaggtggaactcaaatttccaacagagttccagggcaccgtaactggtgatatgaacaagagaaaagggatcattgttggaaatgagcaggaaggtgacgacaccattgtagtttgccatgttccgctaaacaatatgtttggatatgcaacagctattcgatcagtgactcaggggaaaggtgaatttacgatggagtacctggagcataatgttgtctcgcaggatgtacagatgcaattagtgaactcatacaaggcggccaagggcacagagtgattcttctttttgcagaagaataaattttgtttacaaactttcagtagcatcgaattcccggtcctcgggacatcacaaatagtaggcgataattcaaactatatggtttctcagtgaaaatacaagggagctatgctgcaataattggcattcccacagtagaattgtacaatatctagcaaatgtcggaagtttagtttgtaatgattaccatgtcttggcatgggaacatcttgtgcaatttctcccaaaaaaatatgggacactttcaatccatatatcttttgctctccttgttgttgtacttatttcctgaatttcataaactgtaaagtaaatggcaggaacgatcgaggtataaaatgctcaagttcaaagagtttggtt

SEQ ID NO: 677 - DNA, 2755 bp, Oryza sativa
gaacaaatttgccctcttcatttttcctcgacggcccagctccctcgaccaaacagaccagtagggttttaggaggcaacacgccgccctgcgccgccgccgccgccgccgccaccgccaccgccaccgccagattctcctaagcggcgatggccatggcacggcgttccgcctcccgtctcctctcctcgttccgccccttctcgctcctcctccaaccgctcgatgacgccccttcgctctcggccgcggcggcagcagcgtcggcccgccgggggatgtcttcggcgtcggcgctgcgggcgcgggacgagaaggaggtggcgaggtggcgcgagtcgatggaccggatgcggaatatcggaatctccgcgcacatcgactccgggaagacgacgctgacggagcgcgtcctgtactacaccggccggatccacgagatccatgaggtgcgtggccgcgacggcgtgggcgcaaagatggactccatggacctcgagcgcgagaagggcatcaccatccagtccgctgcaacctactgcacctggaatggataccaggttaatatcatcgatactccaggtcatgtggatttcactattgaggttgaaagagcactccgtgttcttgatggtgctatacttgtgctatgtagtgttggtggtgtacaaagtcaatcaattactgtcgatcggcaaatgagaagatatgaaattccaagggttgcatttatcaacaagttggatcgcatgggagctgatccatggaaagttctcaaccaggcacgttccaaacttcggcaccacaatgcagctgtacaggtgccgataggattagaagaagagtttgaaggcctggtggatcttgtggagttgaaggcttataagttcgagggtggtagtggccagaatgttgttgcatctgatgttccatccaacatgcaagacttagtcatggagaagcggcgtgaacttattgaagttgtttctgaagtagatgatcagcttgctgaagcttttctcaatgatgaaccaatacaagctaatcaactcaaggcagctattcgaagagcaacagtagcacgcaagtttataccagtttacatgggaagtgcattcaaaaataagggtgtccagccgcttcttgatggtgtgcttgactatttaccttgtccaatggaagttgaaagctacgcacttgatcaaaacaaatcagaagagaaggtcttattggctggaactcctgctgagccacttgtggcattagcatttaagctggaggaaggtcggtttggtcaattgacatatctaagaatctatgatggggttataaggaagggtgatttcatttacaatgtgaatacagggaagaagattaaggttcctcgcttggtaaggatgcactccaatgagatggaggatattcaagaagcacatgctggtcaaattgttgctgtctttggtgttgattgtgcgtcaggtgatacatttacagatggatcagtgaaatataccatgacttccatgaatgtccctgaacctgtgatgtccttggctgtctcccctatatctaaagattctggaggacaattttcaaaggctctgaatcgtttccagaaagaggatcctactttccgtgtaggtctggatccagaaagtggagagacaattatttctgggatgggtgagctgcatttggatatctatgttgaacgcatcaggagagagtacaaggttgatgcaaaggtcggaaaacctcgtgtgaacttcagggaaactatcactcagcgtgctgaatttgattacttacacaaaaagcaatctggtggtcaaggtcaatatggacgagtttgcgggtacattgagcctcttccatcagaatctgatggtaaatttgagtttgataacatgatcattggacaagcaattccttcaaacttcataccagcaattgagaagggttttaaggaagcttgcaattctggttcgttgatagggcatcctgtggaaaatattcgaattgtgctgactgatggtgcttcacatgcagtggattccagcgaacttgcttttaagttagcttctatctatgcttttagacagtgttatgctgctgctagacctgtaatattggaaccagtgatgaaagtggaactaaaagttcctacagagttccagggcacggtaaccggtgacatgaacaagagaaagggtatcattgttggaaatgatcaggaaggcgacgacacagttgtggtttgccatgttccactaaacaatatgtttggatattcaacagctcttcggtcaatgacacaggggaaaggtgaattttcgatggagtatctggagcacaataccgtatcgcaggatgtacagatgcaactagtgaatacgtacaaggccagcaggggcacagagtaatacagaaaaaaaagaaacagtcacttagttaacgttgcattttgtggcccttaatgatgctaggacatcactagtagagtgattcttctagattacataaacaaattttggtttcactttgtatgttaacattgtattttacggccccccgttgtgatgagccatgacatcactaataggtttatacatgggtttctcgatacgacgatagaattgtgatacaataatctgcactccttatacgcaaacgtacgtgatgatcgaattagagcaagttctgtttggacaatgaaaatttcgttatttcttcaagaaatttctggttttttgat

SEQ ID NO: 678 - DNA, 2753 bp, Oryza sativa
gaacaaatttgccctcttcatttttcctcgacggcccagctccctcgaccaaacagaccagtagggttttaggaggcaacacgccgccctgcgccgccgccgccgccgccgccaccgccaccgccaccgccagattctcctaagcggcgatggccatggcacggcgttccgcctcccgtctcctctcctcgttccgccccttctcgctcctcctccaaccgctcgatgacgccccttcgctctcggccgcggcggcagcagcgtcggcccgccgggggatgtcttcggcgtcggcgctgcgggcgcgggacgagaaggaggtggcgaggtggcgcgagtcgatggaccggatgcggaatatcggaatctccgcgcacatcgactccgggaagacgacgctgacggagcgcgtcctgtactacaccggccggatccacgagatccatgaggtgcgtggccgcgacggcgtgggcgcaaagatggactccatggacctcgagcgcgagaagggcatcaccatccagtccgctgcaacctactgcacctggaatggataccaggttaatatcatcgatactccaggtcatgtggatttcactattgaggttgaaagagcactccgtgttcttgatggtgctatacttgtgctatgtagtgttggtggtgtacaaagtcaatcaattactgtcgatcggcaaatgagaagatatgaaattccaagggttgcatttatcaacaagttggatcgcatgggagctgatccatggaaagttctcaaccaggcacgttccaaacttcggcaccacaatgcagctgtacaggtgccgataggattagaagaagagtttgaaggcctggtggatcttgtggagttgaaggcttataagttcgagggtggtagtggccagaatgttgttgcatctgatgttccatccaacatgcaagacttagtcatggagaagcggcgtgaacttattgaagttgtttctgaagtagatgatcagcttgctgaagcttttctcaatgatgaaccaatacaagctaatcaactcaaggcagctattcgaagagcaacagtagcacgcaagtttataccagtttacatgggaagtgcattcaaaaataagggtgtccagccgcttcttgatggtgtgcttgactatttaccttgtccaatggaagttgaaagctacgcacttgatcaaaacaaatcagaagagaaggtcttattggctggaactcctgctgagccacttgtggcattagcatttaagctggaggaaggtcggtttggtcaattgacatatctaagaatctatgatggggttataaggaagggtgatttcatttacaatgtgaatacagggaagaagattaaggttcctcgcttggtaaggatgcactccaatgagatggaggatattcaagaagcacatgctggtcaaattgttgctgtctttggtgttgattgtgcgtcaggtgatacatttacagatggatcagtgaaatataccatgacttccatgaatgtccctgaacctgtgatgtccttggctgtctcccctatatctaaagattctggaggacaattttcaaaggctctgaatcgtttccagaaagaggatcctactttccgtgtaggtctggatccagaaagtggagagacaattatttctgggatgggtgagctgcatttggatatctatgttgaacgcatcaggagagagtacaaggttgatgcaaaggtcggaaaacctcgtgtgaacttcagggaaactatcactcagcgtgctgaatttgattacttacacaaaaagcaatctggtggtcaaggtcaatatggacgagtttgcgggtacattgagcctcttccatcagaatctgatggtaaatttgagtttgataacatgatcattggacaagcaattccttcaaacttcataccagcaattgagaagggttttaaggaagcttgcaattctggttcgttgatagggcatcctgtggaaaatattcgaattgtgctgactgatggtgcttcacatgcagtggattccagcgaacttgcttttaagttagcttctatctatgcttttagacagtgttatgctgctgctagacctgtaatattggaaccagtgatgaaagtggaactaaaagttcctacagagttccagggcacggtaaccggtgacatgaacaagagaaagggtatcattgttggaaatgatcaggaaggcgacgacacagttgtggtttgccatgttccactaaacaatatgtttggatattcaacagctcttcggtcaatgacacaggggaaaggtgaattttcgatggagtatctggagcacaataccgtatcgcaggatgtacagatgcaactagtgaatacgtacaaggccagcaggggcacagagtaatacagaaaaaaaagaaacagtcacttagttaacgttgcattttgtggcccttaatgatgctaggacatcactagtagagtgattcttctagattacataaacaaattttggtttcactttgtatgttaacattgtattttacggccccccgttgtgatgagccatgacatcactaataggtttatacatgggtttctcgatacgacgatagaattgtgatacaataatctgcactccttatacgcaaacgtacgtgatgatcgaattagagcaagttctgtttggacaatgaaaatttcgttatttcttcaagaaatttctggttttgtg

SEQ ID NO: 679 - DNA, 1587 bp, Arabidopsis lyrata
aactaaccaaacataactgcagtctcttttttttgtttcgatggaactcgataaagatcagacagtcatgtcggaggataaaaagcctcaagatccaaatcccagatttgcttgcgaaggttgcagcgttttgctcgacgtcaacgatggtgaccgtctcgttttcgctcgtttatctggtggcgctatattaaagattgggaataagaattattctttaaagccattgatcggagctccgtttggatctctgttccaagtcgaaaccggagaagatggttctttcctctctcgcatttttcccattaaacaagaaaatagcagtaataatgttatggacgattctagagataatcgggaaatcgtcgacaacaatgaagctcagaaccttactggtgaagaaattgaagcaatgcggagagagggtgcaaaaggggatgaaattattgaagctctaattgcaaacagcaaaacatttgataagaagtttcagttgtctcaggaaaaatataagcttaaaaagcagaagaaatatgcaccaaagcttcttcttcgacggccttttgctagaagtatatgtgaagcttatttcaagaaataccccgccagaattggattcttacgagtagatgcgttgtctcttctgttaacaatggctaatgtcactgcatactcggatgtgcttgtggtggatatggttggtggccttgtcactggtgcagtggctgaaagattaggaggcactggttatgtttgcaatacatataagggaagtgctccttatcctgtggagatggtaaggatgttcaactttagtgacaaggttttagagaggatcgtgcagtcatcgataaacgagctctcgtcagccaatactgcgtctcctgaaggaaacaatcaacaagaaggagtttgtaacgctgagaataatattaatgcaagaaacgtcatctacatctgatattatggtagaagaaatatctgcgacaactgaggctggagtagtagatattgttgtaccagagagcaaagttatcaaagccgcaaaagctggagccaaagcttcaaaagaaacaatagagatgtggcgagaaaacggcttttcgagcctaatcatcgctgcgcaagaccaagacccatggagcgtagctaaagatgtattgccactgctgtcttactctgctccctttgtaatatatcatcagtatttacagccgctggcgacatgtatgcacaagcttcaacaggggaagatggcgatcaatctgcaaataacagaaccatggctacgcgaatatcaggtgcttccttcaagatctcatcctcacatgcagatgagttcttttggaggctatgttctgagtggcatcagaatctctaccacttgactgttgttttcaaaaccagaaactgtggtttgatgtttggtctttaaggtctttgtggttgttgttgttgtaacattaagggctgagattatgagaacactccaaataattgaaaattttgccggatattttaagataatacatccatttaccttcaaatttcttgatcgttttgtatgtccacaactgaagactgata

SEQ ID NO: 680 - DNA, 1543 bp, Eutrema halophilum
aacaaaacaaaacaacactgcagtgtttttttttcttttcctgaaataaaagatggagctcaataaggatcaggcaaccatgtcggagaataataagcctcaagatccagatcccagatttgcttgcgaaggttgcagcgttttgctcgacgtcaacgatggcgatcgtctcgtctttgctcgtctctctggtggcgctatattaaaaattgggaataaaaattactctttaaagccaatgatcggagctccgtttggatctctgttccaagtcgaaagcggagatgaaggctctttcctctctcgcattctacccgttaaacaagaaaataaaagtaataatgttatcgacgattcgagagataatcgggaacttgtcgacaacaatgaagcccaaaaccttactggtgaagaaattgaagctatgcggagagagggtgcaaaaggggatgaaatcattgaagctctaattgcaaacagcaaaacatttgaaaagaagtttcagttgtctcaggaaaaatatctgcttaagaagcagaagaaatatgcgccaaaggtgcttcttagacggccttttgctcgaagtatatgtgaggcttatttcaagaaatacccagaaagaatcggattcttacgagtagacgcgttatctcttttgttaacaatggctaatgtcaccgcatactcggatgtgcttgtggtggatatggttggtggccttgtcactggagcagtggccgaacgattaggaggcactggttatgtttgcaatacatacaagggaaattctccttcttctgtggagatggttaggatgttcaactttagtgacaaggttataaagaggatcgtgcagtcatctataaacgagctctcatcagccaaaactgtatctcctgaagaaaacaatcaacaagaaagagtttgtaacgctgagattaatatcaatgaaccatctacatctgatattgtagaagaaacatctgtgacagctgaggctatggtagtagatattgttgccccagagagcaaaatcatcaaggctccaaaagctggagccaaggcttcgaaagaagcaatagaaatgtggcaagaaaacggtttctctagtctaatcatggctgcacaggaccaagacccatggagcttagctaaagatgtattgccactgctctcctgctctgctccttttgcaatatatcatcagtatttacagccgctggcgacatgtatgcacaaccttcagcaggggaagatggcgatcaatctgcaaataacagaaccatggctacgtgaatatcaggtgcttccttcaagaactcaccctcacatgcaaatgagttcttttggaggctatgttctgagcggcatcagaatctctactacttgattcttgttttcgaacctcatgattcttatcattttcaataactgaggtttgatgtttgatctttcctttcagaaaggtctttgtattcgtatgttgttaagatatagggctgagattataggaaaactttcatgttgatcttttcaatctaat

SEQ ID NO: 681 - DNA, 1571 bp, Eutrema parvulum
acactgaattgttcacttgtctctaaactgaattaatccaaaaacaaaactgcagttttttcttctcttctttatatcgatggagcacaatagggatcaggcaggcatgtcggagaataataataagcctcaagctccaaatcccagatttgcttgcgaaggttgcagcgttttgctcgacgtcaacgatggtgaccgtctcgtcttcgctcgtctatctggtggcgctatattaaaaattgggaataagaattactctttgaagccattgatcggagctccgtttggatctctattccaagtcgaaaccggagaagaaggttctttcctttctcggatcctacccgtcaaaaaagaaagtaccagtaatagtgttatcgaagattcgagagataatcgggaacttgtcgacaataatgaagcccaaaaccttactggtgaagaaattgaagctatgcggagagagggtgcaaaaggagatgaaattattgaagccctgattgcaaacagcaaaacatttgaaaagaagtttcagttgtctcaggaaaaatataagcttaagaagcagaagaagtatgcgccaaagctgcttctaagacggccttttgctcgaagtatctgtgaagcttatttcaagaaatatccagccagaatcggatttttacgagtagatgcgttatctcttctgttaacaatggctaatgtcaccgcatactcggatgttcttgtggtggatatggtcggtggccttgtcactggtgcagtggctgaacgattaggaggcactggttatgtttgcaatacatataaaggaaattccccttaccctgtggagatggttaggatgttcaactttagtgacaaggttatagagaggattgtgcagtcatctataaacgagctctcatcacccaaaactgcatctcctgaagaaaacaatcaacaagaaggagaaccatctacatctgatatggtagaagaaatatctgtgacagctgagactggagtagtagatgataatgttgtcccagagagcagaattatcaaggccccaaaagctggagccaaggcttcgaaagaagcaatagaaatgtggcaagaaaacggtttctctagcctaatcatggcagcacaagaccaagacccatggacattagctaaagatgtattgccactgctctcctactcagctccctttgcaatataccatcagtatttacagcctctggctacatgtatgcacaaccttcagcaagggaagatggctatcaacctgcaaataacagaaccgtggctacgcgaatatcaggtgcttccttcgagaactcaccctcacatgcagatgaactcttttggaggctatgttctcagtggcatcagaatctcggccacttgattcttgttttcgaacctcatttttcgaaacgttttcagtaaaacagaggtttggtgtttgatcttttcttttaaaaggtctttgtatttgtttgttgagatatagagctgagatgatagggaactaaattatatattttttatatatttgtttgtttttttttaatctaatttta

SEQ ID NO: 682 - DNA, 1372 bp, Brassica napus
gaagccgaaaacagaaactccatttcttttttttttctcgatggagcagaacaaggatcaggcagttatgtcggagaataataacaataaggctcaagatccaaatccgagagttgctggcgaaggctgcagcgttttgctggacgtgaacgatggtgaccgtctcgtcttcgctcgtctctctggtggcgctgtattaaagatagggaataagaattactcgttaaagccactgatcggagctccgtttggatctatcttccaagtcgaaaccggagaagatggttctttcctctctcgcattctccccatcaagaaagaaagtagcagcaataatgttatagacgatgctagggataatcgagaacttatcgataataatgaagctcaaaacctcactggtgaagagattgaagctatgcggagggagggtgcaaagggggatgagattatcgaagcactgattgcaaatagcaaaacatttgaccagaagtttcagttgtctcaggaaaaatataagcttaagaagcagaagaagtatgctccgaagctgcttctaagacgcccttttgctcgcagtatctgtgaagcttatttcaaaaaatatccagccagaatcggattcatacgtgtagatgcgttatctcttttgttaacaatggctaacgtcaccgcacactcggatgtgcttgtggtggatatggttggtggtctcatcactggtgcagtggctgaacgtttaggaggcactggttatgtttgcaatacttataaaggaaactctcctccctctgtggagatggttaggatgttcaactttactgacaaggttatagagaggatcgtgcagtcatctatagacgagctctcagcagccaaaactgtttcccctgaagaaaacaatcaacaaggaggagttcacccatctacatctgatatggtagaagacacacctgtgacagctgaggccagagtagtagatgatgcttttccagagagcaaaattgtcaaggccccaaaagctggagccaaggcttcaaagacgcaatagaaatgtggaaagaaaacggcttctctagtttaataatggcagcacaagaccaagacccatggagtttagctaaagatgtattgccactgctctcctactctgctccctttgcaatatatcatcagtacttacagcctctggcgacatgtatgcacaaccttcagcaagggagatggctatcaatctgcaaataacagaaccctggctacgcgaatatcaggtgctaccatcaagaactcaccctcacatgcagatgagctcttttggaggctatgttcttagcggcatcagaatttctaccgcttgattcttatctccaaa

SEQ ID NO: 683 - DNA, 1590 bp, Raphanus sativus
  misc_feature (182)..(182): n is a, c, g, or t
  misc_feature (206)..(206): n is a, c, g, or t
  misc_feature (1138)..(1138): n is a, c, g, or t
  misc_feature (1141)..(1141): n is a, c, g, or t
  misc_feature (1153)..(1153): n is a, c, g, or t
  misc_feature (1176)..(1177): n is a, c, g, or t
  misc_feature (1192)..(1192): n is a, c, g, or t
  misc_feature (1342)..(1342): n is a, c, g, or t
  misc_feature (1490)..(1490): n is a, c, g, or t
  misc_feature (1497)..(1497): n is a, c, g, or t
ggacacaaaacgggtattcactttgcctttaaactaaactaagcgaaaacataaactgcagttctgtttctctttctttctcgatggagcacgataaggatcaggctatgtcggagaataaaaataacagcaacaaggctcaagacataaatcctagatttgctagcgaaggttgcagcgtnttgcttgacgtgaacgatggagancgtctcgtcttcgctcgtctatctggtggcgctggattaaaaatagggaatacgaggtactcgttaaagccattgatcggagctccgtttggatctctgttccaagtcgaaagcggatcagaagaaggttctttcctctctcgcattcttcccatcaaaaaagaaagtactagtaataacgttaccgaagatactagagataatcgcgaacttatcgacaacaatgaagctcaaaaccttactgaagaagaaattgaagctatgcggagagagggtgcaaaaggagatgagattattgaagcactgattgcaaacagcaaaacatttgacaagaagtttcagttgtctcaggataaatataagcttaagaagcagaagaagtatgcacctaaggtgcttctgaggcgtccttttgctcgaagtatctgtgaagcttatttcaagaaatatccagccagaatcggattcttgcgagtagatgcgttatctcttctgttaacaatggctaatgtcaccgcatactcggatgtgcttgtggtggatatggttggtggccttgtcactggtgcggtggccgaaagattaggaggcactggttatgttgcaatacatataaaggaaacaatccttcctctgtggatatggttaggatgttcaactttactgacaaggttatagagaggatcgtgcagtcatctataaacgagctctcatcagccaaaactgcatctcctgaaggaggagtttgtaactctgagattaatatcaatgaatcatctgcatctgataaggttgaagatgtatctgtgacagctgaggccagagtagtagatgatgttgttctcccagagagcaaagttatcaaagccccaaaagctggagccaaagcttcaaaagaagcagtagaaatgtggaaagaaaacggtttctcnagnttaatcatggcngcacaagaccaagacccatggannttagctaaagatgtnttgccactgctctcctactctgctccctttgcaatatatcatcagtatttacagcctcttgcgacatgtatgcacaaccttcagcaagggaagatggccatcaatctgcaaataacagaaccctggctacgcgaatatcaggtgcttccntcaagaactcaccctcacatgcagatgagctcttttggtggctatgttcttagcggcatcagaatctctaccacttgatgattcttatctcccaaacctcaagtcttctctttaccattttcagtaactgaggtttggtttcatcttnttttacnaaaaaggtctttgtatttttgtttgttgttgagatataaagctgagatttttcatgttgtgaccttttaaattaataaaacactgttttgctt

SEQ ID NO: 684 - DNA, 1561 bp, Brassica rapa
aaggcgaaaacagaaactccagtttttttttctcgatggagcacaataagaatcaggcagttatgtcggagaataataataacaacaaggctcaagatccaaatccgagatttgctagcgaaggctgcagcgttttgctggacgtgaacgatggtgaccgtctcgtcttcgctcgtctctctggtggcgctgtattaaagatagggaataagaattactcgttaaagccactgatcggagctccgtttggatctatcttccaagtcgaaaccggagaagacggttctttcctctctcgcattctccccatcaagaaagagagtagcagcaataatgttatagacgatgctagggataatcgagaacttatagacaataatgaagctcaaaacctcactggtgaagagattgaagctatgcggagagagggtgcaaagggggatgagattattgaagcactgattgcaaatagcaaaacatttgaccagaagtttcagttgtctcaggaaaaatataagcttaagaagcagaagaagtatgctccaaagctgcttctaagacgaccttttgctcgcagtatctgtgaagcttatttcaagaaatatccaaacagaatcggattcatacgtgtagatgcgttatctcttttgttaacaatggctaacgtcaccgcacactcggatgtgcttgtggtggatatggttggtggtctcatcactggtgcagtggctgaacgtttaggaggcactggttatgtttgcaatacttataaaggaaactctcctccctctgtggagatggttaggatgttcaactttactgacaaggttatagagaggatcgtgcagtcatctatagacgagctctcagcagccaaaactgtttcccctgaagagaacaatcaacaaggaggagttcacccatctacatccgatatggtagaagacacacctgtgacagctgaggccagagtagtagatgatgctgttccagagagcaaaattgtcaaggccccaaaagctggagccaaggcttcaaaagacgcaatagaaatgtggaaagaaaacggcttctctagtttaataatggcagcacaagaccaagacccatggagtttagctaaagatgtattgccactgctctcctactctgctccctttgcaatatatcatcagtacttacagcctctggcgacatgtatgcacaaccttcagcaagggaagatggctatcaatctgcaaataacagaaccctggctacgcgaatatcaggtgctaccatcaagaactcaccctcacatgcagatgagctcttttggaggctatgttcttagcggcatcagaatttctaccgcttgattcttatctccaaaacctcaattcttctcttttcattttcaataagactgaggtttggtgtttgatattttcttttcgaaaggtctttgtatttgtatgttgttgagatatataggggatgagattatggttaaactttcatgttgcgactcttgttgtttgtttttttatctaataatatcatcattttttttatcgttttg

SEQ ID NO: 685 - DNA, 1444 bp, Brassica juncea
ctgaattaaaccccaaaaaacagaaactgcagtttattttctctctctgtctcgatggagcacagtaaggaggatcaggctaagtcggaggatcagaaaatcaataaggctcaagatccgaacccgagatttgctagcgaaggttgcagcgtgttgctggacgtgaacgacggtgaccgtctcgtcttcgctcgtctatctggtggcgctatattcaaaatcgggaatacgaattactcgttgaagccattgattggagctccgtttggatctctgttccaagtcgaaaccggagaagatggctctttcctctctcgcattcttcccgtcaaaaaagaaagcaccagcgttaatgttgtagacgatgatgctagagataatagggaacttatcgacgataatgaatctcaaaacctcacctgtgaagagattgaagctatgcggagagagggtgcaaaaggagacgagattattgaagcactgattgcaaacagcaaaacatttgacaagaagtttcagttgtctcaggaaaaatataagcttaagaagcagaagaagtatgccccaaaggtgcttctaagacgcccttttgctcgaagtatctgtgaagcttatttcaagaaatatccagccagaatcggattcatacgtgtagatgcgttatctcttttgttaacgatggctaacgtcaccgcatactcggatgtgctagtggtggatatggtgggtggccttgtcactggtgcagtggctgaacgattaggaggcactggttatgtttgtaatacatataaaggggattctccttcctctgtggatatggttaagatgttcaactttaccgacaagattagagagaggatcgtgcattcatctataaacgagctctcatccgccaaagctgcatctcctgaagaaaacaatcaacaagactcatctgcatctgatatggtagaagatgtatctgtgacagctgaggccagagtagtagatgatgttgtcacagagagcaaaactatcaaggccccacaacctggagccaaagcttcgaaagaagctgtagaaatgtggaaagaaaacggtttctctagcttaatcatggcagcgcaagaccaagacccatggactttagctgaagatgtattgccactgctctcctactctgctccctttgcaatatatcatcagtatttacagcctctggcgacatgtatgcacaaccttcagcaaggaaagatggccatcaatctgcaaataacagaaccatggctacgcgaatatcaggtgcttccatcaagaactcaccctcacatgcagatgagctcttttggaggctatgtccttagcggcatcagaatctccaccacttgattctcatctccaaaccccattcttctctttatcattttcaagaactgaggtttggtttttgatcctttgtttt

SEQ ID NO: 686 - DNA, 1313 bp, Brassica napus
gaaataacaacaataaggactcatcaagatccaaatccgagattgctagcgaaggttagctagcgtttgctggacgtgaacgatggtgaccgtctcgtcttcgctcgtctctctggtggcgctgtattaaagatagggaataagaattactcgttaaagccactgatcggagctccgtttggatctctcttccaagtcgaaaccggagaagatctctctcgtatccttcccgtcaaaaaggaaagtagcagcaataatgttatagacgatgctagagataatagggaacttattgataataatgaagctcagaacctcactggtgaagagattgaagctatgcggagagagggtgcaaaaggggatgagattattgaagcactgattgcaaacagcaaaacgtttgaccagaagtttcagttgtctcaggaaaagtataagcttaagaagcagaagaagtatgctccaaagctgcttctaagacgcccttttgctcgaagtatctgtgaagcttatttcaagaaatatccaaacagaatcggattcttaagagtagatgcgttgtctcttttgttaacgatggctaatgtcactgcgtactcggatgttcttgtggtggatatggttggtggccttgtcactggtgcggtggctgaacgattaggaggcactggttatgtttgcaacacatataaaggaaactctcctccctctgtggagatggttaggatgttcaattttactgacaaggttatagagaggatcgtgcagtcatctataaacgagctctcatcagccaaaactgtttcccctgaagagaacaatcatcaagaaggagttcacccatctacatctgatatggtagaagacacagctgtgacagctgaggccagagtagtagtagatgatgttgttttagagagcaaaattgtcaaggccccaaaagctggagccaaggcttcaaaagaagcaatagaaatgtggaaagaaaacggtttctctagtttaatcatggcagcacaagaccaagacccatgggccttagcgaacgatgtgttgccactgctctcctactctgctccctttgcaatatatcatcagtatctacagcctctggcgacatgtatgcacaaccttcagcaagggaagatggccatcaatctgcaaataacagaaccgtggctacgcgaatatcaggtgcttccatcaagaactcaccctcacatgcagatgagctcttttggaggctatgttcttagcggcatcaggatctccaccacttgaatcttatctccaaaacctctccaaacctc

SEQ ID NO: 687 - DNA, 1512 bp, Brassica rapa
taaactcccaaaaaacaaaactgcagtttattttctctctcggtctcgatggagcacagtaaggaggatcaggctaagtcggaggatcagaaaatcaataaggcacaagatccaaatccgagatttgctagcgaaggttgcagcgtgttgctggacgtgaacgatggagaccgtctcgtcttcgctcgtctctccggtggcgctatatttaaaatcgggaatacgaattactcgttgaagccattgattggagctccgtttggatctctgttccaagtcgaaaccggagaagatggttctttcctctctcgcattcttcccgtcaaaaaagaaagcaccagcgttaatgttgtagacgatgatgctagagataatagagaacttatcgacgataatgaatctcagaacctcacttgtgaagagattgaagctatgcggagagagggtgcaaaaggggatgagattattgaagcactgattgcaaacagcaaaacatttgacaagaagtttcagttgtctcaggaaaaatataagcttaagaagcagaagaagtatgccccaaaggtgcttctaagacgcgcttttgctcgaagtatctgtgaagcttatttcaagaaatatccagccagaatcggattcatacgtgtagatgcgttatctcttttgttaacgatggctaacgtcaccgcatactcggatgttctagtggtggatatggttggtggccttgtcactggtgcagtggctgaacgattaggaggcactggttatgtttgcaatacatataaaggggattctccttcctctgtggatatggttaagatgttcaactttaccgacaagattagagagaggatcgtgcattcatctataaacgagctctcatcagccaaaactgcaccccctgaagaaaacaatcaacaagactcatctgcatctgatatggtagaagatgtatctgtgacagctgaggctagagtagatgatattgctgtacgagagagcaaaattaccaaggccccacaacctggagccaaagcttctaaagaagcagtagaaatgtggaaagaaaacggtttctctagcttaatcatggcagcacaagaccaagacccatggactttagctaaagatgtattgccactgctctcctactctgctccctttgcaatatatcatcagtatttacagcctctggcgacatgtatgcacaaccttcagcaagggaagatggccatcaatctgcaaataacagaaccatggctacgcgaatatcaggtgcttccatcaagaactcaccctcacatgcagatgagctcttttggaggctatgttcttagcggcatcagaatctccaccacttgattctcatctccaaaccccattcttctctttatcattttcacgaactgaggtttgttttttttgtattttgtttgttgttgagatatataggaaaacattcatcttgtgactcttataaaaataataaaacactgttttgttttgctt

SEQ ID NO: 688 - DNA, 1483 bp, Brassica napus
actgcagtttattttctctctctgtcacgatggagcacagtaaggaggatcaggcaaagtcggagaatcagaaaatcaataaggcacaagatccaaatccgagatttgcgagcgaaggttgcagcgtgttgctggacgtgaacgatggagaccgtctcgtcttcgctcgtctctccggtggcgctatatttaaaatcgggaatacgaattactcgttgaagccattgattggagctccgtttggatctctgttccaagtcgaaaccggagaagatggctctttcctctctcgcattcttcccgtcaaaaaagaaagcaccagcgttaatgttgtagacgatgatgctagagataatagggaacttatcgacgataatgaatctcaaaacctcacttgtgaagagattgaagctatgcggagagagggtgcaaaaggagacgagattattgaagcactgattgcaaacagtaaaacatttgacaagaagtttcagttgtctcaggaaaaatataagcttaagaagcagaagaagtatgccccaaaggtgcttctaagacgcccttttgctcgaagtatctgtgaagcttatttcaagaaatatccagccagaatcggattcatacgtgtagacgcgttatctcttttgttaacgatggctaacgtcaccgcatactcggacgtgctagtggtggatatggttggtggccttgtcactggtgcagtggctgaacgtttaggaggcactggttatgtttgtaatacatataaaggggattccccttcctctgtggatatggttaagatgttcaactttaccgacaagattagagagaggatcgtgcattcatctataaacgagctctcatcagccaaagctgcatctcctgaagaaaacaatcaagactcatctgcatctgatatggtagaagatgtatctgtgacagctgaggctagagtagatgatgttgctgtacgagagagcaaacttaccaaggccccacaacctggagccaaagcttctaaagaagcagtagaaatgtggaaagaaaacggtttctctagcttaatcatggcagcacaagaccaagacccatggactttagctaaagatgtattgccactgctctcctactctgctccctttgcaatatatcatcagtatttacagcctctggcgacatgtatgcacaaccttcagcaagggaagatggccatcaatctgcaaataacagaaccatggctacgcgaatatcaggtgcttccatcaagaactcaccctcacatgcagatgagctcttttggaggctatgtccttagcggcatcagaatctccaccacttgattctcatctccataccccattcatctcttttatcattttcaagaactgaggtttggtttttgtattttgtttgttgttgagatatataggaacacattcatcttgtgactcttataaaattaataaaacactgtttttgt

SEQ ID NO: 689 - DNA, 845 bp, Arabidopsis lyrata
agggaagacaactccaaaaacaaaaatggtgagagaagaggagaaatcgagatggtggtggttcgagagtcacaagagctccaaacactctcagtggcttcaatcaacactcgctgagcttgatgccaagacaaaggcaatgttgaagctgattgaaggcaacgcagactcttttgcgcagcgtgctgaaacttactacaagaaacgtcctgagcttatctgctttgtcgaagacttttatcgagctcaccgttccttagccgagaagtttgaccacctcaaatcttccgactacggatctcgctcctctaagtttccccaacaatccatggactccgtttctgacagcaattctcactttcaagatgcccattctgagatcgcagaccctgaagatgacgaacttgactctccctttgctagtcacaaagaagatgagacttggaatttggagcaagaaaggtcgaaactcatcgaagagagtgatgctctgaggaaacagctgctagacaaggacgaagagaagagagaggtcatcagacagctttctctaacccttgagaccctcaaagacgagaacttgaccctcaagagacgccttgcccaccattctctcaagcgacgcacctttttggagttcaagccgctcgacaagttcttcgggaagctgttctacattgtgtgcgatggcaacaaggtcgtttagctggctcatctacctcatgagcttagcttcgctagtttctgtgtttgatttcactgtttattaagacatatcctgtcgtttccgtgctgtattataaccggtaattatcctacttaacgcttgctgttctgatttgttc

SEQ ID NO: 690 - DNA, 678 bp, Arabidopsis lyrata
atggtgagagaagaggagaaatcgagatggtggtggttcgagagtcacaagagctccaaacactctcagtggcttcaatcaacactcgctgagcttgatgccaagacaaaggcaatgttgaagctgattgaaggcaacgcagactcttttgcgcagcgtgctgagacttactacaagaaacgtcctgagcttatctgctttctcgaagacttttatcgagctcaccgttccttagccgagaagtttgaccacctcaaatcttccgactacggatctcgctcctctaagtttccccaacaatccatggactccgtttctgacagcaattctcactttcaagatgcccattctgagatcgcagaccctgaagatgacgaacttgactctccctttgctagtcacaaagaagatgagacttggaatttggagcaagaaaggtcgaaactcatcgaagagagtgatgctctgaggaaacagctgctagacaaggacgaagagaagagagaggtcatcagacagctttctctaacccttgagaccctcaaagacgagaacttgaccctcaagagacgccttgcccaccattctctcaagcgacgcacctttttggagttcaagccgctcgacaagttcttcgggaagctgttctacattgtgtgcgatggcaacaaggtcgtt

SEQ ID NO: 691 - DNA, 1044 bp, Arabidopsis lyrata
attggtatttcaaactttgaactactaaaatcacaacaaagtctctaaattgtagtgaaaaaagatcattcaacaacaatgagctattctcatcaaagcatgggttctggtagtagaagtacaaggggctatgagtttggaaggacttatgttgtgaggcctaaaggaaagcaccaagctactattgtttggttgcatggtcttggagataatggctccagctcttctcagctcttggagagcctacctcttccaaacataaaatggatttgtccaactgctccttcgcgtcctgtttcgcttctgggtggattcccttgcactgcctggtttgacgtgggagaaatttctgaggatcttcatgatgatatagaaggcttagatgcttcagctgcacatattgctaacctcttatccgctgaaccaacagatgtcaaagttgggataggaggtttcagtatgggtgcagcaatagctctctactccacgacgtgctacgctcttgggcgttatggaaccggacatccttatactattaacctacgagctactgtaggacttagtggttggcttcctggttggaggagcttaaggagcaaaatagaaagttcgaatgaggttgcaaggcgcgctgcatcgataccaatcatacttgcacatggaacttcggatgatgtagttccttatagatttggagaaaaatctgcccattcacttgccatggctggattccgacaaactatgttcaaaccatatgaagggcttggtcactatacggttcctaaagaaatggatgaggtggttcactggctcgcctcaaggcttggtctcgagggctcacgttaaactctacaagcatcttctaagcatctctatagctactatacaatggtgtagaatatttatattatatataaggggtgggggtttcttggggtatacggtattctcatgttctactgttttgtgattttttcatgcttttctgctgttctattcttgattatgaataataataataaataaaaaggctctttgtgcttc

SEQ ID NO: 692 - DNA, 1542 bp, Eutrema parvulum
atagtgaatgattcagattcatatctcttttctttttattccttctcctctcaacatcacctcaattttctctatatatacgcatttcccctcccttaccttctcttatactttccatcattgtgtgttttgtgacatttgaactctctctcccaaatttcacgacaaagtctccaaaattgtagtgaaagaataaagagagtccattgaacaacaatgagctattctcatcaaagcatgggttctggtagtagaagtgcaaggggatatgattttggaaggacttatgttgtgaggcctaagggaaagcaccaagctaccattgtttggttgcacggtcttggagacaatggctcaagctcgtctcagctcttggagagcctgcctcttccaaacataaaatggatttgcccaactgctccttcgcgtcctgtttcgctacttggtggattcccctgcactgcctggttcgacgtgggagaaatttctgaggaccttcatgatgatatcgaaggcttagatgcttcagctgcacatattgctaacctcttatcaactgaaccaacagatgtcaaagttgggatagggggtttcagtatgggtgcagcaatagctctctactccacgacttgctacgctcttggacgttatggaaccggacatccttatactattaacctacgagctactgtaggacttagtggttggcttcctgggtggaggagcttaaggagcaaaatagaaagttcgaatgaggctgcaaggcgtgctgcatcgataccagttatacttgcacatggaacttcggatgatgtagtcccttacagattcggagaaaaatctgcgcatgcacttgccttggctggatttcgacaagttgcgttcaaaccatatgaagggcttggtcactacacggttcctaaagaaatggatgaagtcgttcactggctcgcctcaagacttggtctcgagggctcgcgttaaactccaaaagcatctaagcatctactatagctatttatacatggtgtagaaatatattatatataatgggtgggtttcttggggtatacggtgttttcttgagtcgactgttttgtgatttaattttttgctttctgctcttcgattcttgattacgaataatgaaataaatgctcttaaatattatatcaagttttgttcataccaaatcaacaagattttgagtttcttgagacattattgccgtacatcaaaaggcatgcttatgaaaagaaacaaaaaaacaataacttcattcagccgtcagcctcagatcagactctctgggagtttattgagacttttggtttccagagacgtctttaagcttctcctccaattcaccttcctgtagtttcaaggacttgggatcataagccaacacaatgaaaaaacaggaagacaaagaaagagtacgctctttctgaaactaaccttgtgcatgttaagaatgatgtctgagcctccaataaactctcccttgatgaagatctgtggaaacgtaggccaatggctgca

SEQ ID NO: 693 - DNA, 1506 bp, Brassica rapa
ataatgaatgattcagattcacatctcttttctttttattccctctcctctcaacatcacctcaatttttttctataaatacacacttcccctcccataccttctcttatattttcaatcattgtgtgttttgtgacatttgaaaacactaccaaaaatcacaacaaagtctctaaaattgtagtgtccatttaacaagaatgagctactctcgtcaaagcatgggttctggtagtagaagtacaaggggatatgagtttggaaggacttatgttgtgaggcctaaaggaaagcaccaagctactattgtttggttgcacggtcttggagacaatggctcaagctcgtctcaactcttagagagcctgcctcttccaaacataaaatggatttgtccaactgctccctcacgtcctgtttcgcttctgggaggctttccttgcactgcatggtttgacgtgggagaaatctctgaggatcttcatgatgatatagaaggcttagatgcttcagcagcacatattgctaacctcttatcaactgaaccaacagatgtaaaagttgggataggtggtttcagcatgggtgcagcaatagcactctactccacaacatgctacgctcttggacgttatggaaacggacttccttatactataaacctacgcgctactgtaggactcagtggttggcttcctggctggaggagcttaaggagcaagatagaaagttcaaatgaggctgcaaggcgtgctgcatcgataccagttatacttgcacatggaacttcggatgatgtagttccttacagatttggagaaacatctgcgcaggcacttgccatggctggattccgacaagttatgttcaaacaatatgaagggcttggtcactatacagttccgaaagaaatgaatgaggtcgttcactggctcgcctcaaggcttggacttgagggctcacgttaaagcttcaacatgcatctatagctattttcatacatggtgtgtaatatattatatatagtgggtggtttcttggggtatacgtcgactgttttgtgatttaatttttgctttttctgctctttcgattcttgattatgaataatgaaataaaagctctttgataatataatatatcaagttttgctcataacaagtttcttgagacttttattattaccgtacatcaaaaggcattctcatgttaagaaacaagaaaaaaaaaacatattcagcagtgacatataacttcagacttggagaaaaatctcaagaagcttactgagacttatggtttgcagagacgtctttaagcttctcctccagttcaccttcctgtaattgaataaaaggacttgggatcataatggaaacacaataagatgaaagaaagggtaatagtgttggtgaaagtaaccttgtgcatgttgaggatgatgtctgagcctccaataaactctcccttgatgaagatctgtggaaatgtaggccaatggctaca

SEQ ID NO: 694 - DNA, 1045 bp, Brassica napus
ccttcctctcaacactacacctacaaacttactactataaataacgcacccccctccctaaccttctcttatattttccatcatcgtgtgtgtttgtgacatttagaaactactaccaccaaaaaaattagtagtgaaaacaaaacagtccatcgaacaacaatgagctattctcatcaaagcatgggttctggcagtagaagtgcaagaggatatgagtttggaaggacctatgttgtgaggcctaaaggaaaacaccaagctactattgtttggttgcacggtcttggagacaatggctcaagctcgtctcagctcttggagagtctgcctcttccaaacataaaatggatttgtccaactgctccttcgcgtcctgtttcacttcttggcggattcccttgcactgcatggtttgacgtaggagaaatttctgaggatcttcaagatgatatagaaggcttagatgcttcagctgcacatattgctaacctcttgtcaactgaaccaacagatgtcaaagttgggataggaggtttcagcatgggtgcagcaatagctctctactccacaacgtgctacgctcttggacgttatggaaccggacatccttatactataaacctacgagctactgtaggacttagtggttggcttcctggttggaggagcttaaggagcaaaatagaaagttctaatgaggctgcaaggcgtgctgcatcagtaccagttatacttgctcatggaacttcggatgatgtagttccttacagatttggagaaaaatctgcgcattcacttgctatgtctggattcagacaagttgtgttcaaaccatatgaagggcttggtcactacacagttcctaaggaaatggatgaggtcgttcagtggctcgcttcaaggcttggtcttgagggatggcgttaagctccaaaagcatctctatatctatatttatacatggtgttagaacatagtatatgtaatggatgggtttcttgggggtatacggcattttctgtttcaaactgttttgtatttt

SEQ ID NO: 695 - DNA, 1156 bp, Eutrema halophilum
atagtgaatgattcagattcacatctcttttcttttattccatctcctctcaacatcaacctcatattttgctctataaatacacatttcccctcccttacattctcttatattttccgtcattcgaaaactatctaccaaatcacagcaaagtcttcaaaattgtagtgaaaaagatccattgaacaacaatgagttactctcatcaaagcatgggttctggtagtagaagtgcaaggggctacgagtttggaaggacttatgttgtcaggcctaaaggaaagcaccaagctactattgtttggttgcacggtcttggagacaatggctccagctcatctcagctcttggagagcctgcctcttccaaacataaaatggatttgtccaactgctccttcccgtcctgtttcgcttctgggtggattcccctgcactgcctggtttgacgtgggtgaaatttctgagaatcttcatgatgatgtcgaaggcttagatgcttcagctgcacatattgctaacctcttgtctgccgaaccaagagatgtcaaagttgggattggaggtttcagtatgggtgcagcgatagctctctattccacgacgtgctgcgctcttggacgttatggaaacggacatccttatactataaacctacgagctacagtaggacttagtggttggcttcctggttggaggagcttgaggagcaaaatagaaagttcgaatgaggctacaaggcgtgctgcatcaataccagttatacttgcacatggaacttcggatgatgtagttccttacatatttggagaaaaatcagcgcattcacttgccttggctggattccgacaagttatgttcaaaccatatgaagggcttggtcactacacggtacctaaagaaatggaagaggtcgttcactggctcgcctcaaggcttggtctcgagggctcgcgttaaactccaaaagcatctaagcatctatagctatttatacatggtgtagaatatatatataaataataatataaatataatgggtgggtttcttgaggtatacggtatttcatgtttctactgttttgatattattttttattttgtgctctttgattcttgattatgaataaataaaaataaaggccacttatgcattc

SEQ ID NO: 696 - DNA, 791 bp, Brassica napus
aaaacaaaacagtcaattgaacaacaatgagctattctcatcaaagcatgggttctggcagtagaagtggaagaggacatgagtttggaaggacttatgttgtgaggcctaaaggaaaacaccaagctactattgtttggttgcacggtcttggagacaatggctcaagctcgtctcagctcttggagagccttcctcttccaaacataaaatggatttgtccaactgctccttctcgtcctgtttctcttcttggaggattcccttgcactgcctggttcgacgtgggagaaatttctgaggatcttcaagatgatatagaaggcttagatgcttcagctgcacatattgctaactcttgtcaactgaaccaacagatgtcaaagttggataggaggtttcagcatgggtgcagcaatagctctttattccacgacgtgctacgctcttggacgttacggaaccggacatccttatactataaacctacgagctactgtaggacttagtggttggcttcctggttggaggagcttaaggagcaaaatagaaagttctaatgaggctgcaaggcgtgctgcatcaataccagttatactttctcatggaacttcggatgatgtagttccttacagatttggagaaaaatcagcgtattcacttgctatggctggattccgacaagttgtgttcaaaccatatgaagggcttggtcattacacggttcctaaggaaatggaggaggtggttcactggctcgcttcaaggcttggtcttgagggatggcgtta

SEQ ID NO: 697 - DNA, 879 bp, Brassica napus
cgtcaaagcatgggttctggtagtagaagtacaagaggatatgagtttggaaggacttatgttgtgaggcctaaaggaaagcaccaagctactattgtttggttgtcacggtcttggagacgaatggctcaagctcgtctcaactcttagagagccctgcctcttccaaacataaaatggatttgtccaactgctccctcacgtcctgtttcgcttctgggaggctttccttgcactgcatggtttgacgtgggagaaatctctgaggatcttcacgatgatattgaaggcttagatgcttcagctgcacatattgctaacctcttatcaaccgaaccaacagatgtcaaagttgggataggtgggtttcagcatgggtgcagcaatagctctctactccacaacgtgctacgctcttggacgttatggaaacggacttccttatactataaacctacgcgctactgtaggactcagtggttggcttcctggttggaggagcttaaggagcaagatagaaagttcaaatgaagctgcaaggcgtgctgcatcgataccagttatacttgcacatggaacttcggatgatgtagttccttacagatttggagaaacatctgcgcaggcacttgccatggctggattccgacaagttatgttcaaacaatatgaagggcttggtcactatacgttaccgaaagaaatgaatgaggtcgttcactggctcgcctcaaggctcggtcttgagggctcacgttaaggcttcaaaaagcatctatagctattttcatacatggtattatatatagtgggtggtttcttggggtatacgtcgactgttttgtgatttaatttttgctttttctgctctttcgattc

SEQ ID NO: 698 - DNA, 1084 bp, Brassica napus
tttaaatatataaagaaagaaaaatgatattgatttcctttttccatttccatggatgcttcctctgggtttctcttaatagtagtcttgtatagctgttgtactctataaatacacatgtccctcttcttaccttctcttatattttccatcattgtctaaaaactatctaccgaaaatcattagactctacaaaattgtagtgaaacaacaatgagctattctcatcaaaacatgggttctggtagtagaagtgcaaggggatacgagtttggaaggacttatgttgtgaggcctaaagggaagcaccaagccactattgtttggttgcatggtcttggagacaatggctcaagctcgtctcagctattggagagcctgcctttcaaacataaaatggatatgcccaacagctccctcgcgtcctgtttcgcttctaggtggattcccttgcactgcatggtttgacgtgggtgaaatttctgaggatcttcatgatgatatcgaaggcttagatgcttcagctgcacacattgctaacctcctatcaaccgaaccaacggatgtcaaagttgggataggaggtttcagtatgggagcagcaatagctctatactcaacaacgtgctacgctcttggacgttatggaacaggacaaccttatactataaacctacgagctactgtaggactcagtggttggcttcctggttggaggagattaaggagcaaaatagaaaggtccaatgaagctacaaggcgtgctgcatcaataccaattatacttgcacatggaacttcggatgatgtagttccttacagttttggagaaaaatctgcacattcacttggcatggctggattcagacaagttgtgtttaagccatatgaaggacttggtcactacacggttcctaaagaaatggaagaggtcgttcactggctcgcctcaaggcttggtctcgacggttctcgctaaacttcaaaagcatctatagctacttatatacatggtgtagaatatattatagtgggcttggggtatacggcatcttcattttcccgactgttttgtgattttttt

SEQ ID NO: 699 - DNA, 835 bp, Brassica rapa
tttgtaattgctcttgttgaatatgtttctggcaaaatctttgtaggtagtagaagtgcaaggggatacgagtttggaaggacttatgttgtgaggcctaaagggaagcaccaggctactattgtttggttgcatggtcttggagacaatggctcaagcttgtctcagctattggagagcctgcctcttccaaacataaaatggatatgcccaactgctccctcgcgtcctgtttcgcttctaggtggattcccttgcactgcatggttcgacgtgggtgaaatttctgaggatcttcatgatgatatcgaaggcttagatgcttcagctgcacacattgctaacctcctatcaactgaaccatcagatgtaaaagttgggataggaggtttcagtatgggagcagcagtagctctatactcaacaacgtgctacgctcttggacgttatggaacaggacatccttatactataaacctacgagctactgtaggactcagtggttggcttcctggttggaggagcttaaggagcaaaatagaaagttccaatgaagctgcaaggcgtgctgcatcaataccaattatacttgcacatggaacttcggatgatgtagttccttacagatttggagaaaaatctgcgcattcacttgccatggctggattcagacaagttgtgtttaagccatatgaagggcttggtcactacacggttcctaaagaaatggaagaggtcgttcactggctcgcctcaaggcttggtctagagggctcaagctgagctccaaaagaatctatagctatttatacaatgtgtagaatatattagagaa

SEQ ID NO: 700 - DNA, 961 bp, Brassica rapa
tttgtgattacaattcttcaatatgtttctggcaaaatatttgtaggcagtagaagtgcaagaggatatgagtttggaaggacctatgttgtgaggcctaaaggaaaacaccaagctactattgtttggttgcacggtcttggagacaatggctcgagctcgtctcagctcttggagagtctgcctcttccaaacataaaatggatttgtccaactgctccttcgcgtcctgtttcacttcttggcggattcccttgcactgcatggttcgacgtaggagaaatttctgaggatcttcaagatgatatagaaggcttagatgcttcagctgcacatattgctaacctcttgtcaactgaaccaacagatgtcaaagttgggataggaggtttcagcatgggtgcagcaatagctctctactccacaacgtgctacgctcttggacgttatggaaccggacatccttatactataaacctacgagctactgtaggacttagtggttggcttcctggttggaggagcttaaggagcaaaatagaaagttctaatgaggctgcaaggcgtgctgcatcagtaccagttatacttgctcatggaacttcggatgatgtagttccttacagatttggagaaaaatctgcgcattcacttgctatgtctggattcagacaagttgtgttcaaaccatatgaagggcttggtcactacacagttcctaaggaaatggatgaggtcgttcagtggctcgcttcaaggcttggtcttgagggatggcgttaagctccaaaagcatctctatatctatatttatacatggtgttagaacatagtatatgtaatggatgggtttcttggggtatacggcattttctgtttcaaactgttttgtattttactttttgcacttgttctcttggatttttggttataaataatgaaataaatgtttgttcatacc

SEQ ID NO: 701 - DNA, 1506 bp, Eutrema parvulum
ctgaattttctggcaagctttctagttaatgggtatcaaactatccattcaatcatctcattttttttcataaataaatgattgaagaaggagatttgtcttctttttcatttttggattatgccttgatgtttcaagtaaatatacttattgttatatatataattaatattcttctatgaagaaaagtttggttttctttatttttccctccaccactgcctccaaggcattgattctctgtctctctctctcctgtctgtgtattgttaccgctagctctctgctctggtttttttattccttatgcttcccaaaagatttatttcttttcttgtataaagaaaaaaaattaacttcatttctttaatctctgattctctttttataagctctttcctctagctttctccttccattccctttctagtagttttgtttagctgttgtacacattgagcatcccatagtgaatgattcagattcacctcttttcttttattccacattcccaaacatcgtccctttaatttggttatatatacacatagccttctcatatatttatcatcacttgttttttgtatcttgaaacttgaatgcactcaaaagaaaaattacaaaaccagtagagtattcggataccgttcaaacaacaatgagttattctcatcaaagcatgggttctggtagtagaaatgcaaggggatatgaatttggaaggacttatgttgtgaggcctaaaggaaagcatcaagccactctagtatggcttcatggtcttggtgacaatggctctagctcatctcagctcatggaaagcttgcatcttccaaatataaaatggatttgccccactgctcctacgcgtcctgtttcaagtcttggtggattcacctgcactgcatggtttgatgttggggaaatttctgaagacagtcatgatgatatggaaggtttagatgcttcagcttcacatattgctaaccttttgtcctctgaaccagcagatgttaaagtggggataggaggttttagcatgggagcagctatatctctctactctgccacttgctatgctcttggacgttatggaactggccacacttaccctataaacctgcgagctgtagtaggactcagcggctggcttcccggttggaagagcttaaggagcaagatagaatgttcctatgaggctgcaaggcgtgctgcatcgttaccaatcgtacttacacatggaacttccgacgatgtggttccttataggtttggagagaaatctgcgcagtctcttggcatggctggatttcgacaagccgtctttaagcaatacgaaggacttggtcactatactgttcccaaagaaatggatgaagtcgttcattggcttacaacaaggctcgggctagagggctcacgctaagaaatacagagagcgatgcatctagctatataggcgatatggtcgaccacaaagaacaaagaataacttggaatgaatag

SEQ ID NO: 702 - DNA, 886 bp, Arabidopsis lyrata
tattttgaaacttgaaagctcttcagaagacaaattacaaaactttaagaggattcaatacacttgatccaaaaatgagttactctcgtcaaagcatgggttctggaagtagaaatgcaaggggatatgaatttggaaggacttatgttgtgaggcctaagggaaagcatcaagccactctagtctggcttcatggacttggtgacaatgggtctagctcatctcagctcatggaaagcttgcatgcatcttccaaatataaaatggatttgtccaactgctccttcgcgtcctgttacaagtcttggtggatttacctgcactgcttggtttgacgttggggaaatttctgaagatggtcatgatgatttggaaggtttagatgcctcagcttcgcatattgctaatcttttgtctgctgaaccagcagatgttcaagtgggcataggaggttttagcatgggagcagcaatatctctctactccgcgacttgttatgctcttggacgttatggaactggccatgcgtatcctttaaacctacgagctgttgtagggcttagcggctggcttcctggttggaagagcttaataaggagcaaaatagaatgttcatatgaggctgcaaggcgtgctgcgtcgttaccaatcatccttacacatgggacatccgatgatgtggttccttataggtttggagagaaatctgcgcagtctcttggcatggctggatttcgacaagccatgttcaaaccatacgaaggacttggtcactatactgttcccaaagaaatgaatgaggtcgttcactggctcacagcgaggctcgggcttgagggctcgtgctaaactacagtgcgatgcatctagctatataaacgatatg

SEQ ID NO: 703 - DNA, 1070 bp, Arabidopsis thaliana
tattttgaaactttgaaagctcttaagaagacgaattacaaaaccttgagaggattcaatacactttcaacaaaaaatgagttactctcatcaaagcatgggttctggtagtagaaatgcaaggggatatgaatttggaaggacttatgttgtgaggcctaaaggaaagcatcaagccactctagtctggcttcatggtcttggtgacaatggctctagttcatctcagctcatggacagcttgcatcttccaaatataaaatggatttgtccaaccgctccttcgcgtcctgttacaagtcttggtggatttacatgcactgcttggtttgacgttggggaaatttctgaagatggtcatgatgatttggaaggtttagatgcctcagcttcacatattgctaaccttttgtcctctgaaccagcagatgttaaagtaggcataggaggttttagcatgggagcagcaatatctctctactccgcgacttgttatgctcttggacgttatggaactggccatgcgtatcctataaacctacaagctgttgtaggactcagcggctggcttcctggttggaagagcttaaggagcaaaatagaatgttcatttgaggctgcaaggcgtgctgcatcgttaccaattatacttacacatggaacttccgatgatgtggttccttataggtttggagagaaatctgcgcagtctcttggcatggctggatttcgactagccatgtttaaaccatacgaaggacttggtcattataccgttcccagagaaatggatgaggtcgttcactggctcacaacgatgctcggacttgagggctcgcgctaaactttacagactgcgatgcatgtagctatatatgcgatatgtacgacacaagaacaaataataaccgggaatgaagaggaattggtggagaacagaaaactagtgtagacttgagatagtagaatgtataatggttgggtttcttgggggtatatatatgtcaaggttcgttattttgttgtatgttcttttgtccatgttggattcttggtcttgaataaaaggg

SEQ ID NO: 704 - DNA, 1631 bp, Eutrema halophilum
tgctggattttctaaaaagcttatagttaatgggtatccaactatccatcaatcactcattttgtttttcatgattgaaagaaaagatttgtcttctttttcatttttggattatgccttaatttttcaggtaaaaatacttattgttttatatagaattgatattcttttaggaagacaagtttttcattttcatatctttcttttattttccctccaccactgcccacaaggcattgattctctgtctccctctctctcctctctgtgtgttgttacctctagctctctgctctgttttgtttttataccttatgtttccaaaaagatttatttcttttgctgtataaagaaaaacaaaaactgattcttttctttaatctatttttataccctccttttcctatggatgcatcctctagctttttacttccattccttttcgagtagtttttgttagctgttttacacattgagcatcccatagtgaatgattcagattctcctctttcttttatcccagaaaatccctttaatttggtgtatatatacacattgccttctcatatatttatcatcacttcttgtttgtattttaaaacttgaaggctcaaaagaaaattaaaaaatctgttgagtgtttggatactgttgaacaacaatgagttattctcatcaaagcatgggttctggtagtagaaatgcaagggggtatgaatttggaaggacttatgtggtgaggcctaaaggaaagcatcaagccactctagtatggcttcatggtcttggtgacaatggctctagctcatctcagctcatggaaagcttgcatcttccaaatataaaatggatttgcccgaccgctcctacacgtcctgtttcaagccttggtggatttacctgcactgcatggtttgatgttggggaaatttctgaagacagtcatgatgatatggaaggtttagatgcctcagcttcacatattgctaaccttttgtcctctgaaccagcagatgttaaagtggggataggagggtttagcatgggagcagcaatatctctctattctgccacatgctatgctcttggacgctatggaactggccacacttatcctataaacctacgagctgttgtagggcttagcggctggcttccgggttggaagagcttaaggagcaaaatagaatgttcatatgatgctgcaaggcgtgctgcatctttaccaatcattcttacacatggaacttccgatgatgtggttccttataggtttggagagaaatctgcgcagtcccttggcatagctggatttcgacaagtcgtgtttaaggcacacgaaggacttggtcactacaccattcccaaagaaatggatgaggtcgttcactggctcacaacaaggctcgggcttgagggctcacgttaaactttacaggatgcaatgcatctagctatataggagatatggttggcctcaaagaacaaagattgagatagtagagaatgtataaatggtgggtttcttgggggtatatataattcatggttcgttgttttgtgatttattttgtcttttgaatcttttgtccatgttggattcgtgatcatgaataaagaggtttgatgct

SEQ ID NO: 705 - DNA, 945 bp, Brassica napus
tatatttatcatcagttgttgtttgcgtttggaacttgaaggctctcaaaagaaaaactacacaacctgtagagtgttcaaattaccttttcagcaacaatgagttattctcatcaaagcatgggttctggtagtagaaatgcaaggggatatgaatttggaaggacttatgttgtgaggcctaaaggaaagcatcaagccactctagtatggcttcatggtcttggggacaatggctctagctcatctcagctcatggaaagcttgcatcttccaaatataaaatggatttgcccgactgctcctacgcgtcctgtttcaagtcttggtggatatacctgcactgcttggtttgatgttggggaaatttctgaagacagtcatgatgatttggaaggtttagatgcctcagcttcacatattgctaaccttttgtcctctgaaccagcagatgtcaaagtggggataggaggttttagcatgggagccgcgatatctctttactctgccacttgctatgctcttggacgttatggaactggccacacatacccaataaacctacgagctgttgtaggactcagcggctggcttcccggttggaagagcttaaggaacaaaatagaatgttcgtatgaggctgcaaggcgtgctgcatcgttaccaatcatacttacacatggaactgccgatgatttggttccttataggtttggagagaaatctgcgcagtctcttggcatggctggatttcgacaagctgtctttaagccatacgaaggacttggtcactatactgttcccaaagaactggatgaagtcgttcaatggctcacaacaaggctcgggctagagggctcacgctaaacagtacagactgccatgcatctagctatataggccctatggtcgaccacaaataacttgagatagtataatgtataa

SEQ ID NO: 706 - DNA, 1639 bp, Raphanus sativus
  misc_feature (793)..(793): n is a, c, g, or t
  misc_feature (976)..(976): n is a, c, g, or t
  misc_feature (1033)..(1033): n is a, c, g, or t
  misc_feature (1048)..(1048): n is a, c, g, or t
  misc_feature (1420)..(1420): n is a, c, g, or t
tgctgaactttctggcaagctttctagttaatgggtatccatcgatcacatcatttttcataaaataaatgattgaagaatgagatttgtcttctttttcattttcggattatgccttaatgtttcgagtaaatatacattttggtatatatagaattaatattcttataggaagaaaagtttgtttgtttttctttctcctttattttttcctccaccactgcacacaaggcattgattctctgcctatatcgcctgtgttaaaaccagtagctctctcctcgttttttcttaataattccggtgcttctcaaaatatatatttcttgttgtattaagaaaaaagcttaagttatttttttatatatttgattctctttttataccaaccttttcaatagacgcatcttctatagctatgtccttccattccctttctagtagttttggttagctgttgtgcacattgagcatcccatagtgaatgattcagattcacatattttcttttatttcacattttcgacatcatccctttaatttggttatataaacacatcaccttctcatatatttatcattagtcgttgtttgtctttgaaacttgaaggctctcacaagaaaatctacacaacctgtagagtgttcggattacctttcagcaacaatgagttattctcatcaaagcatggcttctggtagtcgaaatgcaaggggatatgaatttggaaggacttatgttgtgaggcctaaaggaaagcatcaagccactctagtatggcttcatggtctnggtgacaatggttctagctcatctcagctcatggaaagcttgcatcttccaaatataaaatggatttgcccgactgctcctacgcgtcctgtttcaagtcttggtggatatacctgcactgcttggtttgatgttggggaaatttctgaagacagtcatgatgatttggaaggtttagatgcntcagcttcacatattgctaaccttttgtcctctgaaccagcagatgttaaagtgggnataggaggttttagnatgggagcagcgatatctctttactctgccacttgctatgctcttggacgttatggagctggccacacataccctattaacttacgagctgttgtaggactcagcggctggcttcctggttggaagagcttaaggaacaaaatagaatgctcgtatgaggctgcaagacgtgctgcatcgttaccaattatacttacacatggaactgccgatgatttggttccctataggtttggagagaaatctgcgcattctcttggcatggctggatttcgacaaactgtctttaagccatacgaaggacttggtcactacactgttccaaaagaactggatgaagtcgttcagtggctcacaacaaggctcgggctngagggctcacgctaaacagtacagactgccatgcatctagcaatataggccctatggtcgaccacaaataacttgagatagtataatgtataatgggtgggtttctttggcggggggttatatagttcgttgtttttgggatttattttgtcgcttgttgttttgtttgtccatgttggaatattgatcatgaataaagtaatgctacaaagcccttta

SEQ ID NO: 707 - DNA, 1106 bp, Brassica rapa
tattttgaaacttgaaggctctcaaaacaaaaattacaaaactgtagtgagtttggataccgttcaacaacaatgagttattctcatcaaagcatgggttctggtagtagaaatgcaaggggatatgaatttggaaggacttatgtcgtgaggcctaaaggaaagcatcaagccactctagtatggcttcatggtcttggagacaatggctctagctcttcacagctcatggaaagcttgcatcttccaaacataaaatggatttgcccgaccgctcctacgcgtcctgtttcaagtcttggtggatttacctgcactgcatggtttgatgttggagaaatttctgaagacggtcatgatgatatggaaagtttagatgcatcagcttcacatattgctaaccttttgtgctctgaaccggctgatgttaaagtggggataggaggttttagcatgggagcagcaatatctctctattctgccacttgctatgctcttggacgctatggaactggccacagttaccctataaacctacgagctgttgtaggactcagcggctggcttcccggttggaagagcataaggaacaaaatagaaagttcgtatgaagctgcaaggcgtgcttcatcgttaccagtcatacttacacatggaattgccgatgatgtggttccttataggtttggagagaaatctgcgcagtctcttggcatggctggatttcggcaaaccgtgtttaagccgtaccaaggacttggtcactatactgttcccaaagaaatggatgaggtcgttcactggctcacaacgaggctcggtctcgagggctcacgctaaataatacagactgtggtgcatctagctatgtatgcgatatggttgaccgcaaagaaaaaataataactgagaacgcaaaggaactggtggggaggatgataaaaaactagtgtaaacttgagacagtagaaagccttttttcaaaaaaaaaaaaaaaaaaaaacttgagacagtagattgtataatgggtgggtttcttggggtatatagttcatggttctttgttttttgtgatttattttgtcgctcgacgttcttttgtccgt

SEQ ID NO: 708 - DNA, 1035 bp, Brassica rapa
  misc_feature (533)..(533): n is a, c, g, or t
  misc_feature (555)..(555): n is a, c, g, or t
  misc_feature (594)..(594): n is a, c, g, or t
  misc_feature (609)..(609): n is a, c, g, or t
  misc_feature (621)..(621): n is a, c, g, or t
  misc_feature (627)..(627): n is a, c, g, or t
  misc_feature (631)..(631): n is a, c, g, or t
  misc_feature (646)..(646): n is a, c, g, or t
  misc_feature (648)..(648): n is a, c, g, or t
  misc_feature (653)..(653): n is a, c, g, or t
  misc_feature (655)..(655): n is a, c, g, or t
  misc_feature (710)..(710): n is a, c, g, or t
  misc_feature (720)..(721): n is a, c, g, or t
  misc_feature (742)..(742): n is a, c, g, or t
  misc_feature (751)..(751): n is a, c, g, or t
  misc_feature (756)..(756): n is a, c, g, or t
  misc_feature (759)..(759): n is a, c, g, or t
  misc_feature (761)..(761): n is a, c, g, or t
  misc_feature (783)..(783): n is a, c, g, or t
  misc_feature (786)..(786): n is a, c, g, or t
  misc_feature (792)..(792): n is a, c, g, or t
  misc_feature (802)..(802): n is a, c, g, or t
  misc_feature (804)..(804): n is a, c, g, or t
  misc_feature (836)..(836): n is a, c, g, or t
  misc_feature (839)..(839): n is a, c, g, or t
  misc_feature (849)..(849): n is a, c, g, or t
  misc_feature (851)..(851): n is a, c, g, or t
  misc_feature (853)..(853): n is a, c, g, or t
  misc_feature (858)..(858): n is a, c, g, or t
  misc_feature (863)..(863): n is a, c, g, or t
  misc_feature (865)..(865): n is a, c, g, or t
  misc_feature (885)..(886): n is a, c, g, or t
  misc_feature (891)..(892): n is a, c, g, or t
  misc_feature (901)..(901): n is a, c, g, or t
  misc_feature (903)..(903): n is a, c, g, or t
  misc_feature (968)..(968): n is a, c, g, or t
atattttccatcattgtgtgtatttgtgacacctaaaaactctctaccgaaaatcattagactctccaaaattgtagtgaaacaacaacgagctattctcatcaaaacatgggttctggtagtagaagtgcaaggggatacgagtttggaaggacttatgttgtgaggcctaaagggaagcatcaggctactattgtttggttgcatggtcttggagacaatggctcaagcttgtctcagctattggagagcctgcctcttccaaacataaaatggatatgcccaactgctccctcgcgtcctgtttcgcttctaggtggattcccttgcactgcatggttcgacgtgggtgaaatttctgaggatcttcatgatgatatcgaaggcttagatgcttcagctgcacacattgctaacctcctatcaactgaaccatcagatgtaaaagttgggataggaggtttcagtatgggagcagcagtagctctatactcaacaacgtgctacgctcttggacgttatggaacaggacntccttatactataaacctacgngctactgtaggactcagtggttggcttcctggttggagnagcttaaggagcaanatagaaagttcnaatgangctncaaggcgtgctgcancnatacnanttatacttgcacatggaacttcggatgatgtagttccttacagatttggagaaanatctgcgcanncacttgccatggctggattcngacaagttntgttnaancnatatgaagggcttggtcactanacngttccnaaagaaatgnangaggtcgttcactggctcgcctcaagcttggnctngagggctcangntnagctncaaangnatctatagctatttatacanngtgtnnaaatattananataggtgggtggtttcttggggtatacgtcgacttgttttgtgattttaattttggcttttctgntctttcgattcttgattatgatatgaaataaaaggctctttggatatataattatatcaagtttgtt

SEQ ID NO: 709 - DNA, 980 bp, Brassica rapa
atgcttcttatgatcaagtttctctctaagattatttctatagagattatcttgggtagtagaaatgcaaggggatatgaatttggaaggacttatgttgtgaggcctaaaggaaagcatcaagccactctagtatggcttcatggtcttggggacaatggctctagctcgtctcagctcatggaaagcttgcatcttccaaatataaaatggatttgccctactgctcctacgcgtcctgtttcaagtcttggtggatatacctgcactgcttggtttgatgttggggaaatttctgaagacagtcatgatgatttggaaggtttagatgcctcagcttcacatattgctaaccttttgtcctctgaaccagcagatgttaaagtggggataggaggttttagcatgggagcagcgatatctctttactctgccacttgctatgctcttggacgttatggaactggccacacatacccaataaacctacgagctgttgtaggactcagcggctggcttcccggttggaagagcttaaggaacaaaatagaatgttcgtatgaggctgcaaggcgtgctgcatcgttaccaatcatacttacacatggaactgccgatgatttggttccttataggtttggagagaaatctgcgcagtctcttggcatggctggatttcgacaagctgtctttaagccatacgaaggacttggtcactatactgttcccaaagaactggatgaagtcgttcagtggctcacaacaaggctcgggctagagggctcacgctaaacagtacagactgccatgcatctagctatataggccctatggtcgaccacaaataacttgagatagtataatgtataatgggtgagtttcttggggttttgtgatttattttttcgcttgttcttttctccatgttggattcttgatcatgaataaaggtctttaacgctattttaagtttttttttt

SEQ ID NO: 710 - DNA, 2299 bp, Ricinus communis
tttgagcctagcagcaactagcaaccaaacagatataatggcaagcatcaaagcagccccaaaaagaaaaaaatggaaggagagggaaaaagttcacatcctttttccactatcattctctccccttttcttcttcttcttcttttccttttctttttttttttattttttaatccagaaaatgaacctatatgtatgtgtcgaatttaaaaacttcactttcaattttttttaatcaatcaaaaggattagttcttcaagttttccttataattagtattaattatagaatttattttggccgaaagatttagagttttgacttttctttcaactaagatcatttaaattatcagtttttccagtgagagatgctaaagggccaaaagtaatgatgctcaaccatttggctccattaaataaagaagtaaaaattttaaaaagaaattcttagggtgaaaactgaaaaccccacatttactatagtacgccctagttgagttctttaatttcctaatgttaatgactgcacctataacatcaggtttttttttgtttgtttgtcaatgaaaaaaattgaaagctttgaagcttattgtagctttggcctttgtggttaatgggtatctatcaatcatgagaaattcataaacaaatgattgaagaaaagatattttctattttacaaacctggattattctttctagttttcagtaatattcttgagagctgttgttgattgttgtttttgttgttgatagtttagtatttttttcctttaaaaaaaaaaaaaaactttatttttaaagccagtgcccacaagcatagattctctctatgttgcaaatctcagagcttcacctctttcctagctggttggctcaggaatggatgattgtgctcttctctgcttggattgtgtctgttcttgaaaagattttctgctttttttcttcttgtcctttttaccctctccttttaatggatgccttcctcttttttgagtttctatttggttttagacaccaatatattgctggtgtacacactacatattaattagtagtagtgatagatttgcatattcacctgttttattcctttttccactctataaataggtattattttgctggatgttcttcattgcagcagcacctcctcttcagttgttattcattgctaataggttggctggctgtttagttgcatcaccaaaatgagctatcaacaacatccttctgtgggttctggtagtagaactgccagaagaacttttgagtttgggaggacttatgtggtgaggcctaaagggaaacatcaagccactattgtctggttgcacggtcttggtgataatggctcaagctggtcccagctcctggaaagccttcctcttccaaatattaaatggatttgtccaactgctccaacacgtccggtggcacttctgggtggatttccttgcactgcatggtttgatgtgggagagatatcagaaaatagtccagatgattgggaaggtttagatgcgtcagcagcacatattgcaaatttactgtcaacagagccaactgatgttaaagtcggcatcggaggcttcagtatgggtgctgcaatagcactttactctgcaacttgtgctgccctgggacgatatggtaatggcaacctgtaccctattaacctcagggcagttgttggtctaagtggctggcttcctggttcaaggagcttaaggagcaaaatagaggggctgaatgaagctgtgaggcgtgctgcatccttgccgattttgctgtgtcatggaacaagtgatgatgtggtctcctataattatggagagaaatctgctcactccttaaatactgcaggctttcgacatctcacattcaaaccatacgaagggcttgggcattacacagttcctaaagaaatggatgaggttcgtaattggctgtcagcaaaactgaaccttgagggatcacgcgcatagaacaagcacataatggacttgtagttggagctaaagaggatgaaaatagggatcaataatgtgagaagggaaagaaacggatttgtataagtaggtagtaaatagaatgggtatatggtatagataaccctcctaattccctttttgtctcctttcctctcctgaagaataaagcttgggatgtcttttattttttttactttgcttgtagaatttagcagtaatataagtagcaagttttgctcatcgagcattttgtattagcttgatataatgtttcaatctactagtttggctcataa

SEQ ID NO: 711 - DNA, 1149 bp, Populus trichocarpa
attgcagtagctcttcttcttgtcatttattaacatataggaggtgcactaaggtgtttggtcccatcctcaaaaatgagctaccaacaacacttttctatgggttctggtagtagacctgctagaaggaactttgaatttgggaggacttatgtggtgaggcccaaaggaaaacaccaggccactatagtttggttacatggtcttggtgataatggttcaagctggtcccagctactggaaaatctccctcttccaaatattaaatggatttgcccaactgctcctactcgtcctgtggcactgctgggtggatttccttgcactgcatggtccgacgttggagaaatttcagaagatagcccagatgactgggagggtttagatgcttcagcagcacatatagcaaatttactgtctactgagccagctgatgtgaaagttgctattggaggcttcagtatgggtgctgcaacagccatttattctgcaacttgtgcagccttgggacaatatggtaacggtaatgcgtatcctatcaacctcagagcagttgttggactaagtggctggcttccaggttcaaggagcttaaggagcaaagtcgaagggtcacacgaggctgcgaggcgtgctgcatcgttgcccatttttctttgccatggaacaagtgatgatgtagtcccctataactacggagagaaatctgctcacagcttgaatacagcaggattccgaaacctgattttcaaatcttatgaggggcttggtcattacacggtccccaaagaaatggatgaggttcgcaattggctcacagccaggctggggcttgagggctcccgctcttagttgcagaacagaatcggcttcgggttggagcttataggagaaagaacagggaaaacaataacgggaagaggatgactggatttttataagtaggtagtaatagaacaggttatggagcatatggtatagataatataaccttcctaattcccttttgctttcttgcctgaccttaaaaataaatcttgcatgttttcattttgattgtataatttagcagtgatgggtctaatcacttctgcttgctcagcattttgtattggttaatctaatattcagtctagtgagttttgccta

SEQ ID NO: 712 - DNA, 1769 bp, Arabidopsis lyrata
agttgttcgtgatggtttcagacacaactcctggaactcagcttgatccgaccagcttatgattctgtctttattcttagagcctcttgatccacactgactaatctcgtgtcagtgtgttcttctggtggaataatccgatcccatcgccagataattctccaattctatatataatgcttgcttgcttcataggttctcatgtcgatactgtgttgcgttcccgtacttgaatgtgtctattgcttgggttgtgcccattggctgtggaagaaatgtttatactcagcaggtcacgagagtgagaattggggattagctacatcagatgagtttgagccaatccctaggatctgccgcttgatcttagccgtctatgaggagaatctccatgaccctatgtgggcacctccgggtggttatgggcttgacccaaatcatgtcattctcaagaaagactatgaccagactgagggtcgtgtgacgccttacatgatctacttggatcatgacaatggtgatgtagtcttggccattagagggctgaatttggctaaggagtgtgattatgctgttcttcttgataacaaacttggacagactaagtttgatggaggttatgtacataacgggttgttaaaggcggccatgtgggtttttgaggaggagcatgtggttctaagagagttactcgaggcaaacccgagctattccttgacgtttgttggccattcgttaggtgcaggggttgtgtctttgcttgtcttattcgtcattcagaaccgtgctaggttggggaacatagagagaaagaggataagatgttttgctattgctcctccaagatgtatgtctctccatctagcagtgacatatgcagatgtcataaactctattgttctacaggatgatttcttgcctcggactaccacagctctggagaatgtcttcaagtcaataatctgcttgccatgcttgttgtgtctcacttgtttaaaagatacgttcacattcgaggagaaaaagctcaaagatgcaaggcgtctatatgctcctggtaggttataccacatcgtcgtgcgcaagcccttgagattaggaagatatccacctgttgtaagaacagctgtcccagttgatgggagatttgagcagattgttctctcctgtaatacaacagcggatcacgccatcatctggattgaaagggaatcgcagagagctcttgagttaatgctggaagaggaccaagttatgcaaattccggtggagcagaaaattgtgcgccagaaatcaattgttgaggatcatgacgaagaatacagagcggctataatgaaggcagcttctctgaacatccccatgtctccatcaccgtcttatggaacattccatgatacagaagaaggagaaagctctacaggatcaggcatggaaggatccccgtccgggtggtccttcaaaggaatgagaagaaaatgggatcaattcatagattgccattttcctgtaaatgaccacagagaacatataatcttcaagaaaaatgaatcatcagctttgttgtgtggtcaagaaacattataaatcgtggtataggtgttgtacatgtaggatctagggtacagaatcagagaagcaaagtagatgaaaattcattattgagagattaagattttcttcattgttcgagctctttttgtgttatagcctgtaatgttgctagcaatttcttctgaaatatcaatgaacataacacctatattgtt

SEQ ID NO: 713 - DNA, 1776 bp, Eutrema halophilum
ttactcgtgatcattccagcctgatccaaccagcttatgattctgtctctgttcttagagccccttgagccacactgatcaatctccggtcagtgggtggttctggtggaaaattccgatcccattgccagaaaattctccgattcaacttatataatgcttgattgcttcataggttcccatgtcaatactatgttgtgttcccgtacttgaatgtgtatattgcctgggttgtgcccattggttgtggaagaaatgtctatactcagcaggtcacgagagcgagaattggggtttagccacatcagatgagtttgagcccatccctaggctctgccgcttgatcttagccgtctatgaggaggatctccataaccctatgtgggcacctcctggtggttacgggattgacccacatcacgttgtcctcaagaaagactatgaccagactcaaggtcgtgtcacgccttacatgatctacttggatcaccaaaatggccatgtagtgttggctattaggggtcttaacttggctaaggagagtgattacgctgttctgcttgataacaaacttggccagactaagtttgatggaggttatgtacacaacgggctgttgaaggcggccatgtgggtttttgaggaggagcatgaggttttaaagaaactactcgacgaaaacccgggttattccctgacgtttgttgggcactcgctaggtgcaggggttgtgtctttgctggtcttgtttgtggttcagaaccgggataggttagggaacatagagagaaagaggataagatgctttgctattgctcctccaaggtgcatgtctctccatctagcagtgacatatgccgatgtcataaactctgttgttctacaggatgatttcttacctcggacaactacagctctggaggatgtcttcaagtcaatcatctgcttgccatgcgtattatgcctcacatgtttgaaagatacattcacgttcgaggagaaaaagcttaaagataccaggcggctatatgcccctggtaggttataccacattgttgtgcgcaagcccttgagattgggaagatttcctccggttgtgagaacagctgtcccagttgatgggagatttgagcagatagttctctcctgtaatgcaacagcagatcacgccatcatctggattcaaagggaatcacagatagctctcgatttaatgctggaagaggaccgagtaatgcagattccggtggagcagagaattgtgcgccagaaatcgattgttgaggatcatgacgaagaatacagagcggctataatgaaggcggcttctctgaacatccccatgtctccatcaccgtcgtatggaacattccatgatccagaagaaggagaaagctctgcaggatcaggcgtcgaaggatccccgtctccgtggtccttcaaaggaatgagaagaaattggaatcgattcatagatcgatattttcctgtggatgacaacagtggacatatgatcttcaagaaagaggaatcttcagctttgttgtgtaggtaagagcatgaattcttgttataggtgtacatgtagaatgtagattcctagaatcatagaggcaaattagatgaaaaatcattattgagagattgagaatttattttcttcactaaatccgagatgtgaagcatcatctctttttcttcacaaaaataatttttgttcggttgctttctagcaattgcttgtgaaatctcagtggacataacattaatgttgtt

SEQ ID NO: 714 - DNA, 1688 bp, Eutrema parvulum
ctgttctttcgctcatctttggcaaatctcacttccgggaaatatataatgcttgattgcttcataggttcccaatgtcgatactgtgttgtgttccggtacttgaatgtgtatactgcttgggttgtgcccattggttgtggaagaaatgtctatactcagctggtcatgagagcgagaattggggattagccacttctgatgagtttgagcccatccctaggctctgccgcttgatcttagccgtctatgaggaggatctccataaccctatgtgggcacctcctggtggttacgggattgacccacatcaggttatcctgaagaaagactacgaccggactcaaggtcgtgtcaccccttacatgatctacttggatcaccaaaatggcgaggtagtgctggccataagggggcttaacttggctaaggagagtgattacgctgtgctgcttgataacaaacttggacagactaagtttgaaggaggttatgtacacaacgggttgttaaaggcagccatgtgggtttttgaggaggagcatgaggttttaaacaaattactcgaggaaaacccgggttattccttgacgtttgttgggcattctctaggtgcaggggttgtgtctttgctggtcttgtttgtggttcagaaccgaagtaggttagggaacatagaaagaaagaggataagatgttttgctattgctcctccaaggtgtatgtctctccatctagcagtgacatatgcagatgtcatcaaatctgttgttctacaggatgatttcttacctcggactaccacagctctagaggatgtcttcaagtcaatcatctgcttgccatgcctgttgtgtctcacatgtgtgaaagatacattcacattcgaggagaaaaagcttaaagatgcgaggcgtctatatgctcctggtaggttataccacatcgttgtgcgcaagcccttgagattaggaagatatcctcctgttgtgagaacagccgttccagttgatgggagatttgagcagatagttctctcttgtaatgcaacagcggatcacgccatcatctggattcaaagggaatcacagagagctctcgatttaatgctggaagaagaccaagttatgcagattccggtggagcagaaaattgtgcgccagaaatcgattgttgaggatcatgaagaagaatacagagcggctatcatgaaggcggcttctctgaacatccccatgtctccatcaccgtcatatggaacattccatgatacagaagaaggagaaagctctgtaggatcaggggatccttcgaccccatccccgtggtccttcaaaggaatgagaagaaaatggaatcaattcgtagatggccattttcctatggatgatgacagtggacgtatgatcttcaagaaagaggaatctccagatttgttgtgtaggtaacaaacatgaatcttgttataggtgtacatgtagaatgtagaatgtagaatcagagaagcaaaaggtagatgaaaattcattattgaaagactaaaaatttctttattgaattggggacatgaagatgttgcagcccgttctgctgctttctagcaacaacttttgaaatctcaatgggcataacatttatattgttatatatactattcattttacaagctcccttactttacataattg

SEQ ID NO: 715 - DNA, 1875 bp, Brassica napus
tcttttataaaatcaattcacacttgtcttctctctctagccttcagccctggattgaaatcactttgactggtcttcttatctttatttctcagcctagcttatgatcctgtctctgttttttagagccacactgatcgatctcggatccagtgggttctgtcgattcaacagtttcattccttcatctttgaacaatctgacttcacggcggatatataatgcttaattgcttcattagatccccatgtcaatactctgttgtgttcccgtcatcgaatgcgtatactgcctcggctgctcccactggctgtggaagaaatgcatgtactcggcaggccacgagagcgagagttggggtttagccacttccgacgagttcgaccccatccctaggctctgccgccttatcttagccgtctacgaggaggatctccacaaccccatgtgggcacctcccggtggctacggccttgacccagatcacgtcatcctcaagaaagactacgaccagacccaaggtcgtgtcacaccttacatgatctacctggatcacgacaatgacgctgttgtcttggctattagagggcttaacttggctaaggagagtgattacgctcttcttcttgataacaaacttgggcagactaagtttgatggtggttatgtgcacaacgggttgttaaaggcggccatgtgggttttgaggaggagcatgaggttttgaatagattactcgaggagaacccgagttattccttgacgtttgttgggcattctctaggtgcaggggttgtttctttgctggtcttgtttgtgcttcagaaccgggggaggttagggaacatagagaggaagaggataagatgcgttgctattgctcctccaaggtgtatgtctctccatctagcagtcacatatgcagacatcatcaactctgttgttctacaggatgacttcttacctcggactaccacagctctggaggatgtcttcaagtcaatcatctgcttgccatgcctcttgtgtctcacatgtgtgaaagatacattcacattcgaggagaagaagcttaaggatgcaaggcgtctatatgcccctggtaggttataccacatcgttgtgcgcaagcccttaagattaggaagatatcctcccgttgtgagaacagctgttccagttgatgggaggtttgaccagttagttctctcatgtaatgcgacagcggatcacgccatcatctggattcaaagggagtcacagagagctctcgatttgatgctggaagaggaccaagttatgcagattccggtggagcagaaaattgtgcggcagaaatcagttgttgaggaacatgacgaagagtacagagcggctatcatgaaggcggcttctcttaacatccccatgtctccatcaccttcatatggaacattccatgatacagcagaagaaggtgaaagctctacaggaggatcagttaatgaaggatccccatccatgtggtctttcaagggaatgaagagaaaatggaatcggttcgtagatcgtcattttcctatggatgatgatgacagtggagatatgatattgaagaaagaggaatcttcaactttgttgtgtaggtaagaaaacacgaaataatcttgttatagtaggtgtacatgtagaatgtagaatatagaatcagagaagcaaagaaagttgttagatgaaagttcattgttgagagattgagaattttcttcatcgaattttggatatctgatgtgaaaatgttgcagcaccttctgtgcagtagcctgttctgttgccttgtagtattgttgtaaacaatattcattttacaagctcacttatttgtttgggctacaa

SEQ ID NO: 716 - DNA, 1905 bp, Brassica rapa
aagtaagacgaaagtgcacgtcttttctcctccattagtcctccagattcttctccactctcgttggctgcctaatggaatcttctcagcatctatctttgcctagcttatgatcctgtctccgtttttaagagccacactgatcgatctcggatacagtgggttctgtcgattcaacagtttcattccttcatctttgaacaatctgacttcacggcggatatataatgcttaattgcttcattagatccccatgtcaatactctgttgtgttcccgtgatcgaatgcgtatactgcctgggctgctcccactggctgtggaagaaatgcatgtactcagcaggccacgagagcgagagttggggtttagccacttccgacgagttcgaccccatccctagactctgccgcctcatcttagccgtctacgaggaggatctccacaaccccatgtgggcacctcccggtggctacggccttgacccgcatcacgtcatcctcaagaaagactacgaccagactcaagggcgtgtcacaccttacatgatctacctggatcacgacaatgacgctgttgtcttggctattagagggcttaacttggctaaggagagtgattacgctcttcttcttgataacaaacttgggcagactaagtttgatggaggttatgtgcacaacgggttgctaaaggcggccatgtgggtttttgaggaggagcatgaggttttgaatagattactcgaggagaacccgagttattccttgacgtttgttgggcattctctaggtgcaggggttgtttctttgctggtcttgtttgtgcttcagaaccgggggaggttagggaacatagagaggaagaggataagatgcgttgctattgctcctccaaggtgtatgtctctccatctagcagtcacatatgcagacatcatcaactctgttgttctacaggatgacttcttacctcggactaccacagctctggaggatgtcttcaagtcaatcatctgcttgccatgcctcttgtgtctcacatgtgtgaaagatacattcacattcgaggagaagaagcttaaggatgcaaggcgtctatatgcccctggtaggttataccacatcgttgtgcgcaagcccttaagattaggaagatatcctcccgttgtgagaacagctgttccagttgatgggaggtttgaccagttagttctctcatgtaatgcgacagcggatcacgccatcatctggattcaaagggagtcacagagagctctcgatttgatgctggaagaggaccaagttatgcagattccggtggagcagaaaattgtgcggcagaaatcagttgttgaggaacatgacgaagagtacagagcggctatcatgaaggcggcttctcttaacatccccatgtctccatcaccttcatatggaacattccatgatacagcagaagaaggtgaaagctctacaggaggatcagttaatgaaggatccccatccatgtggtctttcaagggaatgaagagaaaatggaatcggttcgtagatcgtcattttcctatggatgatgatgacagtggagatatgatattgaagaaagaggaatcttcaactttgttgtgtaggtaagaaaacacgaaataatcttgttatagtaggtgtacatgtagaatgtagaatatagaatcagagaagcaaagaaagttgttagatgaaagttcattgttgagagattgagaattttcttcatcgaattttggatatctgatgtgaaaatgttgcagcaccttctgtgcggtagcctgttctgttgccttgtagtattgttgtaaacaatattcattttacaagctcacttattcgtttgggctacaactacaaacttggttttgactcca

SEQ ID NO: 717 - DNA, 646 bp, Arabidopsis lyrata
tttttatctcaccgtcttttatttcgtcttcctcatctttctcgtctctgaacctcttctctaagaacgaataaagaattcgacaaggcaaaaatgtcgacggattgcaacagagccgacgatttcttgttttcacagcaacaagagtctacttctggtgcaaataagtacgaaggacttgtgccaaagaaaaagcctcttatctctaaggattccaaacgtgctttcttcgattcagcagattgggctttactcaagcaagaagcaagtatagatcagagaccaattgcggcaatagagaaactaagacccaaatttcagagaacgcctcgcaaggaacttccccctagaagacccacatgtgcaacgggacatgataatctgacagagtcgagcttttagggtacaaggaaaagggtttgcgtggaaattgtggaacgcgattggtttggtggtagtgagcctactcacgtgtttcatgtttccataaaaaaaacttgtgtgcagttatgcacagtttgttcggtttttttcgatattgattcataaaaatgtttgtcatttcaataaattgcgcagacaattgttgctgtgttctttcttttttcttttgctccattcataaaccttgtggtgttttgttttt

SEQ ID NO: 718 - DNA, 623 bp, Brassica napus
ctttttcccgtctctgaaccactctaaggacgaagtgaaggaatctgaaaaggcaaaaagttagagaaacatggcgactgattacaacagagctgacgatttcttattttctcaacgacaagagtctacctctggtgctcacaaatacggaggacttgtgccaaagaaaaagccacttatctcgcagaatcacaaacgtgctttctttgattcagcagattgggctttacacaagcaagaagcaagtgtagatgagagaacaatagcggcaatagaaaacttaagacccaaattacagagaacgcctcgaaagcaacttcctcttagaagacccacctgtgcaactggacaagagaatttggcagattcgagcttttaaggtacaacgctgaatggttctacgtgtaaatgtaacgtggttggggtacttgggctgggttgagcctgctcacgtgtttcatgtttccattaaaaaccttgtatgaagttgttttgttttagctcttggtccataaaatgctcgtcgtttgaataaatggtgcagacaattgttgctgtttctttctttttattttaaccttgcttgtgattttagtgcctgctagattttgacatgtactttt

SEQ ID NO: 719 - DNA, 540 bp, Brassica oleracea
  misc_feature (115)..(115): n is a, c, g, or t
  misc_feature (183)..(183): n is a, c, g, or t
  misc_feature (185)..(185): n is a, c, g, or t
  misc_feature (187)..(187): n is a, c, g, or t
  misc_feature (209)..(209): n is a, c, g, or t
tcctctttttcccgtctctgaaccactctaaggacgaagtgaaggaatctgaaaaggcaaaaagttagagaaacatggcgactgattacaacagagctgacgatttcttattttntcaacgacaagagtctacctctggtgctcacaaatacggaggacttgtgccaaagaaaaagccacttntntngcagaatcacaaacgtgctttntttgattcagcagattgggctttacacaagcaagaagcaagtgtagatgagagaacaatagcggcaatagaaaacttaagacccaaattacagagaacgcctcgaaagcaacttcctcttagaagacccacctgtgcaactggacaagagaatttggcagattcgagcttttaaggtacaacgctgaatggttctacgtgtaaatgtaacgtggttggggtacttgggttgggttgagcctgctcacgtgtttcatgtttccattaaaaaccttgtatgaagttgttttgttttagctcttggtccatatataaaatgctcgtcgtttgaa

SEQ ID NO: 720 - DNA, 2608 bp, Arabidopsis lyrata
gagccacactgatgatgatgatgatgattccaaccgttggcgaggaatgagagaccttgtcatcgtctttggctcctcctccgcaataactaatcctcaccatcaccaccgtcgctgttacgccacagcaccagagccaaaccgaaaaactaaatccaattcttctttcaccaagctacttccgtcactaccgcagcaacactcaccttctcctgctccagtttccgcgagtcattctctctctaatcacttctctaaggtcgtaagatggattccagatggctcgttggagtattacgctgatttcgcctcgaagctcgctgaggatggccgaattgaggacgtcgctctcatcgccgagactttggctgcagagtccggaactaatgtggcacgtttcgcttccatggttgattatgatctcttatcgaaagggatttcgtcgaatcttcgacaaggtaagattgagagcgttgtttacactttgaagagaattgagaaggtagggattgctccattggaccttgtcgatgaaacgtctgtgaaactaatgaggaaacagtttcgtgcaatggctaactctttgcaagtggagaaagctattgacctaatggagattcttgccggtctcggattcaaaatcaaagagctggtggatccttttgatgttgtaaagagttgtgttgacgtttccaatcctcaattagctattagatacgcatgtcttttgccgcatacagagatattgctttgtagaattattcatggtttcggaaagaaaggagatatggtctctgttatgacagcatatgaagcctgtaaacagattttggatactcctaacatgtatatatgccgcactatgatagatgtttgtggcctgtgtggggattacgttaaatcgaggtacatatatgaggatcttctcaaagaaaacattaagccaaatatttatgttatgaacagtctaatgaatgttaattcccatgatcttgggtacacactaaaagtatacaaggatatgaagaaacttgaagttacagctgacatgacatcctacaacatactactgaaaacatgttgcctggctggacgggttgatcttgcccaggatatatacaaagaagcaaaacgaatggaatcttccggattgttgaagttggatgcctttacgtattgtactattataaaggtttttgcagatgcaaagatgtggaaatgggcactcaaagtcaaagatgatatgaaatctgttggtgtaaccccaaatactcatacatggtcgtcattaattagcgcctgtgccaatgcaggtttagtagagcaggcaaatcacctatttgaagaaatgcttgcatctggttgtgagcctaattctcaatgtttcaacatcctactgcatgcttgcgttgaagcttgccagtatgaccgagcttttcgtctttttcaatcttggaaggggagcacagttaaggaagctttatatgtagatgatagtaaaggtggcatttccagccaaaatagattgaaaaatcatggtcctgggtctttggtgaatagcaattctaattcaccttatatccaagcttcaaatagattttgcttcaagccaacaactgctacatataatatactcttgaaagcctgtggtaccgattactatcgaggaaaagaattgatggatgagatgaagagcctaggtcttgcaccaaatcaaataacatggtcgactttgatcgatatgtgtggtggttcaggcgatgtagaaggtgcggtacggattttgagaactatgcattcggctggaaccagacctgatgttgttgcctacacaacagcaatcaagatttgtgcggaaaataaaagtttgaagttggcattttctttatttgaggagatgaggagatatcagataaagccaaactgggtcacttataacacacttcttaaagcacgaagcaaatatggttctttacttgaagtgcggcaatgcttggccatatatcaggacatgcgaaaagcagggtacaaaccgaacgatcactttctcaaggaacttattgaagagtggtgcgaaggagtcatacaggaaaacggtctgagccaagaagtaagcgaccaagaaggagatgcagggagacctgtaagcctactcattgaaaaagtagctacacacatgcaagagagaacagccggaaaccttgcaattgaccttcaaggacttaccaagattgaggctcgacttgttgttctagcagttttgcgaatgatcaaggaagactatatgcgtggtgatgttgtaatagatgatgtgttgattatcctaggaaccggtgaagcaaattccgattcaggaaagcaagagattactgtgaaagaagcgctagtgaagcttctacaagatgaattgtctcttgtggttcttcctgctggaccaaaaagtatcaaacaggatgcacactgtgtggatgatgcaaaacaagatacagtgcatacgctagagaccactacgtcacttgttagtatatcctcaacaaggagacctgcgattctggagagattgatggtgacaaaggcgtctctgtataagtggttgcagcgcaaaaag

SEQ ID NO: 721 - DNA, 2830 bp, Eutrema halophilum
ataaaaataaaaaccgagaaagagtgagtcacaatgatgatgatgatcccaaccgtgggcgaggaatgagggaccttgtcatcgtctttggctcctcctccgtcataaccaatcctcaccaccgtcgctgttacgccaccgcaccggagctcaaccgaaaacttaaatccacttcttctctcaccaagcaactgccgtcgctgccacagcaacacacatcttctcctgcttcagtttcctcggcgaatgctctctcaagccacttctctgacgccgtgagatggattccagacggctctgtagagtattacgctgatttcgcctcgaagctcgccgaggacggccgaattcaagacgtggccctcatcgccgagaccttggctgcagagtccggagctaatgtggcacgtttcgcttcgatggttgattctgatctcttatcgaaaggaatatcgttgaatcttcgacaaggaaagattgagagcgtggtttacaccttgcaaaggattgagaaggtagggattgctccactggacctcgtcgatgaatcgtctgtgaaacttatgaggaaacactttcgcgcaatggctaactctgtgcaagtggagaaagctattgaccttatggagatactcgcgggtttcagattcaaaatcaaagagcttgtggacccgtttgatgtcgtaaagatttgtgttgacatttccaatccgcaattagctattagatatgcatgtcttttgccccatacagagttattgctttgtagaattatccatggtttcggaaagaaaggagatatggtctctgtattgacagcatatgaagcctgcaaacagattttagacaatcctaacatgtatatataccgcactatgatagatgtttgtggcttatgtggggattacgttaaatcgaggtatatatatgaggatcttctcaaagaaaacattaagccaaacatttatgttatgaacagtctaatgaatgttaattcccatgatcttgggtacacactaaaagtatacaagaatatgcagaaacttgatgttacagctgacatgacatcctacaatatactgctgaaaacatgttgcctggctggacgggttgatctcgcccaggacatatacaaagaagcaaagcgaatggaatcttctggactgttgaagttggacgcctttacatattgtactattataaaggttttcgcagacgcaaagatgtggaaaatggctctaaaagtcaaagaggatatgcaatctgttggtgtaacccctaatactcatacatggtcatcgttaatcagcgcatgtgccaacgcaggtctagtagagcaggcaaatcacctatttgaagaaatgcttgcatctggttgtgagcctaattctcaatgtttcaacatcctactgcatgcttgcgttgaagcttgccagtttgaccgagcttttcgtctttttcaatcttggaagggaagctcagataaggaagccttatatgcagatgatataactggtaaaggtagcattttcagcccaaataaactgaaaaatcatggtaacgggtctttggtgaataccaattcttcaccttatatccaagcttcaaatagatttttcttcaagccaacaacagcgacatataatatactcctaaaagcctgtggtaccgattactatcgaggaaaagaattgatggacgaaatgaggagcctaggtcttgcacctaatcaaataacatggtcgactttgatcgatatatgtggaggttcaggcgatgtagaaggtgctgtagggattttgagaactatgcattccgctggaaccagacctgatgttgttgcctatacaacagctatcaagatttgcgcagaaaataaaagtttaaagttggcattttctttgttcgaggagatgaggagatatcagataaagccaaactgggtgacctataatacgcttcttaaagcacgaagcaaatatggttctttacttgaagtgcggcaatgcttagctatatatcaggacatgcgaaaagcagggtataaacctaacgatcactttctcaaagaacttattgaggagtggtgcgaaggagtcatacaagaaaacagtcaaagccaaattaaaacaagcgaccaggaaggtactaacttagggagacctgtaagtctactcattgaaaaagtagctacacacttgcaagaaagaacagctggaaaccttgcaattgaccttcaaggacttaccaaggttgaggctcgacttgttgttctagcagttttgcggatgatcaaggaagactatatccgaggtgatgttgtaacagatgatttgttgatcatcctaggaaccggtgaagcaaatatcgatccaggaaagcaagagattgctgtaaaagatgtgctagtacagctccttaaagatgaattgtctcttgtggtacttcctgctggacatagacatgtgctagatataacactggatgcacgatgtgtggatgatgcagaccaaggtatagagcttacctcagagaacaccaagtcgattgttggtatatcctcaacgaggagacctgcaattcttgagaggttgatggttacaaaggcgtctttgcaccagtggctgcagcgcaaaaagtagccgatcctgactggtacataactaatcatctgtgtattctatgcaagtttcaaactaaatagaagacaatagtggtgaaagattgcacaacacctcagatgcacatattgtgttccttttaaaataaacaaagagttttcttttatttcctctgtatcttaaggtaaatcagcttacagatattttcc

SEQ ID NO: 722 - DNA, 2833 bp, Eutrema parvulum
acatgaaaaaaaaataaaaagcagaaagagtgagccacaatgatgatgatgatgatcccaaccgttggcgaggaatgagggaccttgtcatcgtctttggctcctcctccgtcataaccaatcctcaccaccgccaccgtcgctgctatgccaccgcaccggagccccacaggaaaacccattccacttcttctctcaccaagccactgctgtcactgccgcagcagcactcagcttctcctgcttcagtttcctcggcgaatactcactactctgacgccgtaagatggattccagacggctcggtagagtattacgccaatttcgcctcgaagctcgccgaggacggccgaattcaagacgtcgccctcatcgccgagaccttggctgcagagtccggggctaatgtggcacgtttcgcttcgatggttgattctcatctcctatcgaaaggtatttcgttgaatcttcgacaaggaaaaattgagagcgttgtttacactttgaagagaattgagaaggtagggattgctccattggacctcgtcgatgactcgtctgtgaaattaatgaggaaacagtttcgcgcaatggctaactcggtgcaagtggagaaagctattgacttaatggagatactagcgggtttcagattcaaaatcaaagagctcgtggatccgtttgatgtcgtaaagatttgtgttgacatttccaatccccaattagctcttagatacgcatgtcttttgccgcatacagagatattgctttgtagaattatacatggttttggaaagaaaggagatatggtctctgtaatgacagcatatgaagcctgcaaacagattttagatactcctaacatgtacatataccgcacgatgatagatgtttgtgggctatgtggtgattatgttaaatcgaggtacatatatgaggatctcctgaaagaagacattaagccaaatatttatgttatgaacagcctaatgaatgttaattcccatgatcttgggtatacaattgaagtatacaagaatatgcagaaacttgatgttacggctgacatgacatcctacaacatactactgaaaacatgttgtctggctggacgggttgatctcgcccaggacatatacaaagaagcaaagcgaatggaatcttgtggactgttgaagttggacgcctttacgtattgtactattataaaggttttcgcagatgcaaaaatgtggaaaatggctctaaaagtcaaagatgatatgcaatctgttggtgtaacgccaaatactcatacatggtcgtcattaatcagcgcatgtgccaacgcaggtttagtagagcatgccaatcacctatttgaagaaatgcttgcatctggttgtgagcctaattctcaatgtttcaacatcctactgcatgcttgcgttgaagcttgccagtatgaccgagcctttcgtctttttcaatcttggaagggaagctcagctaaggaaagcttatatgcagatgatataattagtaaaggtggcatttttagcccaaataaattgaaccatcatggtccccggtctttggtgaatatcaattcttcaccttatatccaagcttcaaatagatttttcttcaagccaacaacagcgacatataatatactcttgaaagcctgtggtaccgattactaccgaggaaaagaattgatggacgagatgaagagcctaggtcttgcacctaatcaaataacttggtcgactttgattgatatatgtggaggttcaggcgatgtagaaggtgctgtacggattctgagaaccatgcattcagctggaaccagacctgatgttgtttcctacacaacagctatcaagatttgcgcggaaaataaaagtttaaagttggcattttctttgttcgaggagatgaggagatatcagataaagccaaactgggtgacctacaatacgcttcttaaagcccgaagtaaatacggttctttacttgaagtgcggcaatgcttagcgatatatcaggacatgcgaaaagcagggtacaaacctaacgatcactttctcaaggaacttattgaggaatggtgcgaaggagtcattcaggaaaacagtcaaagccaaaataaagcaagctaccaggaaggtacgaacttgggaagacctgtaagtctactcattgaaaaagtagctacacacttgcaagagaggacagccggaaaccttgcaattgaccttcaaggacttaccaaggttgagactcgacttgttgttctcgcagttttgcgaatgatcaaggaagactatacgcgaggtgatgttgtaacagatgatttgttgatcatcctaggaaccggtaaagcaaataccgtttcagggaagcaagagattgctgtgaaggatgtgttagtaaagctcctaaaagatgaattgtctcttgtggttcttcctgctggacaaagacatgtgctagatataacacaggatgcacgatgtgtggatgatgcagaccaagatgcagagcacactttagagaataccaagtcgattgttggtatatcctcaacgaggaggcctgcaattctggagaggctgttggtgacaaaggcgtctctgcatcagtggctgcagcgcaaaaagtagctgatcctgactggtacatagctaatcatctttgtatactatgcaattttcaaactaaaataaaataaaatggggaacgattgatgatatctcgatgcacatatcgtgtacttttagaataaaaaaagagttctccattttgtcctctgtatcttaaggtaaatcagcttacaaatatcttccca

SEQ ID NO: 723 - DNA, 3794 bp, Brassica rapa
gaggccatacatttttctcccttttttaattttattaaaaattaaatgtcaaaccggtgtactgtaccaccacaaacccggtccggttcagtagtcgtaagaacagcctctcaaatccaatccaataaaaataaaataaaataaaaagcagagagagtgagccagtgtgattgatgatgatgatcctaaccgttggcgaggaatgagagaccttgtcatcgtcttcccctcctcctccctcataaccaatcctcaccaccaccaccacaatcaccgccgccgctacgccaccgcaccggagcacaaccgtaaaactaaatacacttcttctctcaccaagcaactgccttcactttcatcggcgaatcatctctcaaatcacttccccgacgccgtgagatggactccagacggttccgtggagtattacgccgatttcgcctcgaagctcgccgaggacggcagaatccaagacgtagcgctcatcgccgagaccttagctgcggagtccggagccaatgcggcgcgattcgcttcgatggttgattctgatctcttatcgaaagggattgcattgaatcttaggcaagggaaggttgagagcgtggtttacactctgaagagaattgagaaggtagggattgctccgttggacctcgtcaatgatgactcgtctgtgaagctgatgaggaagcagtttcgcgcaatggctaactctgtgcaagttgagaaagctattgacttgatggagatacttgccggtttcagattcaaaatcaaagacctggtggatccgtttgatgtcatcaagatttgtgttgacatttccaatccccagttagctcttagatacgcatgtcttttgccgcatacagagatactgctttgtagaattattcttggttttgggaagaaaggagatatggcctctgtaatgacagcatatgaagcctgcaaacagattttggatgctcctaacatgtatatataccgcactatgatagatgtttgtggcctttgtggtgattatgtcaaatcaaggtacatatatgaggatctactgaaagaagacattaagccaaatatttatgttatgaacagcctaatgaatgttaattcccatgatcttgggtacacactaaaagtatacaagaatatgcagaaacttaatgttacagctgacatgacatcctacaacatactactgaaaacatgttgcctggctggacgggttgatctcgcccaggacatatacaaagaagcaaaacgaatggaatcctctggactgttgaagttggacgcctttacatattgtactattataaaggtttttgcagatgcaaagatgtggaaaatggctctaaaagtcaaagaggatatgcaatctgttggtgtaaccccaaatactcatacatggtcgtcgttaatcagcgcatgtgccaacgcaggcttagtggagcaggcaaatcacctatttgaagaaatgcttgcatctggttgcgagcccaattctcagtgtttcaacatcctactgcatgcttgcgttgaagcttgccagtatgatcgagcctttcgactttttcaatcttggaagggaagctccgcaaaggaagccttgtatgcagatgatataattagtaaaggtggcgttttcaacccaaataaattgaaccatcatggtccagggtctttggtgaaaagcaattcttcaccttatatccaagcttcaaatagattcttcttcaaaccaacaacagcaacgtataatatactcttgaaagcttgtggtaccgattactatagaggaaaagaattgatggacgaaatgaagagcctaggtcttgcgcctaatcaaataacgtggtcgactttgattgatatatgtggaggttcaggcgatgtagaaggtgccgtacggattctgagaactatgcattcagatggaaccagacctgatgttgttgcctacacaacagctatcaagatatgcgcggaaaataaaagtttaaagttggcattttctttgttcgaggagatgaggagatttcagataaagccaaactgggtgacctataatacgcttctcaaagcacgaagcaaatatggttctttacttgaagtgaggcaatgcttagccatatatcaggacatgcgaaaagcagggtacaaacctaacgatcactttctcaaggaacttattgaggagtggtgcgaaggagtcattcaggaaaacagccaaagccaaaacaaagcaagcgacctggaaggtactgactttgggagacctgttagtctactcattgaaaaagtagcttcgcacttgcaagagagaacatccggacaccttgcaattgaccttcaagaacttaccaaggttgaggctcgacttgttgttctagcagttttgcgaatgatcaaggaagactatacacgaggtgatgttgtgaaagatgatttggtgatcatcctaggaaccggtgaagcaaataccgattcagggaagcaagaggttgctgtaaaagatgcgctagtaaagctcctgaaagatgaattgtctctggtggttcttcctgctggacaaagacgtgtgctagatataacacaggatgcaagatttgtggatgatgcagaccaaaatacagaacatacttcagagaacaccaagtcgattgtcggtatgtccactacgaggaggcctgcaattctggagaggttgatggtgacaaaggcgtctttgcataagtggctgcagcgcaaaaagtagttgatcctgactggtacataactaatcatctttgtattctatgcaaatttcaaactaaattggagaaaaataacgaggaaagattgcagaatatcttgatgcaaatatctgtgtacattcagaaaaaacagcttacaaatatcttcccagttctgtgtaaaccgatacaacacaatttaaaacccaaatatcgatctctgcgataacacatatcagtaaacttgttggtctctaattgaacagtaactcaataagaacagcaacctgaagatcagagccaatcctgctgctgcagtttcaggggcaagtaaacttctgataaatactggaaaccaaaagaactcaacgcctgaatctcagccttctgctttgtcttcaccatcaggttaagttcttcgacccacccaggattcttcttcacgaaatcctcctccagcatatccttcccggtcttaatatcctgctcagtcatcggcaacctacactgctcaggaatcttgtacttatccaaatcacttggcctgatcccaagccacttaatatcaggtgtagtcaagtttgcgctatcgtaagacatgttcttcgacccgcatccataaaccgacaagatcttcaacccgtaaggatcactatccaccaaggcaagcaccggaagcttaagctccattttcatcttcctcaagaacagcctcgtggctacatcgggctggccttttgcagtgacgatgatgcaggggaaccggttgtagaatctgtcttcagctagccttatgtaagctgcatctttctcaactaagagtatgaacatagcatcactctgcatgtctccaactcgatcgatgttcggtggaatggctttcccacccatccccatctttgtgcagtctatcatgtctccgttgtcactgaatatgagccttcccaccaccacacctttctccgctgcaattacattgaggcttgaccttgtgcagccgagcatacacgacacgtcgtccaacacagcatcactctgtgtctggtcctgaga

SEQ ID NO: 724 - DNA, 2225 bp, Arabidopsis lyrata
gaaacacctttctccttgtttctaaaaaagtcatcttcttttccttttttttcttcatcatacacatctctctctctctctctcctaaaaacactcgtcacgcgccacgaactccccaccacagcacaccacattcaccactactagtgccccctccacctctccgtctatggcgtcagacgccgttaagtatatgccaatccacggcggaggaacaacaacaacaacaaccgccgccgacatcaagagcttcttctctgctttgaaacccaaaaaaccctcaactttcgcttacgcttttgtaataacctttgtctcttttactctgttttttgcttttagtccttctccaaactcttcttctccttggttctctaacatcttcacttcctcctccaccaccacaacttcggtatcagacaacacttccggatctcagttctcttcaattttctcttatatcctccccaatgtcacttcaaccaaacccaccaatagatccagtgacgcaacagatcctatctctgttaacgccacttctccgtctctcaattcgaattccaaaaacgttactttacaagcaccggcgccggaaactcatactccgattgctaaaaacacaacctttgagcctccgatcgtaaacggaaccaacccagttgcaaagaacaacactttatctcatcctctgctttcagacaaatcctcggcgacgggatcgaataatcagtcacggaccaccagcgatactgaaaccgtgaagagaaaccagacaacagttccggcgccgtcgaaagcaccggtgtcggtggatctgaagaccaattctagttccaattcatcaactgcttcttctacaccagaaaagcagactaaaaacgttgatttggtttcttcgatgaagcaagagatcgagaaatggagagattctctgaagaattgcgagttcttcgacggtgaatggatcaaagatgattcgtacccgctttataaacccggttcgtgtaagcttatcgatgaacagttcaattgtatttccaacggaagacccgacaaagatttccagaaattgaagtggaaacctaagaaatgtagtttaccaaggttaaatggagctatattgttggagatgcttagaggaagaagactagtctttgtgggtgattctctaaataggaacatgtgggaatcactggtttgtattcttaaaggatcagtgaaagatgagactaaagtctacgaggctagaggaagacatcattttcgtggggaggccgagtactctttcgtcttccaagattataactgcacggtggagttctttgtttcaccgttcttggttcaagaatgggaaattgtagacaagaaaggaacaaagaaggagactttaaggttggatttggttgggaagtcctctgagcagtacaagggagcggatattattgtatttaataccggacattggtggactcacgagaaaacatctaaaggggaggattattatcaagaaggaagcaatgtttatcatgaactcgctgttcttgaagcttttcgtaaagctttgactacatggggtcgatgggtcgagaagaatgtgaatcctgcaaagtccctcgttttctttcggggctactccgcctcccatttcagtggtgggcaatggaactcaggaggagcatgcgatagcgaaacagaaccgatcaagaatgacacatacctaaccccgtacccgtctaaaatgaaggtgcttgagaaagtgctaagaggtatgaaaacacccgtcacgtatctaaacatcacgagattgacggactacaggaaggacggtcacccgtcagtataccggaaacatagcttatcggaaaaagagaaaaagacgcctttgctgtaccaagactgcagccattggtgcctcccgggagttcccgactcttggaatgaaatcctctacgctgagctgctagtcaaactcaatcagctcagccaaacacaacggaaaacttaaggttcttccaccccaatacttgtttgatctcaacacttttactttctattgtgatggtaattgttgattatagaatgtgtagagtaaaaggaaaaaattaaaaatattgatcacccgatatctttgttactaatggttgtaaatgcttttgtcacgacgaatactatatttagctccaaagagaggttacatattcatatttataatggaattgattcaa

SEQ ID NO: 725 - DNA, 2351 bp, Eutrema halophilum
taacggtgtcgtctaaacaaatgaccctttattatcttcttaacccctttctcacttgtttctaaaaaagtcatgtctttccttcatacacatctctgcacttgtttctctctctaaccctaaacaaaagcattatttctctctttctaaaccaccaaaaaacactcttcacgcgcccacgaactccaccacaccatattcctacaaatttgtgcctctccctctccgtctatggcgtcggacgccgtaaagtatatgccgattcacggcggaacaacaacaacaaccgccgccgcagccgagatcaagagcttcttctccgccgtgaaaccgagaaaaacctcaactttcgcttacgcctttgtaatcactttcgtcgctttcactctattctttgcctttagtccttctccaaactcttcttccccttggttctctaacatcttctcttcctcctccaccacatctccttcatcagacaacacttccggatctcacttctcttcaatcttctcctatatcatccccaatgtcactttaacgaaacccaccaatagatctagcgacgccacgtcgaatttcacagagcctatccctgtaaacaccacttcaccgtcttctcccacttcgaattccgtctccgataccatcagaaacggtactttgcaagctccggcgccggaaaatctcactccgattgctaaaaactcgacctttaagtctccgatcgtaaacagaaccaacccggttgccaaaaccaacacttcttctcatcctctgcttccagataaatcgccgacgggatcgagtaatcagtcactgaccaccgatgccgctcgaaaccagaagacagcagctccggcgccgtcgaaagcacccgtgtcggtgaacctgacggccaattccagctcatcagctccttctacgccggaaaaacaaaccggaaacggtggcttggtgacttcggtgaaacaagagatggagaaatggagtgaatctctgaaagactgcgagttcttcgacggtgaatggattaaggatgattcgtatccgctctacaaacccggttcgtgtaagctgattgatgaacagttcaattgtatttcaaacggaagacccgataaaggtttccagaaattgaagtggaaacctaagaaatgtagtttaccaagattaaatggaggtattttgctggagatgcttagaggaagaaggctagtgtttgttggggattctctaaataggaacatgtgggaatctctggtttgtattcttaaaggatcagtgaaagatgagagcaaagtctatgaggctagtggaagacatcattttcgtggggaggctgagtactccttcgtcttccaagattacaattgcacggtggagttttttgtttcacctttcttggtccaagaaacggaaattgttgacaagaagggaacgaagaaggagactctacggctggatttggtcgggaagtcgtctgagcagtacaaaggagctgatattatcatcttcaacaccggacattggtggactcacgagaaaacatccaaaggggaggattattatcaagaaggaagcaatgtctatcacgaactcgctgtacttgaagctttccgtaaagctttgaccacatggggtagatgggttgagaagaatgtgaatccagacaagtcccttgttttctttcgtggctactccgcttcacatttcagtggtgggcaatggaactcgggaggagcatgcgatagcgaaacagaaccaatcaagaacgagacgtacctaaccccatacccttcgaaaatgaaggtgctagagagagtgttaaggggaatgagaacgcccgtcacgtatctaaacatcaccagattaacggattacaggaaagacggacacccttcagtgtaccggaaacatagcttatcggaaaaggagaaaagaacgccgttgctgtatcaagactgcagccattggtgcctccctggagttcccgactcttggaacgagatcctctacgccgagctactcgtcaaactcaaccagcttggccaagcacgacggaaaccttaggaaaaaaaaggtttttttggtcttatctcctcaatactttgatctttcgatgctttgatggttttagttgattatagaatgtgtagagtaaaaaaagaagattgaaaatatgatttacttggatgtcgttgcttggttgtaaatgcttttgtcactcactacactacgattattctcaaagagagaggttacatagtattgatcaatgttttacttccaataatcgtttttagctatgtttgatgatctaaatagaacatggcttttttttcttggtg

SEQ ID NO: 726 - DNA, 2213 bp, Eutrema parvulum
aatagagcattgtttctctttctaaaccaccaaagaacactcctcacgcgccacgaactccacattccccactttcttgtccactgttctctcccctctccgttctatggcgtcggacgccgtcaagtatatgccgattcacggtgggacaacaacaacaaccgcggccgccgctgaaattaagagcttcttctccgccgtgaaacccagaaaaacatcaactttcgcttacgcctttgtaataaccttcgtctctttcactctattctttgcctttagcccttcttcgaactcatcttctccttggttctctaacatattctcttcctccgccgctccttcatcagacagcacttcaggatctcacttctcttcgattttctcctatattatccccaatgtcacttcagccaaacccaccaatagatccaccgacgccaagtctaatatcaccgtccctgtctccgtaaactccacttccccttcccccagtttgaattctgtctccgatgccgtcaaaaacagtactttgcaagcaccggcgccgaaaaatcgaactccggttgctaaaaacgcgacctttgaatctccaatcgtaaacggtaccaacacggttgctaaaagcaacacttctcaccctctgctttcggataaatcgtcgacaagatcaagtaatcaatcacggaccaccgatgctgttcgaaattcggaagccgtgaagagaaaccagacaggagcttcgtcgccaccaaaagcacccgtgtcggtggatctgaaagccaattccagctcatcaacagcttctacaccgggaaagcaaatcggaaaaagtgattcggtttcttcagcgaaacaagagatcgagaaatggagtgaatctctgaaggattgcgagtttttcgacggtgagtggattagggacgattcgtatccactttacaaacccggttcttgtaagctgatagatgaacagttcaattgtatttcaaacggaagagccgacaaaaatttccagaaattgaagtggaaacctaagaagtgtagtttaccaaggttaaatggaggtattttgctggagatgcttagaggaagaaggctagtgtttgtgggggattctctaaataggaacatgtgggaatctctggtttgtatactcaaaggatcagtgaaaaatgagagcaaagtctatgaggctaggggaagacatcattttcgtggggaggctgagtactccttcgtcttccaagattacaattgcacggtggagttctttgtttcaccattcttggtccaagaaacggaaattgttgacaagaagggaacgaagaaggagactttacggctggatttggttggaaaatcctcagagcaatacaaaggagcggatattattgtcttcaataccggacattggtggactcacgagaaaacatccaaaggggaagattattatcaagaaggaagcaatgtttatcacgaactcgctgttcttgaagctttccgtaaagctttgaccacatggggtcgatgggttgagaagaatgtgaatccggagaagtcccttgttttcttccggggttattccgcctcgcatttcagtggtgggcaatggaactcaggaggaggatgcgatagcgaaactgaaccaatcaagaacgagacatacctaaccccttacccgtctaaaatgaaggtgctagagagagtgttaaggggtatgagaacgcctgtcacgtatctaaacatcaccagattaacggacttcaggaaggatgggcacccgtcagtataccggaaacatagcttatcggacaaagaaaaaagaacgccgttgctgtaccaagactgcagccactggtgcctcccaggagttcctgattcttggaacgaaatcctctacgccgagctgctcgtcaaactcaatcagcttggccaaacacaacggaaaccttaaggttcttctatctcgaacacttgtttggtctcaatactttgctttcttctatgtgattgtttttagttgattatagaatgtgtagagtaaaaaaagatgaaaaatatgatatactctgatatctttgttactatttggtgtaaatgcttttgtcacaatgaatactacatttagctccaaagagaggttacatattattattttataatgagattgattccaataatcgtttttagctatgtttgatgttctaaataga

SEQ ID NO: 727 - DNA, 2250 bp, Brassica rapa
ctcctaacggtgtcgttcggacataactacgacccctttctctttgtttctaaaagttcatcttctctcctacttttttttctctctctaaccctaaacaaaaccactgtttctctctctcccaaccactaaaacactccccacgcgccacgaactcctccacacacaccacttcccctccacatggcgtcggacgccgtcaaatatatgccgattcacggcgcaacaacaacaaccgccgccgccgcagcagaaataagaagcttcatctccgccgtgaaaccgaaaaaaacatcaactttcgcttacgcgtttgtaatcaccttcgtctctttcactctcttcttcgcctttagtccttctccgaactcatcttctccttggttctccaacatcttctcttcttcctccttctcctcctccaccaccaccaccgccgccgctccttcttcatcgaaaacagcttccgtctcttcgatcttctcctacataatccccaatgtcacttcaactaaccccaccaatagatctagcgacgccgcgtctaacaccaccgtccccgtctccgttaactccacttctccttccctaagttcgagttccgtcgtcaaaaacagtacgttgcaagcaccgccgccggagaatcgaactccggttgctaaaaactcaacctttgaatctcctgtcgtaaaccggaccgaaccggttgcgaaaaccaacacttcgcaacctctgcttccgacaggatcgagtaatctgtcgcggaccgccgacaaagctccgtcgccggcgaaatcaccaccggtgtcggtggatctgacatccaattccacctcctcagctccttctaaaccgggggagcaaaccggttctgtttctttattggaacaagagatcgagaagtggagtgagtctctgaaagactgtgagttcttcgacggtggatggatcatggacgacacgtacccgctttacaaacccggttcgtgtaatatcatcgacgagcagttcaactgtatctcaaacggaagacccgacaaagactttcagaagctgaagtggaaacctaagaaatgtagtttaccgaggttaaatggaggtattatgcttgagatgcttagaggaagaaggctagtgttcgtgggggattctctgaataggaacatgtgggagtctctggtttgtatgcttaaaggatcggttaaagatgagagtaaagtctatgaagctagtggtagacatcattttcgtggggaggctgagtactccttcgtcttccaggattataattgcacggtggagttctttgtttcaccgttcttggttcaagaaaatgagattgttgacaagaagggaacaaagaaggagacgctaaggcttgatttggttgggaagtcttcagagcagtacaaaggagctgatattattgtctttaataccggacattggtggactcacgagaaaacatccaaaggggaggattattatcaagaagggagcaatgtgtatcacgagctcgctgtacttgaagctttccgtaaagctttgaccacatggggtcgatgggtagagaagaacgtgaaccctgacaagtctcttgttttcttccgtggctactcggcctcgcatttcagcggtgggcaatggaactctggaggagcttgcgatagcgagacggaaccgatcaagaacgagacgtaccttacaccgtacccggataaaatgaaggtgctagagagagtgttaaagggtatgagaacgccggtcacgtatcttaacatcactagattaacggactacagaaaagatggtcacccgtcggtgtaccggaaacagagcttatcggataaagaaaagaaaacgccgttgctgtaccaagactgtagccactggtgcctccctggagttcctgactcttggaacgagatcctctacgctgagctgctcgtcaaactcaatcagcttggccaaacacgacggaatccttaaaaggttttttccatctcgaacatttgtttgatctctcaatacttttctttcttctgtttgattgtttttagttgattatagaatgtttagagtaaaaaagatgaaaagtatgatttactctcttatatctttgctactatttattgtaaatccttttgttaccacggttactatacttagctccaaagagagaagttacatattgatcttttgattccagtaatcgctgtaacatatgtttgattgatgatctaaattgag

SEQ ID NO: 728 - DNA, 573 bp, Arabidopsis lyrata
gggggttgggtttcttctccctttctacattctctctctctcttctttctctcttcactttgatctaatggccggcctaagatggagagagtggtggaacacgatggccttccccacccggcgcatctggaatcgtttcaccgttcgcgtcgggtttcgacatagcggactcttgaggttacaaaacgacgtgagttcttgcgagtacgaagacatacacataatgtggaatctgttacacaagaatgaagatcttacacgtaccgcaccaatccaacaacaacaacaaaggaagaaaccttgctggaatcttcttggttcatatctttgccaaagattctgatccaaataaccaaaccattgttgtatttgagagagccttgacgggtcccttgcagtgtggtgtggttttattggcaaatttcgcaaataatgaatccgaggttgcatagttttatttagctgttatatattccatggcatacctctatgtacttatgattatcatcacatgagtgttgtatatagaatacaaaatgcttcacatagtttgataatacttgtgttcatcta

SEQ ID NO: 729 - DNA, 707 bp, Eutrema halophilum
attataaaattaaaaatacagccatctcaccgtttatttaattgaagctattgcttgtaacgtcagtttttgggagttgggtttgttctacagtctctctctcctctctcttctctcctcaaatggccggcgtgagatggagagagtggtggaacacgatggcgttccccacgcggcgaatctggaatcgtttcaccgttcgcgtcggattccgtcatagcggactcttgaggctacagaacgacgtgagttcttgcgagtacgaagacatacacatcatgtggaatctgttgcacaagaacgaaattcagacaccaacaccaacacgtggcgctcgaatccaacaacggatccaacaaaggaagaaagcttgttggaatctactgatcggttcatatctttgccaaagattctgattattatatatatataaaaaaaatataacccaaaaacattccaaaaccatcgttgtaactgagagagccttgacgggtcccctgcaaatgtggtgaggtaattgacatatttggcgaataagaaaatccgaggctgcacagttttagctgctgttatgttccatatcatgcctctatatatattatatgagtattattatcacttgagtgttgtatatatgaaacaattgttttaagatagtttggatacatctatgttcatctatatggttttctggttttgccattcac

SEQ ID NO: 730 - DNA, 636 bp, Brassica juncea
atggccggcctgagatggagagagtggtggaacacgatggcgttcccctcgcggcgaatctggaatcgtttcaccgttcgcgtcggattccgccacagtggacttttgaggttacaaaacgacgtgagttcttgcgagtacgaagacatacacatcatgtggaatctgttgcacaagatcgaagatccgacacccatacgtggcgcacggatccaacaacgaatccaacagaggaagaaagcttgttggaatctcttcgattcatatctttgccaaagattctgattatatttattataatatatataacctaaacaaatttctccaaaaccatagttgtaatttgtgagagccttgacgggtcccctgcaagtgtggtgaggttatccaaggttgaacggtttagcggcaattccatggcatgtgtctcctccctgtatgtaatatatgcgtattatcattagatgagtgttgtgatatataagatttaaatggttccatactttgatgttacgcttatctatgtatttttctgattctactcagaaacacaacttttaaacccataaccatttgatatctgccatgacatattcatatttccttgagaaaatgaaaaccaatatttgatccttg

SEQ ID NO: 731 - DNA, 397 bp, Brassica juncea
cccctgcaagtgtggtgagagccttgacgggtcccctgcaagtgtacgcgggattctgattatgcaatatataacctaaatatttccaaaaccatagttgtaatttgtgagagccttgacgggtcccctgcaagtgtggtgaggttatccaaggttgaacggtttagcggcaattccatggcatgtgtctcctccctgtatgtaatatatgcgtattatcattagatgagtgttgtgatatataagatttaaatggttccatactttgatgttacgcttatctatgtatttttctgattctactcagaaacacaacttttaaacccataaccatttgatatctgccatgacatattcatatttccttgagaaaatgaaaaccaatatttgatccttg

SEQ ID NO: 732 - DNA, 596 bp, Brassica oleracea
  misc_feature (546)..(547): n is a, c, g, or t
gtttgttgtacagtctctctcctctcttcttttctctctctcctcgcttgctcaaatggccggcctgagatggagagagtggtggaacacgatggcgttccctacccggcgaatctggaatcgttttaccgttcgcgtcggattacgccacagtggactcttgaggttacaaaacgacgtgagttcttgcgagtacgaagacatacacatcatgtggaatctgttacacaagattgaagatccgacaccaacaccaacacgtgttgcacgaatcaaacaaaggaagaaagcttgttggaatctcttcggttcatatctttgccaaagattctgattatacaatatatataacctaaaaactttccaaaaccatacttgtaatttgtgagagccttgacgggtcccctgcaagttggtgaggttatcgacaaatttcgcaaaagaataaactccgaggttgtacagttttagctgttatatttacatggcatgcctctctgtaagttatctaaatatctatgagtatcatcatcacatgagtgttgnngtatgtatgatagaaatgcttctcatagtctaatattactatgttcatc

SEQ ID NO: 733 - DNA, 720 bp, Eutrema halophilum
cgtttatttaattgaagctattgcttgtaacgtcagtttttgggagttgggtttgttctacagtctctctctcctctctcttctctcgtctctctctcctctctcttctctcgtctctctcttcacaagctcaaatggccggcgtgagatggagagagtggtggaacacgatggcgttccccacgcggcgaatctggaatcgtttcaccgttcgcgtcggattccgtcatagcggtaagtcttgaggctacagaacgacgtgagttcttgcgagtacgaagacatacacatcatgtggaatctgttgcacaagaacgaaattcagacaccaacaccaacacgtggcgctcgaatccaacaacggatccaacaaaggaagaaagcttgttggaatctactgatcggttcatatctttgccaaagattctgattattatatatatataaaaaaaatataacccaaaaacattccaaaaccatcgttgtaactgagagagccttgacgggtcccctgcaaatgtggtgaggtaattgacatatttggcgaataagaaaatccgaggctgcacagttttagctgctgttatgttccatatcatgcctctatatatattatatgagtattattatcacttgagtgttgtatatatgaaacaattgttttaagatagtttggatacatctatgttcatctatatggttttctggttttgccattca

SEQ ID NO: 734 - DNA, 668 bp, Brassica rapa
gcacgagggtttgttgtacagtctcttctctctctctcttctctctccctcttctctcctgtctttgcaagctctctcatatggccggcctgagatggcgagagtggtggaacacgatggcgttccccgcgcggcgcatctggaatcgtttcaccgttcgcgtcggattccgccacagcggactcttgaggttacaaaacgatgtgagttcttgcgagtacgaagacatacacatcatgtggaatctgttgcacaagatcgatgatccgacacccatacgtggcgcacggatccaacaacgaatccaacagaggaagaaagcttgttggaatctcttcgattcatatctttgccaaagattctgattatatttattataatatatataacctaaacaaatttcaaaccatatttgtaatttgtgagagccttgacgggtcccctgcaagtgtggtgaggttattgacaaatttcgctaaatattaaaatccaaggttgaacggtttagcggcaattccatggcatgtgtctcctccctgtatgtaatatatgcgtattatcattagatgagtgttgtgatatataagatttaaatggttccatactttgatgttacgcttatctatgtatttttctgattctactcagaaacacaacttttaaaccca

SEQ ID NO: 735 - DNA, 689 bp, Raphanus sativus
  misc_feature (322)..(323): n is a, c, g, or t
gggaagctattgcttgtaacgtcagttttgggagttcggtttgttgtacagtctctctctctcccctttctctctcctctcttctctgtctttgtaagctctctcatatggccggcctgagatggagagagtggtggaacacgatggcgttccccacgcggcgaatctggaatcgtttcaccgttcgcgtcggattccgccacagcggacttttgaggttacaaaacgacgtgagttcttgcgagtacgaagacatacacatcatgtggaatctgttgcacaagatcgaagatccttcaccgacgcctagcacacagtttannaaacgaattcaacagaagaagaaagcttgttggaatctcttcggttcatatctttgccaaagattctgatcataaatatatttataaaaaaaaaactaaacaagttccaaaccatagttgtaatttgtgagagccttgacgggtcccctgcaagtgtggtgaggttattgacaaatttagcgaaataataaaatcggaggttgaacggttttatctggcgtatttccatggcatgtttccctgtatgtaatatgagttttatcattacatgaatgttgttgtatataagatataaaatgcttccatactttgatgcaactacccttatctatgtgtttttctgattttgcacatttacattagagc

SEQ ID NO: 736 - DNA, 936 bp, Brassica rapa
ccacacggtccatacctgtcttttccgtctatttaattgaagctattgcttaaaacgtcagtttcgggagttgggtttgttgtacagtctcttctctctctctcttctctctccctcttctctcctgtctttgcaagctctctcatatggccggcctgagatggcgagagtggtggaacacgatggcgttccccgcgcggcgcatctggaatcgtttcaccgttcgcgtcggattccgccacagcggactcttgaggttacaaaacgatgtgagttcttgcgagtacgaagacatacacatcatgtggaatctgttgcacaagatcgatgatccgacacccatacgtggcgcacggatccaacaacgaatccaacagaggaagaaagcttgttggaatctcttcgattcatatctttgccaaagattctgattatatttattataatatatataacctaaacaaatttcaaaccatatttgtaatttgtgagagccttgacgggtcccctgcaagtgtggtgaggttattgacaaatttcgctaaatattaaaatccaaggttgaacggtttagcggcaattccatggcatgtgtctcctccctgtatgtaatatatgcgtattatcattagatgagtgttgtgatatataagatttaaatggttccatactttgatgttacgcttatctatgtatttttctgattctactcagaaacacaacttttaaacccataaccatttgatatctgccatgacatattcatatttccttgagaaaatgaaaaccaatatctgatccttggatacataaattaataaaagggatgcaattgtgcaattgcaaagcatgatttcctttcaccactgttgaggtaaaataacgtcggattcattgtacatttgtaatactacataaacaataagtgagatggtt

SEQ ID NO: 737 - DNA, 393 bp, Brassica juncea
tcaacgcagagtacgcgggggggagttgggtttgttgtacagtctcttctctcctatctctctcttctctcctctgtctttgcaagcttctctcatatggccggcctgagatggagagagtggtggaacacgatggcgttccccacgcggcgaatctggaatcgtttcaccgttcgcgtcggattccgccacagtggacttttgaggttacaaaacgacgtgagttcttgcgagtacgaagacatacacatcatgtggaatctgttgcacaagatcgaagatcagacaccgacgcgtagcgcaaagttcaacaaacgaatccaacagaagaagaaagcttgttggaatctcctcggttcatatctttgccaaagattctgatcataaacattt

SEQ ID NO: 738 - DNA, 597 bp, Brassica napus
tcagagctctctcatatggccggcctgagatggcgagagtggtggaacacgatggcgttccccgcgcggcgcatctggaatcgtttcaccgttcgcgtcggattccgccacagcggactcttgaggttacaaaacgatgtgagttcttgcgagtacgaagacatacacatcatgtggaatctgttgcacaagatcgatgatccgacacccatacgtggcgcacggatccaacaacgaatccaacagaggaagaaagcttgttggaatctcttcgattcatatctttgccaaagattctgattatatttattataatatatataacctaaacaaatttcaaaccatatttgtaatttgtgagagccttgacgggtcccctgcaagtgtggtgaggttattgacaaatttcgctaaatattaaaatccaaggttgaacggtttagcggcaattccatggcatgtgtctcctccctgtatgtaatatatgcgtattatcattagatgagtgttgtgatatataagatttaaatggttccataaaaaaaaaaaaaaaagggcggcccggacgcgtgggtcgaccaggaattcggaccggtc

SEQ ID NO: 739 - DNA, 608 bp, Brassica napus
gagtttttgggagttgggtttgttgtacagtctatccctctcttcttttctctctctcctcgcttgctcaaatggccggcctgagatggagagagtggtggaacacgatggctttccctacccggcgaatctggaatcgttttaccgttcgcgtcggattacgccacagtggactcttgaggttacaaaacgacgtgagttcttgcgagtacgaagacgtacacatcatgtggaatctgttacacaagattgaagatccgacaccaacaccaacacgtgttgcacgaatcaaacaaaggaagaaagcttgttggaatctcttcggttcatatctttgccaaagattctgattatacaatatatataacctaaaaactttccaaaaccatacttgtaatttgtgagagccttgacgggtcccctgcaagttggtgaggttatcgacaaatttcgcaaaagaataaactccgaggttgtacagttttagctgttatatttacatggcatgcctctctgtaagttatctaaatatctataagtgtcatcatcacatgagtgttgttgtatgtatgatagaaatgcttctcatagtctaatattactatgtt

SEQ ID NO: 740 - DNA, 474 bp, Brassica juncea
tcttcttttctctctctcctagcttgctcaaatggccggcttgagatggagagagtggtggaacacgatggcgttcccctcgcggcgaatctggaatcgtttcaccgttcgcgtcggattacgccacagtggactcttgaggttacaaaacgacgtgagttcttgcgagtacgaagacatacacatcatgtggaatctgttgcacaagatcgatgatccgacacccatacgtggcgcacggatccaacaacgaatccaacagaggaagaaagcttgttggaatctcttcgattcatatctttgccaaagattctgattatatttattataatatatataacctaaacaaatttcaaaccatatttgtaatttgtgagagccttgacgggtcccctgcaagtgtggtgaggttattgacaaatttcgctaaatattaaaatccaaggttgaacggtttagcggcaattccatggc

SEQ ID NO: 741 - DNA, 359 bp, Brassica juncea
cgggggagttgggtttgttgtacagtttcttctttctctctcttctctcctctgtctttgcaagctctctcatatggccggcctgagatggagagagtggtggaaaacgatggcgttccccgcgcggcgcatctggaatcgtttcaccgttcgcgtcggattccgccacagcggactcttgaggttacaaaacgatgtgagttcttgcgagtacgaagacatacacatcatgtggaatctgttgcacaagatcgatgatccgacacccatacgtggcgcacggatccaacaacgaatccaacagaggaagaaagcttgttggaatctcttcgattcatatctttgccaaagattctgat

SEQ ID NO: 742 - DNA, 758 bp, Brassica rapa
attataaaagaacatccctctctttccgtctatttaattgaacctattggttgtaacgtcagttttgggagttgggtttgttgtacagtctctctctctctctctcttcttttctctcaaatgaccggcctcagatggagagaatggtggaacacgatggcgttccccacccggcgaatctggaatcgtttcaccgttcgcgttggattacgccacagtggactcttgaggttacaaaacgacgtgagttcttgcgagtacgaagacatacacattatgtggaatctgttgcacaagattgaagaaccgacaccgacacgtgttgcacgaatcaaacaaaggaagaaagcttgttggaatctcttcggttcatatctttgccaaagattctgattatacagtgtatatatataacctaaagtatttccaaaaccatagttgtaatttgtgagagccttgacgggtcccctgcaagtgtggtgaggttattgacaaatttcgcaaaagaataaactccgaggttgtacagtcttagctgtttaagtttccatggcatgcctctctctgtatgttatctaaatatctatgagttcaacacatgagtgttgttgtatgtatgatagaaatgcttctcgtattttaatgttactatgttcataaatctagaagattctcaaagctttcatcttttttcaccggctctggctgctttcacagaaccggagttgggtttcattttttgttctatgttctgtttc

SEQ ID NO: 743 - DNA, 627 bp, Brassica rapa
attggttgtaacgtcagttttgggagttgggtttgttgtacagtctctctctctctctctcttcttttctctcaaatgaccggcctcagatggagagaatggtggaacacgatggcgttccccacccggcgaatctggaatcgtttcaccgttcgcgttggattacgccacagtggactcttgaggttacaaaacgacgtgagttcttgcgagtacgaagacatacacattatgtggaatctgttgcacaagattgaagaaccgacaccgacacgtgttgcacgaatcaaacaaaggaagaaagcttgttggaatctcttcggttcatatctttgccaaagattctgattatacagtgtatatatataacctaaagtatttccaaaaccatagttgtaatttgtgagagccttgacgggtcccctgcaagtgtggtgaggttattgacaaatttcgcaaaagaataaactccgaggttgtacagtcttagctgtttaagtttccatggcatgcctctctctgtatgttatctaaatatctatgagttcaacacatgagtgttgttgtatgtatgatagaaatgcttctcgtattttaatgttactatgttcataaatctagaagatt

SEQ ID NO: 744 - DNA, 780 bp, Arabidopsis lyrata
atcaatggcgaattcagagtcctcacaagtaaacgaagaagaagagaacaaccagagaatctcaactctccatcaccaaacgatgccttccgagttaactcaagacgaattcacctcactctcccaatcaatcgccgagttccacacataccaactcggtcacggccgttgctcatctctcttagctcagcgaatccacgcgccgccggaaacagtctggtccgtcgtgagaagattcgatcgaccacagatttacaaacacttcatcaaaagctgtttcgtgaaggaaggtttcgagatgcgagtgggatgcacgcgcgacgtgaacgtgataagtggacttccggcgaatacatcgagagagagattagatctgttggacgatgatcggagagtgactgggtttagtatcaccggtggtgaacataggctgaggaattataaatcggtgacgacggttcatagatttgagaaagaagatcggatctggaccgttgttttggaatcgtacgttgttgatgtaccggaaggtaattcggaggaagatacgagattgtttgctgatacggttattagattgaatcttcagaaacttgcttcgatcactgaagctatgaatcggaacaacaacaacgccggtgacggaggaagaaactcttcttcttctcaggtgaagtaaaattgggggatttttaattttattttgatttgtaatatgttttttttttttttcttgaattgtaatttcctcgtttgatttatggttatgttttttttttt

SEQ ID NO: 745 - DNA, 1465 bp, Arabidopsis lyrata
atgtcgtcgtcggcggtcgagtctgtggctgagcagcggatacgcagcaacgatggtgacggcgccggagagaaaatagagaacggcgagcttcatcacttgctttccgaaccgtcggctccgacgatttatctccctacggaatctttcctcagagcagcgacgttactcaagaaccaggttgtggaggccatgtggaaaggcgttgtcgacgttcttgcccctggttcgagtccggtgctggatccgactgtgtacacaggactactcggcacagcgttcacctgcttgaagtcgtacgaggtcacgaggaaccatcaagatctgctaacttgcgctgagataatcgacacgtgtgccaacgttgcgcgtgccacaaccaggcacgtgacgtttttatgtggaagaggaggagtttatacgcttggtgcaatcgtagccaattacagaggggaccaatcaaagcgtgacttcttcctcggtctttttcttgagcttgcagaagcgagagagttaccagcaggaccagaggaaggaggatttgggatgtcatatgaccttctctatggaagagcgggtttcctttgggctgctttgttcctgaaccgatatctcggccaaggcactgttcctgaccatctcttatcacccattgttgcggccatcttagccggtggacgagttggagctgcagatcatgaagcttgtcctctgctatacaggtttcacgggacgcgattttggggtgcggctaatggattagctggaatcttgtatgtattgctgcattttccactatcggaagaggatgtgaaggatgttcaagggacattgaggtacatgatgagtaataggtttccgaacagtggaaactacccgtgcagcgaagggaatccgagagataagctggtccaatgggctcatggagctactggtatggccattactttggctaaagcatctcaggtgtttcccaaggaaagggatttccgcgaagcagccattgaagcaggagaagtagtgtggaagagtggcttggtgaagaaggtaggtttagctgatggagttgctggtaacgcctatgccttcttatcgctttatcggttaactggagatgttttatacgaagagagagcaaaagcgtttgcgagttacttgtgccatgatgcaagagatctcatgaatatgacaaggcaagaagcagaacatgattattcgcttttccgtggactagctggaccagtatgtctctggttcgatcttgtgtcgccggtagattctaggtttcctggttatgagatataattattaccgggtaagttagataaactgttgcttcgattatgaatatctttgtgaaaggatcttaggttctccagtttattatattccactttctataatctattgaattagctttgagatttgggagaaacattcatacaaaacaagaaacaaagtaaca

SEQ ID NO: 746 - DNA, 1366 bp, Eutrema halophilum
agaaagagagagagagagagagatatatgtcgtcgtcggcggtggagtttgtgggggagcaacggagatgcggcgacgatgataacggcggagagacagtagagaacggcgcgcttgaccattttcttctacgaacctcctctgaaccaacggctccgacaatttctctctcgacggaaacttttcttagagcagcaacgttactgaaggacaaggttgtggaggccacgtggaaaggcggtgttccgggtccgagtcttgtgttggatccgactgtatacacaggcttactcggcacagctttcacttgcttgaagtcgtacgaggtcacgaggaaccgtcaggatctgctaacttgcgccgagataatcgaaacgtgtgcaaacgttgcacgtgccacaaccaggcacgtgacgtttttatgtggaagaggaggagtttatgcacttggtgcaatcgtagccaattacagaggggaccagtcaaagcgtgacctcttcctcgctctgtttcttgagctagcagaagagagagagttaccagcaggaccagaggaaggaggatttgggatgtcatatgaccttctctacggaagagcgggtttcctttgggctgctttgttcctaaaccgatatctcggtgaaggcactgttcctgaccatctcttatcacccattatcgcagccatcttatccggtggacgagctggagccgcagatcatcaagcttgccctctgttatacaggtttcacgggacgcgattttggggtgcggctaatggattggctggaatcttgcacgtcttgttacattttcctttatcggaagatgatgtggaagatgtgcaagggacgttgaggtacatgatgagtaataggtttccgaacagcggaaattacccgtgcagcgaagggaatccgagagataagctggtccaatgggctcacggagctacaggcatggccattactttggctaaagcatctcaggtgtttccaaaggaaggggattttcgcgaagcagccattgaagcaggagaagtcgtgtggaagagtggcttggtgaagaaggtaggtttagctgatggagttgccggtaatgcctacgctttcttatcgctttatcggttaactggagatgttgtatacgaagagagagcaaaagcgttcgcgagttacttgtgttgtgatgccagagatctcgtgaatgcgacaatggaagaagcggaacatgattattcgcttttccgtggacttgctggaccagtatgtctctggtttgatcttgtgtctcctgtagattctaaatttcctggttatgagatataattcgattccaggtagtttaaatggatatctttgtgaaa

SEQ ID NO: 747 - DNA, 1769 bp, Eutrema parvulum
taccgtttgtatttctctttcttaaagatatcaagatcgagagtcagagagctatgtcgtcgtcggcggtagagtttgtggcggagcaacggagatgcggtgaagatggtaacggcggagagacagtagagaacggcgagcttgatcatttgcttctacgaaccacctctgaaccaacggctccgacaaaatttctctctacggagacttttcttagagcagcaacgttactcaaggaccaggttgtggaggcgacgtggaaaggcggtgttccggatccgggtctggtgttggatccaactgtgtacacaggcctactcggcacagctttcacttgcttgaagtcgtacgaggtcacgaggaaccatcgggatctgctaacttgcgccgagataatcgacacgtgtgccaacgttgcacgcgccacaaccaggcacgtgacgtttttatgtggaagaggaggagtttatgcgcttggtgcagtcgtagctaattacagaggggaccaatcaaagcttgacttcttccttggtctttttcttgagcttgcagaagagagagagttaccagcaggaccagaggaaggaggatttgggatgtcatatgaccttctctatggaagagcgggtttcctttgggctgctttgttcctaaaccgatacctcggtgaaggcactgttcctgatcttctcttgttgcccattgtcgcagccatcttatccggtggacgtgttggagcggcagatcatgaagcttgccctttgttatacaggcaaataagtgactagtttcacgggacgcgattttggggtgccgcgaatggattagccggaatcttggacgtcttgttacattttccattaccggaagaggatgtgaaggctgtgcaagggacattgaggtacatggtgagtaataggtttccaaacagcggaaattacccttgcagcgaagggaatccgagagataagctggtccaatgggctcatggagcaaccgggatggccattactttggctaaagcatctcaggtatttccaaaggaaagggattttcgcgaagcagctattgaagcaggagaagtagtgtggaaaagtggcttggtgaaaaaggtaggtttagcagatggagttgccggaaacgcctacgctttcttatcgctataccggttaacaggagatgttgtatacgaagatagagcaaaagcgtttgcgagttacttgtgtcgtgatgcaagagatctcgtgaatgcgacaagggaagaaccaggacatgattattcgcttttccggggactagctggaccagcatgtctctggttcgatcttgtgtcgccggtagattctaagtttcctggttctgagatataaattcaatgccagttagtttagataaaccgttgtttctgttatgaatatctttcagagatatcatcaaccaaacagttcgtatctttttaagtgaatacaatggtggcaataatacaatcattgttcaaacgatgttgatagtatccgtaagacaacggagaatgcaaccaagaccagctctctctgtcagtttctcatgaatcttcaaacactgatcgcatgtgggtcggtccccagtagaaaggcctctgtacaagggcttacttcatgagaatgtcgtaatactcgacatcaagagcattcagcattccgtcaatatccttaatcgccattagagctctgtgcacaactatccaattagccgactgcaatttcacgggttgaaagaaaccattttta

SEQ ID NO: 748 - DNA, 1803 bp, Brassica napus
ctatgttatcgtcggcggtagagttctcagcggagcaagcgagatgcggcgaagatggtaacagcggagagacaaacaagaacggcgatcttgatcattttattctacgaacatcctccgaaccaaaagttccgacgacaagttttctctctacggatactttccttagagcagcaacgttactcaaggaccaggttgtggaggctacgtggaaaggcggtccggatccgggtctggtgttagatccgactgtgtacacaggactactcggcacagctttcacttgcttgaagtcgtacgaggtcacgaggaaccatcaagatctgctaacttgcgccgatataatcgacacgtgtgccgacgttgcacgcgccacaaccaggcacgtgacgtttttatgtggaagaggaggagtatatgcgcttggtgcaatcgtagccagttacagtggggaccaatcaaagcttgacctctttctcggtctttttcttgagctagcagaagaaagagagttaccagcaggaccagaggaaggaggatttggaatgtcatatgaccttctctatggaagagcgggttttctttgggctgctttgttcctaaaccgatacctcggtgaaggcactgttcctgatcatctcttatcgcctattgtcgcagccatcttatctggtggacgagttggcgcagcagatcaccaagcttgccctttgttatacaggttccacgggacacggttttggggtgcggcgaatggattagctggaatcttgcacgtcttgttacacttcccattatcagaagaggatgtgaaggatgtgcaagggacgttgaggtacatgatgagcaataggtttccaaacagcggaaactatccgtgcagcgaagggaatccgagagataagctggtccagtgggctcatggtgcaaccggcatggccattactctggctaaagcatcacaggtgtttccaaaggagagggattttcgtgaagcagctattgaagctggagaagtagtgtggaagagtggcttggtgaagaaggtaggtttagcggatggagttgctggcaacgcctatgctttcttgtcgctttataggttaacaggagatgttgtgtacgaagagagagcaaaagcgttcgcgagttacttgtgtcatgacgcgagagagcttgtgagtgcgacaatgggagaagcagaacatgactactcgctgttccggggactagctggaccggcatgtctctggttcgatcttgtgtcgccggtagattctaagtttcctggttatgagatataattcaatgtcaggtctagtttaagataaactgttggttcagttgtcgaaactgcatcttcaatgaatgtatgatcaaaacaaaaactcatgtctttttaaagtaatacaatggtggtaataatacaatgatcaaacggtattgatagtatcagtaagacaacggagaatgcaaccgagaccagctctctcagtgagtttctcgtgaatcttcaaacactgatcgcatgtaggtcggtccccagtggaaaggcctctgtacaagtacttcatgagaatgtcgtaatactcgacatcaagagcattcagcattccttcaatatcctttatcgccattaaagctctgtgcacaactatccaattagccgacttgcaacgctcatcgagagttttaggaggtgaaccttcaagagccgtttttagagcttcaacgggtttgtactgtttgagtaagctttcgatcttgctcgatttggtttcgatcctagcgatgattgcctct

SEQ ID NO: 749 - DNA, 2049 bp, Brassica rapa
aaaacattatacatatattaaggtagcgttcgtactttctcattctaaagataccaagataaagagtgagagagagagagagagagagagagctatgttatcgtcggcgttagagttctcagcggagcaagcgagatgcggcgaagatggtaacggcggagagacaaacaagaacggcgatcttgatcattttattctacgaacatcctccgaaccaaaagttccgacgacaagttttctctcaacggatactttccttagagcagcaacgttactcaaggaccaggttgtggaggctacgtggaaaggcggtccggatccgggtctggtgttagatccgactgtgtacacaggactactcggcacagctttcacttgcttgaagtcgtacgaggtcacgaggaaccatcaagatctgctaacttgcgccgatataatcgacacgtgtgccgacgttgcacgcgccacaaccaggcacgtgacgtttttatgtggaagaggaggagtatatgcgcttggtgcaatcgtagccagttacagtggggaccaatcaaagcttgacctctttctcggtctttttcttgagctagcagaagaaagagagttaccagcaggaccagaggaaggaggatttggaatgtcatatgaccttctctatggaagagcgggttttctttgggctgctttgttcctaaaccgatacctcggtgaaggcactgttcctgatcatctcttatcgcctattgtcgcagccatcttatctggtggacgagttggcgcagcagatcatcaagcttgccctttgttatacaggttccacgggacacggttttggggtgcggcgaatggattagctggaatcttgcacgtcttgttacacttcccattatcagaagaggatgtgaaggatgtgcaagggacgttgaggtacatgatgagcaataggtttccaaacagcggaaactatccgtgcagcgaagggaatccgagagataagctggtccagtgggctcatggtgcaaccggcatggccattactctggctaaagcatcacaggtgtttccaaaggagagggattttcgtgaagcagcaattgaagctggagaagtagtgtggaagagtggcttggtgaagaaggtaggtttagcggatggagttgctggcaacgcctatgctttcttgtcgctttataggttaacaggagatgttgtgtacgaagagagagcaaaagcgttcgcgagttacttgtgtcatgacgcgagagagcttgtgagtgcgacaatgggagaagcagaatatgactactcgctgttccggggactagctggaccggcatgcctctggttcgatcttgtgtcgccggtagattctaagtttcctggttatgagatataattcaatgtcaggtctagtttaagataaactgttggttcagttatcgaaagtgcatcttcaatgaatgtatgatcaaaacaaaaactcatgtctttttaaagtaatacaatggtggtaataatacaatgatcaaacggtattgatagtatcagtaagacaacggagaatgcaaccgagaccagctctctcagtgagtttctcgtgaatcttcaaacactgatcgcatgtaggtcggtccccagtggaaaggcctctgtacaagtacctgttccacaccattcaagcaaacataaagattaacacttactcttcaagagctaagctaaattgtaacattccctcaatggacagagatcgcaataacaaaacctaaccatattatacaacacgaccaactctttattttcatacaaacaaagattgcattgacacaaaacctaaaccatgttatataaatttttgctctagcctttatctatctccaatgaaattcagacaagaaataagaggcaaggggggatttacttcatgagaatgtcgtaatactcgacatcaagagcattcagcattccttcaatatcctttatcgccattaaagctctgtgcacaactatccaattagccgactgcaaattgaaagcaaccatttatta

SEQ ID NO: 750 - DNA, 1705 bp, Brassica juncea
ttatatattaaggtagcgttcgtacttctcattctgaaagataccaagataaaagagtgagagagagagctatgttatcgtcggcggtagagttttcggcggagcaagcgagatgcggcgacgatggtaacggcggagagacaagcaagaagggcgatcttgatcattttcttctgcgaacctcctccgaaccaaaggctccgacgacaagtcttctctctacggatactttccttagagcagcaacgttactcaaggaccaggttgtggaggctacgtggaaaggcggtgttccggatccggatctggtgttggatccgactgtgtacacaggactactcggcacagctttcacttgcctgaagtcgtacgaggccacgaggaaccatcaagatctgctaacttgcgccgatataatcgacacgtgtgccgacgttgcacgcgccacaaccaggcacgtgacgtttttatgtggaagaggaggagtgtacgcgcttggtgcaatcgtagccaattaccgaggggaccaatcaaagcttgacctctttctcggtctttttcttgagatagcagaagaaagagagttaccagcaggtccagaggaaggaggattcggtatgtcatatgaccttctctatggaagagcaggtttcctttgggctgcattgttcctaaacagatacctcggtgaaggcactgttcctgatcatctcttatcgcctatagtcgaagccatcttatcaggtggacgagttggagcagcagatcaccaagcttgccctttattatacagattccacgggacacggttttggggtgcggcgaatggattagctggaatcttgcacgtcttgttacacttcccattatcagaagaaaatgtgaaggatgtgcaagggacgttgaggtacatgatgagcaataggtttccaaacagcggaaactatccgtgtagtgaagggaatccgagagacaagctggtccaatggtctcatggtgcgaccggcatggctatcactttggctaaagcgtctcaggtgtttccaaaggagagggattttcgtgaagccgctattgaagctggagaagtagtgtggaagagtggcttggtgaagaaggtcggtttagccgatggagttgctggtaacgcctatgctttcttgtcactttaccggttgacaggagatgctgtgtacgaagagagagcaaaagcgtttgcgggttacttatgtcgtgatgcaagagatctggcgacaaggggagaagcagaacatgactactcgctcttcaggggactagctggaccagcatgtctttggttcgatctagcgtcgccggtagattctaagtttcctggctatgagatataattccataccaggtctagattaagacatcagttatcgaagtgcatcttcaatgaatgtatcatcaaccaacaactactcatgtcttttttaaagtaatgcaatggtggcaataatacaatgatcaaacggtgttgatagtatcagtaagacaacggagaatgcaaccgagaccagctctctcagtgagtttctcgtgaatcttcaaacactgatcgcatgtaggtcggtccccagtggaaaggcctctgtacaagtacttcatgagaatgtcgtaatactcgacatcaagagcattcagcattccttcaatatcctttatcgccattaaagctctg

SEQ ID NO: 751 - DNA, 1955 bp, Raphanus sativus
  misc_feature (13)..(14): n is a, c, g, or t
  misc_feature (529)..(529): n is a, c, g, or t
  misc_feature (586)..(586): n is a, c, g, or t
  misc_feature (1517)..(1517): n is a, c, g, or t
  misc_feature (1538)..(1538): n is a, c, g, or t
  misc_feature (1565)..(1565): n is a, c, g, or t
  misc_feature (1864)..(1864): n is a, c, g, or t
ggaaagataccannatacagagtgagagagaaagatagatatgatatcgtcggcggtagagttttccgcggagcaagcgagatgcggcgacgatggtgacggcggagagacgaacaagaacggcgatcgtgatcattttattatacgaacctcctccgaaccaaaagctcagacgacaagttttctctcaactgatactttccttagagcagcaacgttactcaaggaccaggttgtggaggccacgtggaaacgcggtgctccggatccgagtctagtgttggatccgaccgtgtacacagggctactcggcaccgctttcacttgcttgaagtcgtacgaggtcacgaggaaccatcaagatctgctaacttgcgcagatataatcgacacgtgtgccgacgttgcacgcgccacaaccaggcacgtgacgtttttatgtggaagaggaggagtgtatgcgcttggtgcaatcgtagccagttacagaggggaccaatcaaaacttgacctctttctcggtcttttnctggagctagcagaagaaagagagttaccagcaggaccagaggaaggaggatttggnatgtcatatgaccttctatatggaagagcgggtttcctttgggctgctctgtttctaaacagatacctcggtgaaggcactgttcccgaccatctcttatcgcctattgtcgcagccatcttatcaggtggacgagtcggagctgcagatcaccaagcttgccctttattatacaggttccacgggacacggttttggggtgcggcgaatggattagctggaatcttgcacgtcttgttacacttcccattatcagaagaggatgtgaaggatgtgcaagggacgttgaggtacatgatgagtaataggttcccaaacagcggaaactatccttgcaacgaagggaatccgagagacaagctagtccaatgggctcacggtgcgaccggcatggccattactctggctaaagcgtcacaggtgtttccagaggagagggattttcgtgaagcagccatcgaagctggagaagtagtgtggaagagtgggttggtgaagaaggtaggtttagctgatggagttgctggcaacgcctatgcttgcttgtcgctctacaggttaacaggagatgtagtgtacgaagagagagcaaaagcgttcgcgagttacttgtgtcgtgatgggagagagcttgtgagtgcgacaatgggagaagcggagcatgactattctctcttcaggggactagctggaccggcatgtctctggttcgatctagcgtcgccggcagattctaagtttcctggttatgagatttaaatttaagataaaccgttgttctttctctccgtggttattgaaagtgaatcttcaatgaatgtattatcatcaaacaaaaaaaaactcatgtcttttttaaagtaatacaatggtggcaataatacaatgataaggatcaaacggtgttgatagtatcagtaaggcaacgganaatgcaaccgagaccagctcnctcagtgagtttctcgtgaatcttcanacactgatcgcatgtaggtctgtccccagtggaaagccctctgtataagtacttcatgagaatgtcgtaatactcaacatcaagggcattaagcatcccctcaatatccttaatcgccattaaagctctgtgcacaactatccaattagccgacttgcaacgctcatcgagagttttaggaggagaaccttcaagagccgttttcagagcttctactggtttatactgtttgagtaagctttcaatcttggtcgatttggtttcgatccttgcgatgattgcctctgcctccacaaatncacctcctcctcccgccattcgatctctccctctctctctccccagcagattgatctggagggaatcaatcaaagcgaatcaatcaagccc

SEQ ID NO: 752 - DNA, 1093 bp, Brassica rapa
tactcgccacaaaagattgttggaaacatttatgcagacttaaaatttgttattaaaatatggtatatcctctttttcatgagtggttgacaactcttggacttatagcctttttcacattggtgtcttgtcttattccctcttctcttctttcgctttgctccacaaaaaaaaagagaggaaaacattactacttagtttgaggcagaagaaggagagaagaatctaagtgtaacgaatctttagctggtgaagatcagttaaaattttctgtgttgatcctgaagatgacagcaatagtaggagtatcatttggagctaccagctctcgtatctctatagtcaccccaactctttcatcctcttctttgtttccaccactaacattgcatcagtcaggtaataaaaaggaaagtcagttgcgctgtgccgtgcaagagtcttccacttcggctgttgctactgagaagaaagaaaaagaagactcaacagttgaagttccagcaaagaaaccaaaaccggcagctgcgaaggcagccgtggcaaaaccgctgagagaaatgatggaagaagacgtgattcctcccctaaaagccattcttgaagctcaagatgatatctctgagattgatttatctttccaagacgataagctcgaggggtttttctttaagaaaggtattcaatattccttctgggccttcttccccagtgggaacctcacaggtgcaaagggcttttcaatctcctcgtacggatcaggtccaagcactgtggagccgtttctagtggacgagaggaaaccaactgcaaaccacgttgtgttttgggtggagaagcgccttgctgcacaagggattattcccgtttggaaccaataatgtaaccgagatgttgttttttttattcacttgtttataagaaaacaattacatttgtataccaaaactgaagaaaaccaaagtccttcgtatctctcaatatgtatttattaagaaacactcttcgtttaagctaatccattttccctagagattattctcttccttgccttctcagcctaaaaattatagattccaattactttaaagca

SEQ ID NO: 753 - DNA, 748 bp, Brassica rapa
  misc_feature (6)..(6): n is a, c, g, or t
acaaanaaaaaaaaagagaggaaaacattactacttagtttgaggcagaagaaggagagaagaatctaagtgtaacgaatctttagctggtgaagatcagttaaaattttctgtgttgatcctgaagatgacagcaatagtaggagtatcatttggagctaccagctctcgtatctctatagtcaccccaactctttcatcctcttctttgtttccaccactaacattgcatcagtcaggtaataaaaaggaaagtcagttgcgctgtgccgtgcaagagtcttccacttcggctgttgctactgagaagaaagaaaaagaagactcaacagttgaagttccagcaaagaaaccaaaaccggcagctgcgaaggcagccgtggcaaaaccgctgagagaaatgatggaagaagacgtgattcctcccctaaaagccattcttgaagctcaagatgatatctctgagattgatttatctttccaagacgataagctcgaggggtttttctttaagaaaggtattcaatattccttctgggccttcttccccagtgggaacctcacaggtgcaaagggcttttcaatctcctcgtacggatcaggtccaagcactgtggagccgtttctagtggacgagaggaaaccaactgcaaaccacgttgtgttttgggtggagaagcgccttgctgcacaagggattattcccgtttggaaccaataatgtaaccgagatgttgttttttttatt

SEQ ID NO: 754 - DNA, 1480 bp, Brassica oleracea
gcgtccgggctttttgagctactcatactctcctcaggactactcccaaacccgaaacttgagacctctgttctttcaatatgtcttacaacagaaacattgcactatgtaatttcaaatggagttgccgcggctgtgagcacacgcgtggcaaacaatttgggagctgggagtccccaagttgctagggtatcaatattggcagggctttgcctctggctgatagagtcagtttttttcagtacacttctcttcacatgccggaacatcataggctacgcattcagcaacagcaaagaagtcgtggactatgtcgcggatatatctcctttgctctgtatttccttcatcctagatgggttcactgcagtgcttaatggtgtagctaggggaagtgggtggcaacacattggagcatggaacaatgtggtgtcttattatctggtaggagctccggttggactttacttagctttcagtcatgggtttaatggaaaaggattgtggtgcggtgttgtggttggatccgctgttcaagcgactattctggctatcgtcacaacttccatggattggaaaaaacaggctgaaaaggcaaggaagagaataatctctagggaaaatggattagcttaaacgaagagtgtttcttaattaatacatattgagagatacaaaggactttgattttcttcagttttggtatacaaatgtaattgttttcttataaacaagtgaatgaaaaaaacacaacatctcggttacattattggttccaaacgggaataatcccttgtgcagcaaggcgcttctccacccaaaacacaacgtggtttgcagttggtttcctctcgtccactagaaacggctccacagtgcttggacctgatccgtacgaggagattgaaaatccctttgcacctgcgaggttcccactggggaagaaggcccagaaggaatattgaatacctttcttaaagaaaaacccctcgagcttatcgtcttggaaagataaatcaatctcagagatatcatcttgagcttcaagaatggcttttaggggaggaatcacgtcttcttccatcatttctctcagcggttttgccacggctgccttcgcagctgccggttttggtttctttgctggaacttcaactgttgagtcttctttttctttcttctcagtagcaacagcagaagtggaagactcttgcacggcagcgcaactgactttcctttttattacctgactgatgcaatgttagtggtggaaacaaagaagaggatgaaagagttggggtgactatagagatacgagagctggtagctccaaatgatactcctactattgctgtcatcttcaggatcaacacaggaaattttaactgatcttcaccagctaaagattcgttacacttagattcttctctccttcttctgcctcaaactaagtagtaatgttttcctctctttttttttc

SEQ ID NO: 755 - DNA, 943 bp, Brassica napus
aaaaaaaaaaaagaagaggaaaacatgactacttagtctgaggcagaagaaggagagaagaatctaagtgtaacgaatctttagctggtgaagatcagttaaatttttctgtgttgatcctgaagatgacagcaatagtaggagtatcatttggagctaccagctctcatatctctatagtcaccccaactctttcatcctcttctttgtttccaccactaacattgcatcagtcaggtaataaaaggaaagtcagttgcgctgtgccgtgcaagagtcttccacttctgctgttgctactgagaagaaagaaaaagaagactcaacagttgaagttccagcaaagaaaccaaaaccggcagctgcgaaggcagccgtggcaaaaccgctgagagaaatgatggaagaagacgtgattcctcccctaaaagccattcttgaagctcaagatgatatctctgagattgatttatctttccatgacgataagctcgaggggtttttctttaagaaaggtattcaatattccttctgggccttcttccccagtgggaacctcacaggtgcaaagggcttttcaatctcctcgtacggatcaggtccaagcactgtggagccgtttctagtcgacgagaggaacccaactgcaaaccacgttgtgttttgggtggagaagcgccttgctgcacaagggattattcccgtttggaaccaataatgtaaccgagatgttgttttttttattcacttgtttataagaaaacaattacatttgtataccaaaactgaagaaaatcaaagtccttcgtatctctcaatatgtattaattaagaaacactcttcgtttaagctaatccattttccctagagattattctcttccttgccttctcagcctgttttttccaatccatggaagttgtgacgatagccagaatagtc

SEQ ID NO: 756 - DNA, 952 bp, Eutrema halophilum
tgtggttggcaactcttaggctctgcctttttcacatttgtcttatttccacttcttttctttcgctttgctccactaaaatttttttttaaagttttagtttgaggatgaagaagatggagagaatctaagagtcgagagtaacaaatcttgtaacagtttttgtttatttcctgaagatggcagcaatggctggaggaacatttggagtcaccaactctcgtatctctataaccacaccaactctttcttcctcttctctgtttccaccattaacattgccaccaggtaacaaaaaggataaccagttgcgttgtgccgtgcaagaatcttctacttctgctgttgctaccgagaagaaagacaaagaagaaaaagactcaacagtggaggttccggcaaagaaaccgaaacccgcagctgcgaaagcagcagtggtgaaaccgctaagagagatgatggatgaagacgtaattcctccattaaaagcaattcttgaagctcaagatgatatctctgaccttgaattatctttccaagacgataagctggagggttatttcttgaagaaaggtattcaatattccttctgggccttcttccccactggaaacctcacaggagcaaaggggttttcaatttcctcatacgggtcaggtccaagcacagtagagccatttctggtcgatgagaggaaaccaactgcgaaccacgttgtgttctgggtcgagaagcgcctcgctgcacaagggattattccggtttggaaccaatgatgttaagaatctcacatcggaaatgagtcggaaccttgaatgatacctaagaaatttggactgatcatccactcatgaggttttcttattcatttgtttataataaaacaattacatttgtataccaaaattaaagaaaagcccttcatttatgctaatctattttcacttgagac

SEQ ID NO: 757 - DNA, 1444 bp, Thellungiella halophila
tgtggttggcaactcttaggctctgcctttttcacatttgtcttatttccacttcttttctttcgctttgctccactaaaatttttttttaaagttttagtttgaggatgaagaagatggagagaatctaagagtcgagagtaacaaatcttgtaacagtttttgtttatttcctgaagatggcagcaatggctggaggaacatttggagtcaccaactctcgtatctctataaccacaccaactctttcttcctcttctctgtttccaccattaacattgccaccaggtaacaaaaaggataaccagttgcgttgtgccgtgcaagaatcttctacttctgctgttgctaccgagaagaaagacaaagaagaaaaagactcaacagtggaggttccggcaaagaaaccgaaacccgcagctgcgaaagcagcagtggtgaaaccgctaagagagatgatggatgaagacgtaattcctccattaaaagcaattcttgaagctcaagatgatatctctgaccttgaattatctttccaagacgataagctggagggttatttcttgaagaaaggtattcaatattccttctgggccttcttccccactggaaacctcacaggagcaaaggggttttcaatttcctcatacgggtcaggtccaagcacagtagagccatttctggtcgatgagaggaaaccaactgcgaaccacgttgtgttctgggtcgagaagcgcctcgctgcacaagggattattccggtttggaaccaatgatgttaagaatctcacatcggaaatgagtcggaaccttgaatgatacctaagaaatttggactgatcatccactcatgaggttttcttattcatttgtttataataaaacaattacatttgtataccaaaattaaagaaaagcccttcatttatgctaatctattttcacttgagactattctcttcctcgccttctcagcctgttctttccaattcatagaacctgtgacaatagctagtatagtggcttggacagcggatccaaccacaacaccgcaccatagtccttttccgttgaatccccaactgaaagctaagtaaactccaaccggagctccaacgagataataagccaccacgttgttccaagctccaatgtgttgccaaccacttcccctagcaacaccattgaggactgcagtaaatccgtcgaggataaaagaaagacagagcaaaggagataggtccgcgacatagtccacaacttctttgctgttgttgaatgcgtagcctattatgttcctgcaggtgaagagaagtgtgctaaagcaaatagactctatcagccagagacaaagccgtgccattactgataacctagcgacttgaagattctcagctcccaggttgtttgacacgcgtgtgctcacagccgccgcgactccatt

SEQ ID NO: 758 - DNA, 884 bp, Arabidopsis lyrata
gtggttggcgactcttaggctcagccttttgcaaatttgcctctcgtcttatttcctcttcttttcctttgctttgggccactagtctttcgcttgagggagagatggagaaaaactgagaatttgagaataacgaaacttgttatcgttgaagaaactcaattacagtttcggtttcttcctgaatatggcagcaatagcaggaggatcatttggagtcccaagctctcgtatctctatagccactccaactctctcttcctcttctttgcttccaccactaacattgcaatcagttactagaaaggataaccttttgcggtgtgccgtgcaagagtcttccacttctgctgtcactactgagaagaaagataaagaagacaaaaatgagtcaacagtggcggttccggcaaagaaacctaaacccgcagctgcggtggcgaaaccgctgagacaaatgatggaagaagacgtgattcctccgttaaaagccattcttgaatctcaagacgatatctctgagatcgatttatcttaccaagacgataagttggaaggttttttcttgaagaaaagtattccatattccttttgggccttcttccctactggaaaccttacaggagcaaaaggattttcaatatcctcacacgggtcaggtccgagcaccgtggagccgtttctcgttgacgagaggaaaccaaccgcaaaccacgttgtgttttgggtcgagaagcgcctcgctgcgcaagggatcattcccgtttggaaccaatgatgtttttattcacttgtaattattacatttgtataccaactaaaaattgaagaaaacataaaaatccttgtctcaaaaatggattaagaaacacatggccctcttt

SEQ ID NO: 759 - DNA, 1195 bp, Brassica rapa
cacgtggcggcttctccatcctcctgcaatctcagcacaagataaaccttctattctccaccctcgatctttcctcatcaacaaatctccaccgtccgttttataattccccaaaaccttaccttcttcttctcctctcgtcttcgagacaccacaaatcgccctccctctctctttctctgcaatggcgtctcttcagcaaaccatgctctctctgcagtccaaacttcctccatcatctttccacatcgggggatctcttcccatgcgaaagacagccttaccgctccgaaccagaggcggaaacgccgcgggagcgagaatgtcagccacggcggcgggaagctacgcgatggctctcgcggacgtggcgaagaggaacgacacactcgaactgacgagcgcagacgtcgagaagctcgagaaggtcttctccgatccgcaggtgctcaacttcttcgcgaatccaaccgtcgagctcgagaagaagcgtctcgtgatcgacgagatcgtgaaatcgtccgctctccagagccacacctccaacttcctcaacatccttgtcgacgcgaatcgtatcaacatagtgagggacatcgtgaaggagttcgagatggtgtacaacaagataacggacacgcagctggcggaggttagatcggtggtgaagctggagccgccgcagcttgctcagatcgccaaacaggttcagaagctgaccggggcgaagaacgtgagggtgaagacggtgcttgatccgagcctcgtcgctgggtttacgattaggtacggtgattctgggtcgaagcttattgatatgagtgtgaagaagcagcttgaggatatcgctgctcagctagaactcggcgagattcagttagctgcatgagaaaattgtattgacaaccgcttcttttttacttgtgcaagttaattctttctctcttcttttctccatcaatcatctacatataatatacttatatataaataattctcgagttattttcaattatttctgaaatgtagtgaaactgtgtgttcgactcatgatgaatcatgattacaatgttccagcttagactgacgaacaaacatcattaattattattagatgtaatcgtaccaaaaaccatataattaagagcacgaatttagagaaataccaaaaaactgtaaaagatagttttctggt

SEQ ID NO: 760 - DNA, 911 bp, Brassica rapa
cgccctccctctctctttctctgcaatggcgtctcttcagcaaaccatgctctctctgcagtccaaacttcctccatcatctttccacatcgggggatctcttcccatgcgaaagacagccttaccgctccgaaccagaggcggaaacgccgcgggagcgagaatgtcagccacggcggcgggaagctacgcgatggctctcgcggacgtggcgaagaggaacgacacactcgaactgacgagcgcagacgtcgagaagctcgagaaggtcttctccgatccgcaggtgctcaacttcttcgcgaatccaaccgtcgagctcgagaagaagcgtctcgtgatcgacgagatcgtgaaatcgtccgctctccagagccacacctccaacttcctcaacatccttgtcgacgcgaatcgtatcaacatagtgagggacatcgtgaaggagttcgagatggtgtacaacaagataacggacacgcagctggcggaggttagatcggtggtgaagctggagccgccgcagcttgctcagatcgccaaacaggttcagaagctgaccggggcgaagaacgtgagggtgaagacggtgcttgatccgagcctcgtcgctgggtttacgattaggtacggtgattctgggtcgaagcttattgatatgagtgtgaagaagcagcttgaggatatcgctgctcagctagaactcggcgagattcagttagctgcatgagaaaattgtattgacaaccgcttcttttttacttgtgcaagttaattctttctctcttcttttctccatcaatcatctacatataatatacttatatataaataattctcgagttattttcaattatttctgaaatgtagtgaaactgtgtgttcgactcatgatgaatcatgattacaat

SEQ ID NO: 761 - DNA, 1111 bp, Brassica juncea
gggtcttcgagacaccacaaatcgccctccctctctctctctctcctcctctgcaatggcgtctcttcagcaaactatgctctctctgcagtccaaacttcctccatcatccttccacatcgggggatctcttcccatgcgaaagacagccttaccgctccgaaccagaggcggaaacgccgcgggagcgagaatgtcagccacggcggcgggaagctacgcgatggctctcgcggacgtggcgaagaggaacgacacactcgaactgacgagcgcagacgtcgagaagctcgagaaggtcttctccgatccacaggtgctcaacttcttcgcgaatccgaccgtcgaggtcgagaagaagcgtctcgtgatcgacgagatcgtgaaatcgtcgtctctccagagccacacgtccaatttcctcaacatcctggtcgacgcgaatcggatcaacatcgtgacggacatcgtgaaggagttcgagatggtgtacaacaagataacggacacgcagctggcggaggtcaggtcggtggtgaaactggagccgccgcagctcgctcagatcgcgaagcaggttcagaagctaaccggggcgaagaacgtgagggttaagacgattcttgatccgagtcttgttgctgggtttacgatccggtacggtgattccgggtcgaagcttattgatatgagtgtgaagaagcagcttgaggatattgcggctcagctagaactcggggagattcagttagctgcttgaaaaacttgtattgagaatcccttcttccttttttttttcttctgagcaagttaattctttccctcttctttctctatcaatcatcaacataatatatactggtaataaataattctctcgagttatttttcaattaagttctggaatgtagtgaatcatgattgcaatgttctagctttagaccgacgagtaaacatcgttaattattatatatgtgaaatcaacaatccagagagatagattaagcaaacaaaacttgagaagatggaatgtatttcagtgtaaatcaagatccattagcagttttctcattctctagcacacccatgaggaaacgagttttgtttaatc

SEQ ID NO: 762 - DNA, 860 bp, Brassica oleracea
  misc_feature (35)..(39): n is a, c, g, or t
  misc_feature (789)..(790): n is a, c, g, or t
accttagcttcttcttctcctctcgtcttcgagannnnnaaatcgctctctctctctctctctctctctttctctgcaatggcgtctcttcagcaaactatgctctctctgcagtccaaacttcctccatcatctttccacatcgggggatctcttcctatgcgaaagacagccttaccacttcgaatcagaggcggaaacgcggcgggagcgagaatgtcagccacggcggcgggaagctacgcgatggctctcgcggacgtcgcgaagaggaacgatactctcgaattgacgagcgcagacgtcgagaagctcgagaaggtcttctccgatccgcaggtgctcaacttcttcgcgaatccaaccgtcgagctcgagaagaagcgtctcgtgatcgacgagatcgtgaaatcgtcctctctccagagccacacctccaatttcctcaacatcctggtcgacgcgaatcgtatcaacatagtgaccgacatcgtgaaggagttcgagattgtgtacaacaagataacggacacgcagttggccgaggttagatcggtggtgaagctggagccgccgcagcttgctcagatcgccaaacaggttcagaagctgaccggggcgaagaacgtgagggtgaagacggttcttgatccgagccttgtcgctgggtttacgattaggtacggtgattctgggtcgaagcttattgatatgagtgtgaagaagcagcttgaggatatcgctgctcagctagaactcggcgagattcagttagctgcatgagaaaanngtattattgacaacagcttctttttacttgtgcaagttaattctttctctcttctgttctccatcaatca

SEQ ID NO: 763 - DNA, 929 bp, Brassica napus
gcaatggtgtctcttcagcaaactatgctctctctgcagtccaaacttcctccatcatctttccacatcgggggatctcttcctatgcgaaagacagccttaccacttcgaatcagaggcggaaacgcggcgggagcgagaatgtcagccacggcggcgggaagctacgcgatggctctcgcggacgtcgcgaagaggaacgatactctcgaattgacgagcgcagacgtcgagaagctcgagaaggtcttctccgatccgcaggtgctcaacttcttcgcgaatccaaccgtcgagctcgagaagaagcgtctcgtgatcgacgagatcgtgaaatcgtcctctctccagagccacacctccaatttcctcaacatcctggtcgacgcgaatcgtatcaacatagtgaccgacatcgtgaaggagttcgagattgtgtacaacaagataacggacacgcagttggccgaggttagatcggtggtgaagctggagccgccgcagcttgctcagatcgccaaacaggttcagaagctgaccggggcgaagaacgtgagggtgaagacggttcttgatccgagccttgtcgctgggtttacgattaggtacggtgattctgggtcgaagcttattgatatgagtgtgaagaagcagcttgaggatatcgctgctcagctagaactcggcgagattcagttagctgcatgagaaaattgtattattgacaacagcttctttttacttgtgcaagttaattctttctctcttcttttctccatcaatcatctccatataatatacttatataaataattctcgagttattttcaattatttctgaaatgtagtgaaactgtgtgttcgactcatgaatcatgattacaatgttccagcttagactgacgaacaacatcattattactatcaaa

SEQ ID NO: 764 - DNA, 1075 bp, Brassica juncea
caaccaaataatccataatcaagatgaactacgattctgtctgtaaaagaagttaaagatcatgtcgtacaatttaacttaagaagcaagataaatacttaggggctctctcttctctctctctctctctgcaatggcgtctcttcagcaaactatgttctctctgcagtccaaacttcctccctcatcttttcacatcggaggatctctccctatgcgaaagacaaccttaccactccgaatcagaggcggaaacgccgcaggagcgagaatgtcagccacggcggcaggaagctacgcgatggctctcgcggacgtcgcgaagaggaacgatactctcgagctgacgagcgcggacgtcgagaagctcgagaaggtcttctccgatccacaggtgctcaacttcttcgcgaatccgaccgtcgaggtcgagaagaagcgtctcgtgatcgacgagatcgtgaaatcgtcgtctctccagagccacacgtccaatttcctcaacatcctggtcgacgcgaatcggatcaacatcgtgacggacatcgtgaaggagttcgagatggtgtacaacaagataacggacacgcagctggcggaggttagatcggtggtgaagctggagccgccgcagcttgctcagatcgccaaacaggttcagaagctgaccggggcgaagaacgtgagggtgaagacggtgcttgatccgagccttgtcgctgggtttacgattaggtacggtgactctgggtcgaagcttattgatatgagtgtgaagaagcagcttgaggatatcgctgctcagctagaactcggcgagattcagttagctgcatgagaaaattgtattgacaaccgcttctttttttacttgtgcaagttaattctttctctcttcttttctccatcataatatacttatatataaataattctcgagttattttcaattatttctgaaatgtagtgaaactgtgtgttcgactcatgatgaatcatgattaccatgttccagcttagactgacgaacaaacatcattaattattattagatgtaatcgtaccaaaaaccata

SEQ ID NO: 765 - DNA, 837 bp, Brassica juncea
ggaattgaagcactcgattatgtacttaaagagcttcgcgttcaaagacgctcatgatcaatgtaacgctttctctctctcgctctctggctctctctctctgcaatggcgtctcttcagcaaacaatgttctctctgcagtccaaacttcctccatcatcttttcacatcggaggatctcttcctatgcgaaagacaaccttgcccctccgaattagaggcggaaacgccgccggagcgagaatgtcagccacggcagcaggaagctacgcgatggctctcgcggatgtcgcgaagaggaacgatacactcgaactgacgagcgcggacgtcgagaagctcgagaaggtcttctccgatccactggtgctcaacttcttcgcgaatccaaccgtggagctcgagaagaagcgtctcgtgatcgacgagatagtgaaatcatcctctctccagagccacacctccaacttcctcaacatcttggtcgatgcgaatcgtatcaacatagtgacggacatcgtgaaggagttcgagatggtgtacaacaagataacggatacgcaattggcggaggttagatcggtggtgaaactggagccgccgcagctcgctcagatcgcgaaacaggttcagaagctaaccggagcgaagaacgtgagggttaagacggttcttgatccgagtcttgttgctgggtttacgattcggtacggtgattctgggtcgaagcttattgatatgagtgtgaagaagcagcttgaggatatcgctgctcagctagaactcggcgagattcagttagctgcttgaagaaaatgtattgagaactgtttcttc

SEQ ID NO: 766 - DNA, 859 bp, Brassica juncea
gctctctcttctctctctctctctctgcaatggcgtctcttcagcaaactatgttctctctgcagtccaaacttcctccctcatcttttcacatcggaggatctctccctatgcgaaagacaaccttaccactccgaatcagaggcggaaacgccgcaggagcgagaatgtcagccacggcggcaggaagctacgcgatggctctcgcggacgtcgcgaagaggaacgatactctcgagctgacgagcgcggacgtcgagaagctcgagaaggtcttctccgatccacaggtgctcaacttcttcgcgaatccgaccgtcgaggtcgagaagaagcgtctcgtgatcgacgagatcgtgaaatcgtcgtctctccagagccacacgtccaatttcctcaacatcctggtcgacgcgaatcggatcaacatcgtgacggacatcgtgaaggagttcgagatggtgtacaacaagataacggacacgcagctggcggaggtcaggtcggtggtgaaactggagccgccgcagctcgctcagatcgcgaagcaggttcagaagctaaccggggcgaagaacgtgagggttaagacgattcttgatccgagtcttgttgctgggtttacgatccggtacggtgattccgggtcgaagcttattgatatgagtgtgaagaagcagcttgaggatattgcggctcagctagaactcggggagattcagttagctgcttgaaaaacttgtattgagaatcccttcttcctttttttttttcttctgagcaagttaattctttccctcttctttctctatcaatcatcaacataatatatactggtaataaataattctctcgagtt

SEQ ID NO: 767 - DNA, 917 bp, Brassica juncea
ggaattgaagcactcgattatgtacttaaagagcttcgcgttcaaagacgctcatgatcaatgtaacgctttctctctctcgctctctggctctctctctgtgcaatggcgtctcttcagcaaacaatgttctctctgcagtccaaacttcctccatcatcttttcacatcggaggatctcttcctatgcgaaagacaaccttgcccctccgaattagaggcggaaacgccgccggagcgagaatgtcagccacggcagcaggaagctacgcgatggctctcgcggatgtcgcgaagaggaacgatacactcgaactgacgagcgcggacgtcgagaagctcgagaaggtcttctccgatccactggtgctcaacttcttcgcgaatccaaccgtggagctcgagaagaagcgtctcgtgatcgacgagatagtgaaatcatcctctctccagagccacacctccaacttcctcaacatcttggtcgatgcgaatcgtatcaacatagtgacggacatcgtgaaggagttcgagatggtgtacaacaagataacggatacgcaattggcggaggttagatcggtggtgaaactggagccgccgcagctcgctcagatcgcgaaacaggttcagaagctaaccggagcgaagaacgtgagggttaagacgattcttgatccgagtcttgttgctgggtttacgatccggtacggtgattccgggtcgaagcttattgatatgagtgtgaagaagcagcttgaggatatcgctgctcagctagaactcggcgagattcagttagctgcttgaaaaaattgtattgagtatcgctttttgttgtgcaagttaatacagtatgtatacggttataataattaataataatttcaggtgatattcaaaaaaaaaaaaaaaaa

SEQ ID NO: 768 - DNA, 965 bp, Brassica napus
ctctctctgcagtccaaacttcgtccatcatctttccacatcgggggatctcttcccatgcgaaagacagccttaccactccgaaccagaggcggaaacgccgcgggagcgagaatgtcagccacggcggcgggaagctacgcgatggctctcgcggacgtggccaagaggaacgacacactcgaactgacgagcgcagacgtcgagaagctcgagaaggtcttctccgatccgcaggtgctcaacttcttcgcgaatccaaccgtcgagctcgagaagaagcgtctcgtgatcgacgagatcgtgaaatcgtccgctctccagagccacacctccaacttcctcaacatcctggtcgacgcgaatcgtatcaacatagtgagggacatcgtgaaggagttcgagatggtgtacaacaagataacggacacgcagctggcggaggttagatcggtggtgaagctggagccgccgcagcttgctcagatcgccaaacaggttcagaagctgaccggggcgaagaacgtgagggtgaagacggtgcttgatccgagcctcgtcgctgggtttacaattaggtacggtgactctgggtcgaagcttattgatatgagtgtgaagaagcagcttgaggatatcgctgctcagctagaactcggcgagattcagttagctgcatgagaaaattgtattgacaaccgcttcttttttacttgtgcaagttaattctttctctcttcttttctccatcaatcatctacatataataatatacttatatataaataattctggagttattttcaattatttctgaaatgtagtgaaactgtgtgttcgactcatgatgaatcatgattacaatcgagccgagttatcctctagttctagcgcgacacagacacaccacggtggacctccggcgggtgttgcctcacggagcgaggttatggctgattttccca

SEQ ID NO: 769 - DNA, 880 bp, Brassica rapa
tctcttctctcctctctctctatctctaccctctggaatggcgtctcttcagcaaaccatgttatctctgcaatcgaaacttccaccatcttcctttcaaatcgcgaaatctcttcctattcgaagaacaaacttaccactccgcatcggtgggggaaacgcggcgggaacgagaatgtcagctacagcagccggaagttacgctatggctctcgcagatgttgcgaagaggaacgatactcttgaactaacgagtgcagacgtagaaaagctagagaaggtattctcagatccacaggtactcaatttcttcgccaatcccaccgtcgaggtcgagaagaagcgtctcgtgatcgacgagatcgtgaaatcttcgtctctccagagccacacctcgaatttcctcaacatcttggtcgatgcgaatcggatcaacatagtgagggacatcgtgaaggagttcgagatggtgtacaacaagataactgatacgcaattggctgaggttagatcggtggtgaaactggagccgccgcaacttgctcagatcgccaaacaggttcagaagttaaccggagccaagaacgtgagggttaagacgattcttgatcccagccttgtcgctgggttcacgattcggtatggcgattccgggtcgaagcttattgatatgagtgtgaagaagcagcttgaggatatcgctgctcagctagaactcggcgagattcagttagctgcttgaaaacaattgcattgagaatcgctttttgttgtgcaacttaatattctttctctcttcttgttctttttctccatcgatcatcaacatgatgtgtatacagttataatagttataataatttcaggtttttttcaatta

SEQ ID NO: 770 - DNA, 902 bp, Brassica napus
acatacgtccatgcacgcgtactaagcttgtcatctctagagtcgacccacgcgtccgctctatctctaccctctggaatggcgtctcttcagcaaaccatgttatctctgcaatcgaaacttccaccatcttcctttcaaatcgcgaaatctcttcctattcgaagaacaaacttaccactccgaatcggtgggggaaacgcggcgggagcgagaatgtcagctacagcagccggaagttacgctatggctctcgcagatgttgcgaagaggaacgatactcttgaacttacgagtgcagacgtagaaaagctagagaaggtcttctcagatccacaggtcctcaatttcttcgccaatcccaccgtcgaggtcgagaagaagcgtctcgtgatcgacgagatcgtgaaatcttcgtctctccagagccacacctcgaatttcctcaacatcttggtcgatgcgaatcggatcaacatagtgagggacatcgtgaaggagttcgagatggtgtacaacaagataactgatacgcaattggctgaggttagatcggtggtgaaactggagccgccgcaacttgctcagatcgccaaacaggttcagaagttaaccggagccaagaacgtgagggttaagacgattcttgatcccacccttgtcgctgggttcacgattcggtatggcgattccgggtcgaagcttattgatatgagtgtgaagaagcagcttgaggatatcgctgctcagctagaactcggcgagattcagttagctgcttgaaaacaattgcattgagaatcgctttttgttgtgcaacttaattctttctctcttcttgttctttttctccatcgatcatgaacatgatgtgtatacagttataatagttataataattt

SEQ ID NO: 771 - DNA, 1094 bp, Brassica juncea
cttgattcttttactcattacggaacacagatatcctacttatcatataagtccacgtggcgactcctctgttctcttgtaatccttctgaaacctcaacacaagataaaccttctagtgtctaccctcgatctttcctcatcaagaaatctccaccgtctgtttcttattccctaaatcttaccttcttcttctctcctctcgtctttgagaaactgcaaatcactcccttctctcctctctctacccctctggaatggcgtctcttcagcaaaccatgttttctctgcaatcgaaacttccaccatcttcctttcaaatcgccaaatctcttcctattcgaagaacaaccttaccgctccgaatcggcggtggaaacgcgacgggagcgagaatgtcagctacagcagccggaagttacgctatggctctcgctgacgttgcgaagaggaacgatactctcgaattaacgagtgcagacgtggaaaagctagagaaagtattctcagatccacaggtactcaacttcttcgccaatccaaccgtcgagctcgagaagaagcgtctcgtgatcgacgagatcgtgaaatcgtcgtctctccagagccacacctcgaatttcctcaacatcttggtcgatgcgaatcggatcaacatagtgacggacatcgtgaaggagttcgagatggtgtacaacaagataactgatacgcaattggctgaggttagatcggtggtgaaactggagccgccgcaacttgctcagatcgccaaacaggttcagaagttaaccggagcgaagaacgtgagggttaagacgattcttgatcccagccttgtcgctgggttcacgattcggtatggcgattccgggtcgaagcttattgatatgagtgtgaagaagcagcttgaggatatcgctgctcagctagaactcggcgagattcagttagctgcttgaaaaaattgtattgagtatcgctttttgttgtgcaacttaattctttctctcttcttgttcttttttctccatcgatcatgaacatgatatgtatacagttataacagttataattctttctctcttcttgttc

SEQ ID NO: 772 - DNA, 870 bp, Triticum aestivum
ctcctctctctctatctctaccctctggaatggcgtctcttcagcaaaccatgttatctctgcaatcgaaacttccaccatcttcctttcaaatcgcgaaatctcttcctattcgaagaacaaacttaccactccgaatcggtgggggaaacgcggcgggagcgagaatgtcagctacagcagccggaagttacgctatggctctcgcagatgttgcgaagaggaacgatactcttgaattaacgagtgcagacgtagaaaagctagagaaggtattctcagatccacaggtactcaatttcttcgccaatcccaccgtcgaggtcgagaagaagcgtctcgtgatcgacgagatcgtgaaatcttcgtctctccagagccacacctcgaatttcctcaacatcttggtcgatgcgaatcggatcaacatagtgacggacatcgtgaaggagttcgagatggtgtacaacaagataactgatacgcaattggcggaggttagatcggtggtgaaactggagccgccgcaacttgctcagatcgccaaacaggttcagaagttaaccggagcgaagaacatgagggttaagacgattcttgatccgagccttgtcgctgggttcacgattcggtatggcgattccgggtcgaagcttattgatatgagtgtgaagaagcagcttgaggatatcgctgctcagctagaactcggcgagattcagttagctgcttgaaaacaattgcattgagaatcgctttttgttgtgcaacttaattctttgtctcttcttgttctttttctccatcgatcatcaacatgatatgtatacagttataatagttataataatttcaggctattttcaactg

SEQ ID NO: 773 - DNA, 851 bp, Brassica juncea
tcccttctctcctctctctacccctctggaatggcgtctcttcagcaaaccatgttttctctgcaatcgaaacttccaccatcttcctttcaaatcgccaaatctcttcctattcgaagaacaaccttaccgctccgaatcggcggtggaaacgcgacgggagcgagaatgtcagctacagcagccggaagttacgctatggctctcgctgacgttgcgaagaggaacgatactctcgaattaacgagtgcagacgtggaaaagctagagaaagtattctcagatccacaggtactcaacttcttcgccaatccaaccgtcgagctcgagaagaagcgtctcgtgatcgacgagatcgtgaaatcgtcgtctctccagagccacacctcgaatttcctcaacatcttggtcgatgcgaatcggatcaacatagtgacggacatcgtgaaggagttcgagatggtgtacaacaagataacggatacgcaattggctgaggttagatcggtggtgaaactggagccgccgcaacttgctcagatagcgaaacaggttcagaagttaaccggagcgaagaacgtgagggttaagacgattcttgatccgagccttgtcgctgggttcaccattcggtatggtgattccgggtcgaagcttattgatatgagtgtgaagaagcagcttgaggatatcgctgctcagctagaactcggcgagattcagttagctgcttgaaaacaattgcattgagaatcgctttttgttgtgcaacttaatattctttctctcttcttgttcttttttctccatcgatcatcaacatgatgtgtatacagttataatagttataa

SEQ ID NO: 774 - DNA, 875 bp, Brassica juncea
aaatcactctcttctctcctctctctctatctctaccctctggaatggcgtctcttcagcaaaccatgttatctctgcaatcgaaacttccaccatcttcctttcaaatcgcgaaatctcttcctattcgaagaacaaacttaccactccgaatcggtgggggaaacgcggcgggagcgagaatgtcagctacagcagccggaagttacgctatggctctcgcagatgttgcgaagaggaacgatactcttgaacttacgagtgcagacgtagaaaagctagagaaggtcttctcagatccacaggtcctcaatttcttcgccaatcccaccgtcgaggtcgagaagaagcgtctcgtgatcgacgatatcgtgaaatcttcgtctctccagagccacacctcgaattttctcaacatcttggtcgatgcgaatcggatcaacatagtgagggacatcgtgaaggagttcgagatggtgtacaacaagataactgatacgcaattggctgaggttagatcggtggtgaaactggagccgccgcaacttgctcagatcgccaaacaggttcagaagttaaccggagccaagaacgtgagggttaagacgattcttgatcccacccttgtcgctgggttcacgattcggtatggcgattccgggtcgaagcttattgatatgagtgtgaagaagcagcttgaggatatcgctgctcagctagaactcggcgagattcagttagctgcttgaaaacaattgcattgagaatcgctttttgttgtgcaacttaattctttctctcttcttgttcttttttctccatcgatcatgaacatgatatgtatacagttataacagttataataatttcaggtt

SEQ ID NO: 775 - DNA, 1319 bp, Brassica rapa
gaaaaactgactatgaactcttaaactattgtcgacatgctcttatttctcaaaagtttatacgtgtatcattttacttgattcgactgatatcctacttatcatataagtccacgtggcgactcctctgttctcttgtaatccttctgaaacctcaacacaagataatccttctattctctaccctcgatctttcctcaacaagaaatctccaccgtccgtttgttattcccaaaatcttaccttcttcttctcctctctcgtcttttgagaaactgcaaatcactctcttctctcctctctctctatctctaccctctggaatggcgtctcttcagcaaaccatgttatctctgcaatcgaaacttccaccatcttcctttcaaatcgcgaaatctcttcctattcgaagaacaaacttaccactccgcatcggtgggggaaacgcggcgggaacgagaatgtcagctacagcagccggaagttacgctatggctctcgcagatgttgcgaagaggaacgatactcttgaactaacgagtgcagacgtagaaaagctagagaaggtattctcagatccacaggtactcaatttcttcgccaatcccaccgtcgaggtcgagaagaagcgtctcgtgatcgacgagatcgtgaaatcttcgtctctccagagccacacctcgaatttcctcaacatcttggtcgatgcgaatcggatcaacatagtgagggacatcgtgaaggagttcgagatggtgtacaacaagataactgatacgcaattggctgaggttagatcggtggtgaaactggagccgccgcaacttgctcagatcgccaaacaggttcagaagttaaccggagccaagaacgtgagggttaagacgattcttgatcccagccttgtcgctgggttcacgattcggtatggcgattccgggtcgaagcttatttatatgagtgtgaagaagcagcttgaggatatagctactcagctagaactcggcgagattcagttagctgcttgaaaacaattgcattgagaatcgctttttgttgtgcaacttaatattctttctctcttcttgttctttttctccatcgatcatcaacatgatgtgtatacagttataatagttataataatttcaggtttttttcaattagttctgtaggttctaaggtgaaattcactttcgagttcgtactgtccactgaaacaatgttctagtttaaggttggttaaggagcaagctacatagagttgtgagctttttgaaagtgttaaagctaatctagtacatgaactataacgcaag

SEQ ID NO: 776 - DNA, 858 bp, Raphanus sativus
  misc_feature (110)..(110): n is a, c, g, or t
  misc_feature (117)..(117): n is a, c, g, or t
  misc_feature (171)..(171): n is a, c, g, or t
  misc_feature (321)..(321): n is a, c, g, or t
  misc_feature (561)..(561): n is a, c, g, or t
  misc_feature (654)..(654): n is a, c, g, or t
  misc_feature (768)..(769): n is a, c, g, or t
  misc_feature (779)..(779): n is a, c, g, or t
gagaaaccacaaatcgctctctcttctctctctctctctgcaatggcgtctcttcagcaaactatgttctctctgcagtccaaactccctccctcatctttccacatcgnaggatcnctccctatgcgaaagacatccttacccctccgaatcagaggcggaaacgccgcnggagcgagaatgtccgccactgctgcaggaagctacgcgatggctctcgcggacgtcgcgaagaggaacgacactctcgaactcacgagcgccgacgtcgagaagctcgagaacgtcttctcagacccgcaggtgctcaacttcttcgcnaacccaaccgtcgaggtcgagaagaagcgcctcgtgatcgacgagatcgtcaaagcgtcctccctccagacccacacctccaacttcctcaacctcctggtcgacgcgaaccgggtcgacatcgtgacggacatcgtgaaggagttcgagattgtatacaacaagataacggacacgcagctggcggaggttaggtcggtggtgaagctggagccgccgcagctcgctcagatcgcgaancaggttcagaagctgaccggagccaagaacgtgagggttaagacggttcttgatccgagtcttgtcgctgggtttacgattcggtatggtgantccgggtcgaagcttattgatatgagtgtgaagaagcagcttgaggatatcgctgctcagctagagctcggtgagattcagttagctgcatgaagaaaattgtattgacaaccnncttcttcttntttttttacttgtgcaagtttaattctttctctcttttttcctccatcaatcgtctacatataatatatactgatataa

SEQ ID NO: 777 - DNA, 916 bp, Raphanus sativus
  misc_feature (18)..(19): n is a, c, g, or t
  misc_feature (42)..(42): n is a, c, g, or t
  misc_feature (54)..(54): n is a, c, g, or t
  misc_feature (103)..(103): n is a, c, g, or t
  misc_feature (645)..(645): n is a, c, g, or t
  misc_feature (706)..(706): n is a, c, g, or t
tctcttctctctctctcnncaatggcgtctcttcagcaaacnatgttctctctncagtccaaactccctccctcatctttccacatcggaggatctctccctntgcgaaagacagccttacccctccgaatcagaggcggaaacgccgcaggagcaagaatgtccgccactgctgcaggaagctacgcgatggctctcgcagacgtcgcgaagagggacgacactctcgagctgacgagcgccgacgtggagaagctcgaaaacgtcttctcggaccctcaggtgctcaacttcttcgccaacccaaccgtcgaggtcgagaagaagcgtctcgtgatcgacgagatcgtcaaagcgtcctctctccagatccacacctccaacttcctcaacctcctggtcgacgcgaaccgggtcgacatcgtgacggacatcgtgaaggagttcgagattgtgtacaacaagataacggacacgcagctggcggaggttaggtcggtggtgaagctggagccgccgcagctcgctcagatcgcgaagcaggttcagaagctgaccggagcgaagaacgtgagggttaagacggttcttgatccgagtcttgtcgccgggtttacgattcggtatggtgactccgggtcgaancttattgatatgagtgtgaagaagcagcttgaggatatcgctgctcagcttgagctcggtnagattcagttagctgcatgaagaaaaattgtattgacaactggcttcttcttttttacttgtgcaagtttaattctttctctcttttttcctccatcaatcgtctacatataatatatactgatataaataattctctgagttgtttccaattatttctgaaatgtagtgaacctgtttgttcgattcatgaatcgtgattacaatactc

SEQ ID NO: 778 - DNA, 965 bp, Raphanus sativus
  misc_feature (405)..(405): n is a, c, g, or t
  misc_feature (670)..(670): n is a, c, g, or t
ggctcgtcttcgagaaaccacaaatcgccctctcttctcttctctctctgcaatggcgtctcttcagcaaaccatgttctctctgcagtccaaattccctccctcatctttccacatcggaggttctctccctatccgaaagaagacaaccttacccctccgaatcagaggcggaaacgccgcaggcgcaagaatgtccgccactgctgcaggaagctacgcgatggctctcgcggacgtcgcgaagaggaacgacactctcgagctcacgagcgcggacgtcgagaagctcgagaaggtcttctcggacccgcaggtgctcaacttcttcgtgaacccaaccgtcgaggtcgagaagaagcgtctcgtgatcgacgagatcgtcaaagcgtcctccctccaganccacacctccaacttcctcaacctcctggtcgacgcgaaccgggtcgacatcgtgacggacatcgtgaaggagttcgagattgtatacaacaagataacggacacgcagctggcggaggttaggtcggtggtgaagctggagccgccgcagctcgctcagatcgcgaagcaggttcagaagctgaccggggcgaagaacgtgagggttaagacggttcttgatccgagtcttgtcgctgggtttacgattcggtatggtgactcngggtcgaagcttattgatatgagtgtgaagaagcagcttgaggatatcgctgctcagctagagctcggtgagattcagttagctgcatgaagaaaaattgtattgacaactcgcttcttctttttttacttgtgcaagtttaattctttctctctcttttttcctccatcaatcgtctacatatataatatactgatataaataattctcgagttgttttcaattatttctgaaatgtagtgaacctgtgtgttcgattcatgaatcatgattacaatgctccagcttagaccga

SEQ ID NO: 779 - DNA, 1118 bp, Eutrema halophilum
cgcagataattcacctatcatataaccccacgtggcggctccttcttcctcctctaaccacagcctaatctttctgaaacctcaacacaagataaaccttcaattctctaccgtcgatctttacgcatcaaaacatctccaccgtccgtttcttattcccaaaaaccttaccttcttctgctcctctctcgtcttcgagaaaccacaaatctctctctctctctctctttctctccctctctactctctgcaatggcgtctctccagcaaactctattctctcttcaatccaaactcccaccttcctcctttcaaatcgcgagatctctccctatgcgaaagacgaccttaccactccgaatcggcggcggaaacgcagcgggagcgagaatgtcagccacggcggccggaagctacgcgatggctctcgcagacgtcgcgaaaaggaacgacacactcgaattgacgagcgcagacgtcgagaagctcgagaaggtattctcagatccacaggtgctcaatttcttcgcgaacccaaccgtcgaggtcgagaagaagcgtctcgtgatcgacgaaatcgtgaaatcgtcttctctccagagccacacgtcgaatttcctcaacgttttgatcgacgcgaaccggatcagcatagtgacggagatcgtcaaggagttcgagatggtgtacaacaagatcacggatacgcaattggcggaggttagatcggtggtgaaacttgagccgccgcagcttgctcagatcgcgaaacaggttcagaagctgaccggagcgaagaacgttagggttaaaacggttattgacccgagtcttgtggctgggtttacgattcggtatggtgattctgggtcgaagcttattgatatgagtgtgaagaagcagcttgaggatatcgctgctcagcttgaactcggtgagattcaattagctacttgaaggaacaaaaaattgtattgagaatcactttttttttttggttcaatgttaattctttctctcttcttcctctatcaatcatcaacatatactgatatataataattcggcgttatcttcaattatttatgtgagaacttttgtgtaagtcatgattatgt

SEQ ID NO: 780 - DNA, 1124 bp, Eutrema parvulum
ctttttactcattatcgaacacagatatcttacctatcatataactccacgtgtcgattcctccctcctcctgtaaccatagcctaatccttctggaacctcaacacaagataaaccttctattctctaccctcgatctttcctcctcaagaaatctccaccgtccgtttataattcccaaaaccttaccttcttcttctccattcgtcgtcgagaaaccgcaaatcgctatttctctctctctctctctcctctcctctcctctctctactctctgcaatggcgtctcttcagcaaactctattctctctgcaatccaaactcccaccatcctcctttcaaatcgcgagatctctccctatgcgaaagacgaccttaccactccgaatcggcggtggaaacgcggccggagcgagaatgtcagcgacggcggcgggaagctacgcgatggcactcgcggacgtcgcgaagaggaacgatacactcgagttgacgagcgcagacgtcgagaagctcgagatggttttctcagatccacaggttctcaatttcttcgctaacccaaccgtcgaggtagagaagaagcgtctcgtgatagacgacatcgtgaaatcatcgtctctccagagccacacctcgaatttcctcaacatcttggtcgatgcgaaccggatcaacatagtgacggagatcgtgaaggagtttgagattgtgtacaacaagataacggatacgcaattggcggaggttaaatcggtggtgaaacttgagccgccgcaacttgctcagatagcgaaacaggttcagaagttaaccggagcgaagaacgtgagggttaagacggtgattgatccgagtcttgtggctgggtttacgattcggtatggtgattctgggtcaaagcttattgatatgagtgtgaagaagcagcttgaagatatcgctgctcagctagagctcggcgagattcagttagctgcttgaaaaatttgtaataagaatctcttcttcttctttttgcaagttaattcttttctcttcttcttcttcttctttctccatcaatcatcaacataatatatactgatataataatcttcttcaatagttttgttcgagttaag

SEQ ID NO: 781 - DNA, 1024 bp, Eutrema parvulum
atccttctggaacctcaacacaagataaaccttctattctctaccctcgatctttcctcctcaagaaatctccaccgtccgtttataattcccaaaaccttaccttcttcttctccattcgtcgtcgagaaaccgcaaatcgctatttctctctctctctctctcctctcctctcctctctctactctctgcaatggcgtctcttcagcaaactctattctctctgcaatccaaactcccaccatcctcctttcaaatcgcgagatctctccctatgcgaaagacgaccttaccactccgaatcggcggtggaaacgcggccggagcgagaatgtcagcgacggcggcgggaagctacgcgatggcactcgcggacgtcgcgaagaggaacgatacactcgagttgacgagcgcagacgtcgagaagctcgagatggttttctcagatccacaggttctcaatttcttcgctaacccaaccgtcgaggtagagaagaagcgtctcgtgatagacgacatcgtgaaatcatcgtctctccagagccacacctcgaatttcctcaacatcttggtcgatgcgaaccggatcaacatagtgacggagatcgtgaaggagtttgagattgtgtacaacaagataacggatacgcaattggcggaggttaaatcggtggtgaaacttgagccgccgcaacttgctcagatagcgaaacaggttcagaagttaaccggagcgaagaacgtgagggttaagacggtgattgatccgagtcttgtggctgggtttacgattcggtatggtgattctgggtcaaagcttattgatatgagtgtgaagaagcagcttgaagatatcgctgctcagctagagctcggcgagattcagttagctgcttgaaaaatttgtaataagaatctcttcttcttctttttgcaagttaattcttttctcttcttcttcttcttctttctccatcaatcatcaacataatatatactgatataataatcttcttcaatagtt

SEQ ID NO: 782 - DNA, 931 bp, Thellungiella halophila
gatcttcgagaaaccacaaatctctctctctctctctctttctctccctctctactctctgcaatggcgtctctccagcaaactctattctctcttcaatccaaactcccaccttcctcctttcaaatcgcgagatctctccctatgcgaaagacgaccttaccactccgaatcggcggcggaaacgcagcgggagcgagaatgtcagccacggcggccggaagctacgcgatggctctcgcagacgtcgcgaaaaggaacgacacactcgaattgacgagcgcagacgtcgagaagctcgagaaggtattctcagatccacaggtgctcaatttcttcgcgaacccaaccgtcgaggtcgagaagaagcgtctcgtgatcgacgaaatcgtgaaatcgtcttctctccagagccacacgtcgaatttcctcaacgttttgatcgacgcgaaccggatcagcatagtgacggagatcgtcaaggagttcgagatggtgtacaacaagatcacggatacgcaattggcggaggttagatcggtggtgaaacttgagccgccgcagcttgctcagatcgcgaaacaggttcagaagctgaccggagcgaagaacgttagggttaaaacggttattgacccgagtcttgtggctgggtttacgattcggtatggtgattctgggtcgaagcttattgatatgagtgtgaagaagcagcttgaggatatcgctgctcagcttgaactcggtgagattcaattagctacttgaaggaacaaaaaattgtattgagaatcactttttttttttggttcaatgttaattctttctctcttcttcctctatcaatcatcaacatatactgatatataataattcggcgttatcttcaattatttatgtgagaacttttgtgtaagtcatgattatgtcc

SEQ ID NO: 783 - DNA, 886 bp, Raphanus sativus
gggactgcaaatcactctcttctctcctctagaatggcgtctcttcagcaaaccatgttctctctgcaatcgaaacttccaccatcttcttttcaaatcgcgaaatctcttcctattcgaagaacaaccttaccactccgaatcagtggtggaaacgcggcgggagcgagaatgtcagctacagcagccggaagttacgcaatggctctcgcagacgttgcgaagaagaacgacactctcgaatcaacgagtgcagacatcgaaaagctagagaaggtattctcagatccacaggtactcaacttcttcgccaatccaaccgtcgagctcgagaagaagcgtctcgtgatcgacgagatcgtggaatcgtcgtctctccagagccaccacacctcgaatttcctcaacatcttggtggatgcgaatcggatcgacatagtgacggacatcgtgaaggagttcgagatggtgtacaacaagataacggatacgcagttagcggaggttaggtcggtggtgaaactggaggagccgcaacttgctcagatcgcgaaacaggttcggaagttaaccggagcgaagaacgtgagggttaagacggttcttgatccgagccttgtcgctgggttcacgattaggtatggtgattccgggtcgaagcttattgatatgagtgtgaagaagcagcttgaggatatcgctgctcagctagaactcggcgagattcagttagctgcttgagaaaaattgggttgagaatcgcctttttttgtgcaagttaattctttctctcttcttgttctttttgtccatcgatcataatgtaataattataataatttcaggttattttcaattaagtcggtaggttcaaagttaaggtcca

SEQ ID NO: 784 - DNA, 1027 bp, Arabidopsis lyrata
cacaatccaaaatctccaccgtccattctcatctcccccaaaaaccttaccttcttcatctcctcctcctctatcgtctccgagaaaccacaaatctctctctctctctctctttctctcaacaacaatggcgtctcttcaacaaactctattctctcttcaatcaaaactcccaccatcctccttccaaatcgccagatctctcccactccgaaaaaccttcccaatccgaatcaacaacggaaacgccgccggagcaagaatgtcagccaccgcagcatcaagctacgcgatggctttagcagacgtcgctaaaagaaacgacacaatggaattaacagtcgcagacatcgaaaaactcgatcaagtcttctcagatccacaagtactaaacttcttcgcgaatccaacgatcaccgtcgagaagaaacgtcaagtcatcgacgacatcgtgaaatcatcatctcttcaatctcatacctctaacttcctcaacgtcctcgtcgacgcgaatcggatcaatataatgacggagattgttaaagagtttgaattggtttacaataagctaacggatacacaattggcggaggttaggtcggtggtgaaattggaaccgccgcaattagctcagattgcgaaacaggttcagaagttaaccggagctaagaatgttcgggttaagacggttattgatccgagtcttgtggctggttttacgattcggtatggtgattccggttcgaagcttattgatatgagtgtgaagaagcagcttgaagatattgctcaacagcttgaacttggtgagattcaattagctacttgaattgggaattgtattaagagaaatttgagaatggttttttttttctgtgcaattttttttttttttcttcttcttcttctttctctattaatcaatcatataatatactgatgatgtaataataattctgagtttattatctttgtaattcgaaatcgggtaaaaatgcatcgaaatcgaatagattgtttacagttt

SEQ ID NO: 785 - DNA, 1058 bp, Arabidopsis thaliana
cacaatccaaaatctccaccgtccattctcatctcccccaaaaaaccttaccttcttcttcttcttcctctcctctatcgtcttcgagaaaccacaaatctctctttctctcaaactctctcaacaacaacaatggcgtctcttcaacaaactctattctctcttcaatccaaactcccaccatcctccttccaaatcgccagatctctcccactccgaaaaaccttcccaatccgaatcaacaacggtggaaacgccgccggagcaagaatgtcagccaccgcagcatcaagctacgcgatggcattagcagacgtcgcgaaaagaaacgacacaatggaattaacagtcacagacatcgagaagctcgaacaagtcttctcagatccacaagtactaaacttcttcgcgaatccaacaatcaccgtcgagaagaaacgtcaagtcatcgacgacatagtgaaatcgtcgtctcttcaatctcacacatctaacttcctcaacgtcctcgtcgacgcgaatcggatcaatatcgtgacggagatcgttaaggagtttgagttggtttacaataagctaacggatacacaattggcggaggttaggtcggtggtgaaattggaagcgccgcaattagctcagattgcgaaacaggttcagaagttaaccggagctaagaatgttcgggttaagacggttattgatgcgagtcttgtggctggttttacgattcggtatggtgaatccggttcgaagcttattgatatgagtgtgaagaaacagcttgaagatattgcttctcagcttgaacttggtgagattcaattagctacttgagatttgggaaaaattgtataagagaaaaatttgagaatcttttttttttgtgcaagtttaattttttttctcctcatcttctttctctattaatcaatcatataatatacagtactgatgatataataatgattctgagtttattatctttgtaattgttaaatttagtgaattcgaaaacgaattcgaatagtatgtttgcggattatgcgttttgggga

SEQ ID NO: 786 - DNA, 954 bp, Cleome spinosa
cccgtcgtcgagaaaccgcattctctctctcccctccctctctccctctccgtctgcaatggcgtctctccaccaaacccttgtttctatgcaatccaagctccttccatcgtcagctcaaatatcgaggtctctcccacttcggatgaccttcccactccgaatcggacgccgcggtggcggtgccgccggagcaaggatgtccgcgacggcggcgggaagctacgcgacggctcttgccgacgtagcgaagtcgaacaatactctggacacgacgagtgccgacgtggagaagatcgagaaggtgttctcggaccagcaggtcgtcgacttcttcgcaaatccgacggtggacgttgagaaaaaacgccaggtcctcgacgagatcgtgaaatcgtcatcgctgcagcctcacacggcgaatttcctgaacatcctggtggacgcgaaccggatcgagattgtgaccgagatcgtgaaggagttcgaggcggtgtacaacacgctgacggacacagaactggcggtggtgagctcggtggtgaagctggagccgccgcagctggcgcagatagcgaagcaagtgcagaagctgacaggggcgaagaacgtgagggtcaagacggtgatcgacccggacctggtggctgggttcacgatccgatacgggaactcggggtcgaagcttatcgacatgagcgtgaagaagcagctggaggacatcgccgctcagctcgacctcggcgagattcagttagccacctgagtctgtgtataattcaaatccaaaactcgtttcccctttttgtgtgcaatcaaatctattcttttcggtagatttaatatatcaacatatatagcagtgttcgtggttgttcattgccagaactgaaccaattgatagaacgtaacttcccaaatgtgtggaagaacatgtttgcaaattgcgtgaat

SEQ ID NO: 787 - DNA, 1711 bp, Brassica rapa
caaaaactcaatggttgcgcatatacgcttcatcaacattacctatcctcctaaccgttcgattaaaatccaacggaccaaacaaaaccttatctctccagcttcagatcctgtacaaattcaaagacacaaacaagcaaaggaacatgcacagaagaagaagtgaaagagacaaatgaataagacgatgtacagagagacttcaccggccggagatcacaattgagtttattagtctcggagtacctcgacgaagcaacaatggagcttccgttgctctcttacacgaactcagcctcgttttctcggacaggcttatgctcttcgtcttcctcctcctcctcgactagtattaatgacttcttagagagaagaaggagcttgagaatgagattaaatggtggtgaaacgtcacgaagcgttaaaactttcgctggacgaagcagtgaagggatagagaaaacagacggcggcgtaggaggaggaggacagttcgccggtcctgccatggaggtcactacacttgatcgtggctttgctaactccaccactgttgatttcccgatttgggacaagatcggcgccgttgttagacttacttacgggatcggaatatatggagcaatggctgtagcaggaaggttcatatgttcagtgactgggattgactcatctggtgggtttgatccttctcttgatgcacttctctccggacttggctatgcaacaccacctatcatggctcttctcttcatactcgatgatgaagttgtgaaactttctccgcacgcaagggctattagagatgtggaagatgaggagctaagaagctttttcttcggaatgtctccatggcagtttatacttattgtcgtggccagttccgtaggagaagagctcttttaccgtgttgctgtacagggtgctctgtccgatatattcttgagaggaacacaactgatgacagattctagaggcatggcagctctgaccggcgtatttcctccgtttgtaccatttgctcaagcatttgcagctgtgatcaccgcaacactcacaggctctctctactttcttgctgcttctccaaaagacccgatatacattgttgccccggtcctaagatcacgccgcgatgattttaagaagcttttgtcagcttggtacgagaagagacagatgaagaagatttactctcctctccttgaaggactattagccctctacctcggtattgaatgggttcagacggataatattttagcaccgatgatgacgcatgggatatactcggcggtaatattagggaatggactgtggaaaattcacgatcaccgtagaagattacgtcagagaattgaacggattagatcggagagtggagaccagtgagcagcttttaaattatctatagattttaattggtgcgggtgggtggatgtgtgtgtatttttttggtatggggtcgtatagtaattagagaaattaggtaggacctattccataaaatttagacagatgttgcaatatacagtaggaaacttatatggtatactacataagtttgtatttatgaggttcaagaacaataaacttaagtctcttttactctctttggcccatatatatgttcgtttgaatagaaaaagcaagaaaccagatgtgagactgaagaacagaacaataattcgagcacttgaaagagttttaa

SEQ ID NO: 788 - DNA, 1533 bp, Brassica napus
acaaatgaataagacgatgtacagagagacttcaccggccggagatcacaattgagtttattagtctcggagtacctcgacgaagcaacaatggagcttccgttgctctcttacacgaactcagcctcgttttctcggacaggcttatgctcttcgtcttcctcctcctcctcgactagtattaatgacttcttagagagaagaaggagcttgagaatgagattaaatggtggtgaaacgtcacgaagcgttaaaactttcgctggacgaagcagtgaagggatagagaaaacagacggcggcgtaggaggaggaggacagttcgccggtcctgccatggaggtcactacacttgatcgtggctttgctaactccaccactgttgatttcccgatttgggacaagatcggcgccgttgttagacttacttacgggatcggaatatatggagcaatggctgtagcaggaaggttcatatgttcagtgactgggattgattcatctggtgggtttgatccttctcttgatgcacttctcgctggacttggatatgctacaccacctatcatggctcttctcttcatactcgatgatgaagttgtgaaactttctccgcacgcaagggctattagagatgtggaagatgaggaactaagaagctttttcttcggaatgtctccatggcagtttatacttattgtcgtggccagttcggtaggagaagagctcttgtaccgtgttgctgtacagggtgctctgtccgatatattcttgagaggaacacaactgatgacagattctagaggcatggcagctctgaccggcgtatttcctccgtttgtaccatttgctcaagcatttgcagctgtgatcaccgcaacactcacaggctctctctactttcttgctgcttctccaaaagacccgatatacattgttgccccggtcctaagatcacgccgcgatgattttaagaagcttttgtcagcttggtacgagaagagacagatgaagaagatttactctcctctccttgaaggactattagccctctacctcggtattgaatgggttcagacggataatattttagcaccgatgatgacgcatgggatatactcggcggtaatattagggaatggactctggaaaattcacgatcaccgtagaagattacgtcagagaattgaacggattagatcggagagtggagaccagtgagcagcttttaaattatctatagattttaattggtgcgggtgggtggatgtgtgtgtatttttttggtatggggtcgtatagtaattagagaaattaggtaggacctattccataaaatttagacagatgttgcaatatacagtaggaaacttatagatatatggtatactacataagtttgtatttatgaggttcaagaacataacttaagtctctttactctcaaaatacaaacttatgtagtataccatatatctataagtttgtatttatgaggttcaagaacaataaacttaagtctctttactctac

SEQ ID NO: 789 - DNA, 1445 bp, Brassica rapa
  misc_feature (758)..(758): n is a, c, g, or t
  misc_feature (807)..(807): n is a, c, g, or t
  misc_feature (1422)..(1422): n is a, c, g, or t
atgcacagaagaagaagtgaaagagacaaatgaataagacgatgtacagagagacttcaccggccggagatcacaattgagtttattagtctcggagtacctcgacgaagcaacaatggagcttccgttgctctcttacacgaactcagcctcgttttctcggacaggcttatgctcttcgtcttcctcctcctcctcgactagtattaatgacttcttagagagaagaaggagcttgagaatgagattaaatggtggtgaaacgtcacgaagcgttaaaactttcgctggacgaagcagtgaagggatagagaaaacagacggcggcgtaggaggaggaggacagttcgccggtcctgccatggaggtcactacacttgatcgtggctttgctaactccaccactgttgatttcccgatttgggacaagatcggcgccgttgttagacttacttacgggatcggaatatatggagcaatggctgtagcaggaaggttcatatgttcagtgactgggattgactcatctggtgggtttgatccttctcttgatgcacttctctccggacttggctatgcaacaccacctatcatggctcttctcttcatactcgatgatgaagttgtgaaactttctccgcacgcaagggctattagagatgtggaagatgaggagctaagaagctttttcttcggaatgtctccatggcagtttatacttattgtcgtggccagttccgtaggagaagagctctttnaccgtgttgctgtacagggtgctctgtccgatatattcttgagagaacncaactgatgacagattctagaggcatggcagctctgaccggcgtatttcctccgtttgtaccatttgctcaagcatttgcagctgtgatcaccgcaacactcacaggctctctctactttcttgctgcttctccaaaagacccgatatacattgttgccccggtcctaagatcacgccgcgatgattttaagaagcttttgtcagcttggtacgagaagagacagatgaagaagatttactctcctctccttgaaggactattagccctctacctcggtattgaatgggttcagacggataatattttagcaccgatgatgacgcatgggatatactcggcggtaatattagggaatggactgtggaaaattcacgatcaccgtagaagattacgtcagagaattgaacggattagatcggagagtggagaccagtgagcagcttttaaattatctatagattttaattggtgcgggtgggtggatgtgtgtgtatttttttggtatggggtcgtatagtaattagagaaattaggtaggacctattccataaaatttagacagatgttgcaatatacagtaggaaacttatatggtatactacataagtttgtntttatgaggttcaagaacaataa

SEQ ID NO: 790 - DNA, 1502 bp, Brassica napus
atgaagaagacgatgtgcaaagagacttcaccggccggagatcacaactgagcttcttagtctcggagtacctcgacgaagctgcaatggagcttccgttactctcttacacgaactcagcctcgttttctcggacaggcttatgctcttcttcttcctcctcctcctcctcaactagtattaatgaattcttagagagaagaaggaacttgagaatgatattcaatggtggtgaaacgtcaagaagcgttaaagcttccgctggacgaagcagcgaagggatcgagaaaacagacggtggaggagcaagacagttcgccggtcctgccatggaggtcactaaacttgatcgtggctttgctaactccaagactgttgatttcccgatctgggacaagatcggcgccgtggttagacttacttacggaatcggaatatatggagcaatggctgtagcaggaaggttcatatgttcagtgactgggattgactcatctggtgggtttgatccttctcttgatgcacttctcgccggacttggctatgctacaccacctatcatggctcttctcttcatactcgatgatgaagttgttaaactttcaccgcacgcaagggctattagagatgtggaagatgaggagctaagaagctttttcttcggaatgtctccatggcagtttatacttattgtcgtggccagttcggtaggagaagagctcttttaccgtgttgctgtacagggtgctctttctgatatgttcttgagagggacacaactgatgacagatcctagaggcatggcatctctgaccggagtctttcctccatttgtaccattttctcaagcatttgcagctgtgatcaccgcaacactcacaggctctctctactttcttgctgcttctccaaaagacccgatatacattgttgccccagtcctaagatcacgccgcgatgattttaagaagcttttgtcagcttggtacgagaagagacagatgaagaagatttactctcctctccttgaaggactcttagccctctacctcggtattgaatgggttcagacggataatattttagcaccgatgatgacgcatggtatatactcggcggtaatattagggaatggactgtggaaaattcacgatcaccgtagaagattacgtcagagaattgaacggattagatctgagagtggagaccagtgagctgcttttaaattatctatagattttaattggtgcgggtgggtgggtggatgtgtgtgtatttttcggtaaggggtcgtatagtatttagagaaattaggtaggacctcttccataaaatttagacagatgttgcaatatacagtagagaacttatagatatatggtatacataagtttgtatttactctctttggcccatatatgtttgtttgaatagaaaaagcaagaaaccagatgtgggagattcatgaacagaaacataatacgagcactaaaagaggttaa

SEQ ID NO: 791 - DNA, 1135 bp, Brassica juncea
atggagcttccattactctcttacaccaactcagcctcgttttcccggacaggcatatgctctacttcttcctcctcaactagtattaatggattcctggagagaagaaggtgcttgagaatgagattcaacggtggcgaaaatgcccgaagcgttaaagcttccgctggacgaagcagtgaagggatggagaagacagacagcagcggaggaggaggatttgccggtcctgtcatggaggttactacacttgatcgtggctttgctaactccaccaccgttgatttcccggtctgggacaaaatcggcgccgtcgttagacttacttacggaatcggaatatatggagcaatggctgtagcaggaagattgatatgttcagtgactgggattgactcatctggtggatttgatccttctcttgatgctcttctcgccggacttggctatgccacaccacctatcatggctcttctcttcattctcgatgatgaagttgtgaaactatcaccgcatgctcgagccatcagagacgtggaagatgaggaactaagaagctttttcttcggaatgtccccatggcagtttatactcattgtggcggccagttcgataggagaagagctcttttaccgtgttgctgtacagggggctctgtctgatatattcttgaaaggaacacaattgatgacagactctagaggcatggcatctttgaccggagtcttgcctccatttgttccatttgctcaagcatttgcagctgtgatcactgccactctcacaggctccctctactttcttgctgcttctccaaaagacccgacatacattgttgccccggttttaaggtcacgccgcgatgatttcaagaagcttttgtctgcatggtacgagaagagacagatgaagaagatttactctcccctcctggaaggactcttagctctctacctcggtattgaatgggttcagacggataacattttagcaccgatgatgacgcatggtatatactcgacggttatattagggcatgggctgtggaaaatacatgatcaccgtagaaggttacgtcggaggatcgaacggcttagatcggagaccgctgatgaatgaacggttttaaaatcat

SEQ ID NO: 792 - DNA, 1876 bp, Brassica rapa
ccgaccaatgctatctctacgtgtcagatactggttggttatgtagatatgcttcatctacatcatatatcctcctagccgcacgataaaaatcctacggacaagaacaaaccttatctctccagttttagattctgtataaattcaaagggaagaacacaaataagcagagaaggagaagtgaaaaggcaaatgaaaaagacgacgtactaagatcacgactgagagattattagtttccgcgacaatggagcttccattactctcttacaccaactcagcctcgttttcccggacaggcatatgctctacttcttcctcctcaactagtattaatgacttcctggagagaagaaggagcttgagaatgagattcaacggtggagataatccacgaagcgttaaagcttccgctggacgaagcagcgaagggatggagaagacagacagcagcggaggaggagcaagacaattcgccggtcctgtcatggaggtcactacactcgatcgcggctttgctaactccactactgttgatttcccggtttgggacaaaataggcgccgtggttagacttacttacgggatcggaatatatggagcaatggctgtagcaggaagagtcatatgttcagtgactggtattgactcttctggtggctttgatccttctcttgatgctcttcttgccggtcttggctatgctactccacctatcatggctcttctcttcattctcgatgatgaggttgtgaaactatcaccccatgctcgagccatcagagacgtggaagatgaggaactaagaggctttttcttcggaatgtccccatggcagtttatactcattgttgcggccagttccataggagaagagctcttttaccgtgttgctgtacagggtgcgctgtctgatatattcttgaaaggaacacagttgatgacagattctagaggcatggcatctctgaccggagtattgcctccatttgttccatttgctcaagcatttgcagctgtgatcaccgccactctcacaggctccctctactttcttgctgcttctccaaaagacccaacctacattgttgccccggttttaaggtcacgccgcgatgatttcaagaagcttttgtctgcatggtacgagaagagacagatgaagaagatttactctcccctcctggagggactcttagctttctacctcggtattgaatgggttcagacggataacattttagcaccgatgatgacgcatggtatatactcgactgttatattagggcatgggctgtggaaaatacatgatcaccgtagaaggttacgtcggaggatcgaacggcttagatcggagaccgctgatgaatgaacggttttaaaatcatctatagattgtaactggttgtggggtggatttgtgtgtattttttttgggtatggggggggtcgtatagtaataactagagaaattaggtctccataaaatttagaacagctgcatatatgtgtatatacataacataaaacctgtatttgttcctagttgtgaggctaaagaacaataaagcttgagtctctctttaaactcactttgactcatgtctgtttgaatggacaaagcaatcataattaagtgaaactaaagaacacaacacattcattttaatcaacattccagagcccttcaagctaatgtcacagttcggtttcttctttttttcatgaaaatctgagagctcacagtcaccaacctcttccaagttctgtaatgcggctaacgccatgtgacgcctccgtgcttctcttgttctcgggttgagcttccaacttgggcctctactgagacgaaaccatgaatccttttgtcactttt

SEQ ID NO: 793 - DNA, 1359 bp, Brassica napus
aaggagaagtgaaaaggcaaatgaaaaagacgacgtactaagatcacgactgagagattattagtttccgcgacaatggagcttccgttactctcttacaccaactcagcctcgttttcccggacaggcatatgctctacttcttcctcctcaactagtattaatgacttcctggagagaagaaggagcttgagaatgagattcaacggtggagataatccacgaagcgttagagcttccgctggacgaagcagcgaagggatggagaagacaaacagcagcggaggaggagcaagacaattcgccggtcctgtcatggaggtcactacacttgatcgcggctttgctaactccactactgttgatttcccggtatgggacaaaataggcgccgtggttagacttacttacgggatcggaatatatggagcaatggctgtagcaggaagagtcatatgttcagtgactggtattgactcttctggtggctttgatccttctcttgatgctcttctcgccggtcttggctatgctactccacctatcatggctcttctcttcattctcgatgatgaggttgtgaaactatcaccccatgctcgagccatcagagacgtggaagatgaggaactaagaggctttttcttcggaatgtccccatggcagtttatactcattgttgcggccagttccataggagaagagctcttttaccgtgttgctgtacagggtgcgctgtctgatatattcttgaaaggaacacagttgatgacagattctagaggcatggcatctctgaccggagtattgcctccatttgttccatttgctcaagcatttgcagctgtgatcaccgccactctcacaggctccctctactttcttgctgcttctccaaaagacccaacctacattgttgccccggttttaaggtcacgccgcgatgatttcaagaagcttttgtctgcatggtacgagaagagacagatgaagaagatttactctcccctcctggagggactcttagctttctacctcggtattgaatgggttcagacggataacattttagcaccgatgatgacgcatggtatatactcgactgttatattagggcatgggctgtggaaaatacatgatcaccgtagaaggttacgccggaggatcgaacggcttagatcggagaccgctgatgaatgaacggttttaaaatcatctatagattgtaactggttgtggggtggatttgtgtgtattttttttgggtatggggggggtcgtatagtaataactagagaaattaggtctccataaaatttagaacagctgcatatatgtgtatatacataacataaaacc

SEQ ID NO: 794 - DNA, 1717 bp, Brassica napus
ggaagtgaaaaggcaaatgaaaaagacgacgtacgaagatcacgagtgagagattattagtttacgattagctcgacagagcgacaatggagcttccgttactctcttacaccaactcagcctcgttttgtcggacaggcatatgctcttcttcctcttcttcctcctcaactagtattagtgacttcccggagataagaaggagcttgagaatgagactcaacggtggagaaaattcaagaagcgttaaagcttccgctggacgaagcacggaagggatggagaagacagacagcagcggaggaggaggagcaagacagttcgccggtcctgtcatggaagttactacacttgaccgtggctttgctaactccaccaccgttgatttcccggtctgggacaaaatcggcgccgtggttagacttacttacgggatcggaatatatggagcaatggctgtagcaggaagagtcatatgttcagtgactggtattgactcttctggtggatttgatccttctcttgatgcacttctcgccggtcttggctatgctactccacctatcatggctcttctcttcattctcgatgatgaggttgtgaaactatcaccccatgctcgagccatcagagatgtggaagatgaggaactaagaggctttttcttcggaatgtccccatggcagtttatactcattgttgcggccagttccataggagaagagctcttttaccgtgttgctgtacagggtgctctgtctgatatattcttgaaaggaacacaactgatgacagattctagaggcatggcatctctgaccggagtcttgcctccatttgtcccatttgctcaagcatttgcagccgtgatcaccgccactctcacaggctccctctactttcttgctgcttctccaaaagacccgacatacattgttgccccggttctaaggtcacgccgcgatgattttaagaagcttttgtctgcatggtacgagaagagacagatgaagaagatttactctcccctcctggaaggagtcttagcgttctacctcggtattgaatgggttcagacggacaatatcttagcaccgatgatgacacatggtatatactcgacggtaatattagggcatgggctgtggaaaatacatgatcaccgtagaaggttacgtcggaggatcgaacggcttagatcggagaccgctgatgaatgaacggttttaaaatcatctatagattgtaactggttgggggtggatttgtgtgtaattttttgggtatgggggggggcgcgtatagtagtaataactagagaaattaggtctccataaaatttagaacagctgcatatatatacataacataaacttgtatttgttcctacttgtgaggctaaagaacaataaagcttgagtctctctttaaactcactttgactcatgtctgtttgaatggacaaagcaatcataagcgaaactaaaggacacaactaacacattcatttcaatcaacattcgagagcctttcaagttagtgtcacagttcggtttcttcttttgtcatgaaaatctgagagctcacagtcaccaacctcttccacgttctgtaatgcggctaatccatgtgacgcctccgtgcttctcttgttctcgggttgagcttccaacatgggcctctactgagacgaaaccatgaatcctttgtcactttt

SEQ ID NO: 795 - DNA, 1772 bp, Eutrema parvulum
ccgccaatgttatctctacgtgtccgatactgattggttgtagagatattcttcatctacatcagatatcctcccaaccgtaagatgaaaatccgacggaccaaaaaaaaccttatctctccagcttcagatcctgtataaattcaaagaaacaaataagcaaagacacacacacagaagaagaagaagaagtgaaaaaaagcaaatgaagaagacgaagttcggagagattttgctggccggagatcacgattgagttttagtaggttcggaatagctcgacgaagccacaatggagcttccattactctcttacaccaactcagcctcgttttcgcggacaggcttatgctcttcttcttcttcctcctcaactggtattagtgacttcccggagagaaggagcctgagattgagattaaacggtggagaaaagtcccgaagcgttaaagcttccgctggacgaagcagcgaagggattgataagacagacggcgtaagcggcggcggaggaggaggaggaggaacaagacaattcgccggtcctgccatggaggttactacatttgatcgtggctttgctaactccaccaccgttgattttccgatctgggacaaaatcggcgccgtcgttcgacttacttacggaatcggaatatatggagcaatggctgtagcaggaagaatcatatgttcagtgactggaattgactcatctggtggatttgatccttctcttgatgcacttctggccggaattggctatgcaacaccaccgatcatggctcttctcttcatactcgatgatgaagttgtgaaactatcaccgcatgctcgagccatcagagatgtggaagatgcggaactaagaagctttttcttcggaatgtcaccatggcagtttatactcatcgttgtggccagttcgataggagaagagctcttttaccgtgttgctgtacagggtgctctgtccgatatgttcttgagaggaacacaactgatgacagattctagaggcatggcatctctgaccggagtcttgcctccatttgtcccatttgctcaagcatttgcagctgtgatcaccgcgactctcacgggctccctctactttcttgctgcttctccaaaagacccgacatacattgttgccccggttctaaggtcgcgccgcgatgattttaagaagcttttgtcagcttggtacgagaagagacagatgaagaagatttactctcccctcctcgaaggactcttagcactctacctcggtattgaatgggttcagacggacaatattttagcaccaatgatgacgcatggtatatactcggcggtaatattagggcacggactgtggaaaattcacgatcaccggagaagattacgtcggagaatcgaacggattaaatcggagaccactgatgaacaattttaaatcatccctagatcttaattggttggggatggatttatatgtatttttttggtatggggtcgtatagtaattagagaaattaggtaggacctctaccataaaatttagaccgctgctgcattatacagtagacaacttacatacagtatatgtatatacataagctttgtatttgttccgagttgtgaggtttaattacaataaagcttaagtctctcttaaactctcttactctccttgactcatatttgttttgaatgacaaaagcaagaaatcagaagtgaaactgaagaacagaacaagattgtaagaacatttcaaagagttttaa

SEQ ID NO: 796 - DNA, 1443 bp, Raphanus sativus
  misc_feature (298)..(298): n is a, c, g, or t
  misc_feature (304)..(304): n is a, c, g, or t
  misc_feature (334)..(334): n is a, c, g, or t
  misc_feature (853)..(853): n is a, c, g, or t
  misc_feature (1435)..(1435): n is a, c, g, or t
  misc_feature (1438)..(1438): n is a, c, g, or t
ggaataagcctagaagaagtgaaagaggcaaatgaagaagacaaagcacggagatatataaccggccggagatcacaactgagattatattagtagtgtgccgattagatcaaacgaagcgacaatggagcttccattactctcttacaccaactcagtcacgttttcgcgcacaggcatatgctcttcttcctcttcctcctcaactagtattagaaacttcccggggaaaagaatgagcttaggaatgggattcaataattcaagaagcgtcaaagcttcagctggacggagcacngaaggngtggagaagacagacggaggacagttcgcnggtcctgtcatggaggtcactacacttgatcgcggctttgctaactccacgaccgttgattttccggtctgggacaaaattggcgccgtggttagacttacttacgggatcggggtatatggagcaatggctgtagcaggaagattcatatgttcagttactggtattgactcatctggtggctttgatccttctcttgatgctcttctcgctggtcttggctatgctacaccacccatcatggctctcctcttcatactcgatgatgaagttgtgaaactatcaccacatgctcgagccatcagagacgtggaagatgaggaactaagaagctttttcttcggaatgtcgccatggcagtttatactcattgtggcggccagttcgataggagaagagctcttttaccgtgttgctgtacagggggctctgtctgatatattcttgaaaggaacacagttgatgacagactctagaggcatggcctctctgaccggagtcttgcctccatttgttccntttgctcaagcatttgcagctgtgatcaccgctactctcacaggctcactctactttcttgctgcttctccaaaagacccaacatacattgttgccccggttctaaggtcacgccgcgatgactttaagaagcttttgtctgcttggtacgagaagagacagatgaagaagatttactctcctcttctcgaaggactcttagctctctacctcggtattgaatgggttcagacggacaatatcttagcaccgatgatgacgcatggtatatactcgacggtaatattagggcatgggctgtggaaaatacatgatcaccgtagaaagttacgtcggaggatcgaacggcttagatcagagaccgctgatgaatgaacaattttaaaatcatctatagattgtatgggggtggggcggttggatttgtgtgtatttttttggggtatggggtcgtatagtaataattagagaacttagatctccataaaatttagaacagctgcatatatatacatagcatatagttgtatttgttcctagttgtgaggttaaaaatagcaatagagcttgagcctctcttanacncaata

SEQ ID NO: 797 - DNA, 1116 bp, Arabidopsis lyrata
atggagcttccgctactctcgtatgctagctccgcgtcgttttcgcggacaggcttttactcttcttcttcctcaactagtatctgtgagttcccggagagaagacggagcttcagaatgagattcaatggtggagaaaggtcacgaagcgttatagcttccgctgaacggagcagcgaagggatcgagaagacagacggcggaggaggatttgctggtactgccatggaggtgacaacacttgatcgtggattcgctaactccaccaccgttgattttccgatctgggacaaaattggcgccgtcgttagacttacttacggaatcggaatatatggagcaatggctgtagctggaagattcatatgttcggtgactggaattgattcatctggtggatttgatccttctcttgacgcacttctcgccggacttggctatgcaacaccaccaatcatggctcttctcttcatactcgatgatgaagttgtgaagctatcaccgcacgctcgggccattagagatgtggaagatgaggagctcagaagctttttcttcggaatgtccccatggcagtttatactcattgtcgcggctagttcaataggagaagagctcttttaccgtgttgctgtacagggtgctctgtctgatatattcttgaaaggaacacagttgatgacagattctagaggcatggcatctctgaccggagtgtttcctccatttgtcccatttgctcaagcctttgcagctgtaatcactgccactctcacaggctctctctactttcttgctgcttctccaaaggacccgacatacattgttgccccggttttaaggtcacgcagagatgattttaagaagcttttgtcagcttggtacgagaagagacagatgaagaagatttactctcctctactcgaaggactcttagccctctatctcggtattgaatgggttcagaccgataatattttagcaccgatgctgacgcatggtatatactcggcagtcatattaggacatgggctgtggaaaattcatgatcaccggagaagattacgccggagaatcgaacgcattagatcggaggctaccgataagttgatttaa

SEQ ID NO: 798 - DNA, 1649 bp, Eutrema halophilum
atatgcttcatctacatcaaatatcttcccaaccgtacgatattaatccgacggaccagaaaaaaccttatctctccagctctagatcctgtataaattcaaagaaacaaataaacaaatggcacacacgcacagaagaagaagaagtgagagaaaggcaaatgaagaagacgaattacgcagagatttcgccggccggagatcacgaataagtttattagcttcaaaataagctcgacgaagctacaatggagcttccattactctcttacaccaactccgcctcgttttcgcggacaggcttatgctcttcttcctcctcagctagtgttagtgacttaacggagagaaggaggaacttgagaatgagattcaatggtggagaaaattctagaatcgttaaagcttccgctggacgaagcagcgaagggattgacaagacagacggtgtaagtggcggcggaggaggaggaacaagacaattcgctggtcctgccatggaggttactacacttgatcgtggctttgctaactccaccaccgttgatttcccgatctgggacaaaatcggcgccgtcgttcgacttacttacggaatcggagtatatggagcaatggctgtggcaggaagatttatatgttcagtgactggggttgactcgtctggtggatttgatccttctcttgatgcacttcttgctggacttggctttgcaacacctccaattatggctcttctcttcatactcgatgatgagattgtgaaactatcaccgcacgctcgagccattagagatgtggaggatgaggaactcagaagctttttctttggaatgtcgccatggcagttcatactcattgtcgtggccagttcgataggagaagagctcttttaccgtgtagctgttcagggtgctctgtctgatatgttcttgagagggacacaattgatgacagattctagaggcatggcatctttgaccggagtcttgcctccatttgtcccatttgctcaagcatttgcagctgtgatcactgcaactctcacaggctctctctactttcttgctgcttctccaaaagaccctgcgtacattgttgccccggttttaagatcacgccgagatgatttcaagaagcttctgtcagcttggtacgagaagagacagatgaagaagatatactctcccctcctcgaaggactcttagctctctacctcggttttgaatggattcagacggataatattttagcaccgatgatgacgcacggtatatactcggcggtaatattaggtcatgggctgtggaaaattcacgatcaccggagaagattacgtcggagaatcgaacgggttagaacggagaccaccaatgaacaattttaaatcaactctagcatgtaataggttggggtgggggacttgtgtgtaatattttttttggtaaggggtcgtaagtaactagagaaattaggtaggacctcttccataaaatttagacagctgctgcatacagtagagaagtattgaaagtacatatatatatgtatatatattatatgttatacataaaaagcttgtatttgctcttagttgtgacttgtgacttgtgagaacaatcaattttgagatctctcgtaaactctc

SEQ ID NO: 799 - DNA, 1748 bp, Brassica rapa
ttttcaaaacccacgtgtattaatcttcatcaatcttagccacatcttcctcattaataatcccaagtcctaggtggaaacaagaagcatcatccaaacacatggaagaagctcaaacactaacgttcacactaatcttcgtcgttcttactctcatcttcttcattgtaacaaacagaaccaagaagcgaaagccgaaacttcctccgagtccacctttcgcgcttccagtcatcggccacctccgcttactcaagccaccgctccaccgcgttttctattccatctctcaatctctaggcggtgcccccatcttctcactccgtctcggcagccgactagtgttcgttgtctcttcacactcaatcgcagaggaatgtttcacgaagaacgacgtggtactcgcgaaccgaccaaacacaatcgcttccaaatacgtctcatacgaccacacaaccatggtcacagctccgtatggggaacactggagaaacctccgccgcataggcgccgtggagatattctcggctcaccggcttaataagtttctgtctatacgccaggacgaggtccgtcggcttatagttcgtctctcacggaactcttcatacgagtttgccaaggtggagatcaactcaatgttctctgacttaacattcaacaacatcatccgtatggtagccggaaaacgttactacggagatgtttcagaggaaaactctgaggctaaactcgtacggcagcttatcgcggacctgatgagtatttttggtgcgggaaatgcggctgactatgtacctatcctgcgttgggtcacgggtttcgagaaacgggttaaagagctcggtggtaggtttgatgagttcttgcaaggattggttgatgaaaggcgagcagcgaaggagaaagggaacaccatgatcgatcacttgctttctctgcaagaaacacaacctgggtactacacggaccgtaccatcaaaggaaccatactctctttgatactggcggggactgatacatcagcggtaacattggaatgggcattgtcgagcttattaaaccatccagagaaattaagaaaggcgagagaagaaatcgattgtaaaattggtttagacaggcttgtggaggaatcagacatctcaaaccttccctgtcttcagaacattgtgtctgaaacattacgtctataccctgcgggacctttgatggtgcctcacgtcgcatcggaagactgtaaagtaggagggtatgatatgccacaaggcacaacattattggtgaatctgtgggctatgcacagagatcctcagctatgggatgatcccgagactttcaagccagagaggttcgagaaagaaggggaggctcataagctaatgacgttcgggttaggaagaagggcgtgtcctggatcaggactagcgcaacggctggtgagcttgactctggcgtcattaattcaatgttttgaatgggagaggattggagaagaagaggtggatatgactgaagctggaggtgccacaatgcctaaagctagacctctggtagccatgtgtacagcacgtacgaccttggttggtaaaatcctccacgagtccgcttgactttaccttttttaaagtagtatatgtttgatggacatatcatccctaatttttttttttgaaaaaaaaaatcgttcacaaactttattgttgttgtgaatttatgcaattaatactttatatctggaatgcttt

SEQ ID NO: 800 - DNA, 1547 bp, Brassica napus
gatccaaacacatggaagaagctcaaacactaacgttcacactaatcttcattgttcttactctcatcttcttcattgtaagaaacagaaccaagcgtaagccgaaacttcctccgagtccacctttcgcgcttccagttatcggtcaccttcgcctgctcaagccgccgctccaccgcgttttctattccatctctcaatctctaggcggtgcccccatcttctcactccgtctcggcagccgactagtgttcgttgtctcttcacactcaatcgcagaggaatgtttcacgaagaacgacgtggtactagcgaaccgaccaaacacaatcgcttccaaatacgtctcatacgaccacacaaccatggtcacagctccgtatggggaacactggagaaacctccgccgcataggcgccgtggagatattctcggctcaccggcttaataagtttctgtctatacgccaggacgaggtccggcggcttatagttcgtctctcacagaactcttcacacgagtttgccaaggtggagatcaactcaatgttttctgacttaacattcaacaatatcatccgcatggtggccggaaaacgttactacggagatggtgcagaggaaaactctgaggctaaactcataaggcagcttatcgcggacctgatgaacatttttggtgcgggaaacgctgctgactatgtacctatcctgcgttgggtaacgggtttcgagaaacgggttaaagagctcgctggtaggtttgatgagttcttgcaaggattggttgatgaaaggcgatcagctaaggagaaagggaacatgatgatcgatcacttgctttctttgcaagaaacacaacctgagtactacacggactgcaccatcaaaggaaccatactctctttgatactggcggggactgatacatcagcagtaacattggaatgggcattgtcgagcttattaaaccatccagagaaattaagaaaggcgagagaagaaatcgacagtaaaattggtttagacaggcttgtggaggaatcagacatctcaaaccttccctgtcttcagagcattgtgtctgaaacattacgtctataccctgcgggacctttgatggtgcctcacgtcgcatcggaagactataaagtaggagggtatgatatgccacaaggcacaacactattggtgaatctatgggctatgcacagagatcttcagctatgggatgatcccgagactttcaagccagagaggttcgagaaagaaggggaggctcataagctaatgacgttcgggttaggaagaagggcgtgtcctggatcaggactagcgcaacggctggtgagcttgactctcgcgtcattgattcaatgttttgaatgggagaggactggagaagaagaggtggatatgactgaagctggaggtgtcacaatgcctaaagctagacctctggtagccatgtgtagaacacgtacgaccttggttggtaaaatcgtccacgagtccgcttgactttgccttttttaaagtagtatatgt

SEQ ID NO: 801 - DNA, 2801 bp, Brassica napus
aaagaaaaaatgttttgtaaagagtcgtcgtcgggtctccagaccctgagcatagcaaagagcctcagctctccgttccataaaccatcaccactcatcaaccccatttggacaggacgtcgagacaagctgtgtcgtccccgaaacctcggtggacgatgtaaggtcacggcatcacagtcaaatagtgaaccgaaaggtaacataatgaaagaaaagttaaaaaaatacaaagtaaagggatatatacaggccgaagaagggacggtgctggagggcctacgttggtcgagaggtctcgatgacatttcagatattgccggcagatcactgctcgttgagcttatttccgccgagactgacaaccggacgctgatggagaaggatccggtagaagactatgcacaacgtgtatggttcgatggcgaatcccctgatgagaagtacgagtgcgagtttaacatgcctgaagactttggaaccgtgggagctataaggatacaaaaccagcaccatcgagacatattcatcaaggagatggagcttgagttacccagcgggtccgttacgtttcatgccactcatgggtggccccaagtccgttgacccagccaagaggatattcttctccagcaagtcctacataccttccgcaaccccagagccccttaagaagctgcggaaggaggagctggagaccttgcaaggcaacaaccgcaagaaggttggtgaattcgagaaacacgaacgcgtttatgactatgacgtgtacaacgatgtgggtgaccctgacaaaaatgacgaactcgcccgtcctgtcattggaggcctctctcatccgtacccgagacggtgcaagactggtcgcaaatccagcaaaaaagacccatccacggagaaacgcgaaggggacttctatgtccctagagacgaggagttctccacaaccaagggaacggcattcacaggcaaggccatcttggcagctcttccatccgtgttcacacagctcgagtctattctgctggatcccaaatctcccttcccacacttcaagtcaatagaagatctctttgacgttggcatcaatcttcccaaggatgctggccttttacctatgctccccaaacttattaaagttctttctgaagctcaagatgatcttctccagtttgatccccctattcttcttaacaaggatagattttcatggatccgagacgacgaatttgctcgccagacacttgcaggccttaacccctattgcattcagctagttacggagtggccgttgcaaagcaaactagaccctgcggtttatggtgatcccaactcactcattacttgggaaattgtggaaaaggaaattagaggagtcatgtcagttgatgaggctctaaagaataagagattgttcatgttggattatcacgacttgctactaccgtatgtgaacaaagtgagggagttggatgacaccatgttatatgcttctcgaacactattcttcctcagcgatgatagcacactaagacctgttgccattgagttgactcgtcccccagatgtcaacaggccccaatggaagcaggtcttcacgccaggttatgatgctacctcctgctggctatggaaacttgctaagactcacgttgttgctcatgacgccggttatcatcagcttatttcccactggctgaggactcattgctgtatggagccatacataatagcggcaaacagacaattaagtgccatgcatcctatctataggcttttgcatccccacttccgctacaccatggagatcaacgctcgtgcacgccaaagtctcgtcaacgcaggtggaatcattgagacttgtttctggccaggcaagtattccttagagctaagttcagatgtctatggtaaactatggaggttcgacaaggaaggtttacctgcagacctcatcaacagggggctggctgtggaagatgagaaggcggaacatggggtgcgactgacgataccagactacccattcgcgaatgacggtctaatgctgtgggatgcactaaaggaatggatcacagactatgtgaatcactattatccagatgcaggactgatcacgtcggatgaggaactccaagcatggtggagtgaagtgaagaacatagggcatggagacaaaaaagacgaaccatggtggcctgagctcaaaacacaagatgacttgattggcgtggcgactacgattgcgtgggtggcttcaggtcaccatgcagctgtaaactttggacagtacgggtacggagggtacttccccaaccgaccaaccacaacaaggagaagaatgccagtggaagagcctacagaggaagagctaaaagagttctacgaggagccagagaaggtgttgctgaagacattcccgtcgcagaagcaggcgacgcaagtgatggtgactctggatctactatcgacccattcaccagacgaagagtacttgggagaagagccagaagcatcttggatcgatgaacctgtcatctttgctgcatatgaacgattcaagggcaggctccaatatctagaaggagtgatagatgagaggaacgtgaatgtttctctaaagaacagagctggcgcaggtgttgtcaagtacgagcttttgaagcccatctctgagcccggttgtaccggaatgggtgttccctacagtgtctctatctaatgcatctgaacatgtatttacttgctaaaatcattgatcaagtggtcagcaataaaaaataaaacaagtgaatttcctt

SEQ ID NO: 802 - DNA, 2588 bp, Triticum aestivum
tgagcatagcaaagagcctcagctctccgttccataaaccatcaccactcatcaaccccatttggacaggacgtcgagacaagctgtgtcgtccccgaaacctcggtggacgatgtaaggtcacggcatcacagtcaaatagtgaaccgaaaggtaacatagtgaaagaaaaagtaaaaaaaatcaaagtaaagggatatatacaggccgaagaagggacggtgctggagggcctacgttggtcaagaggtctcgatgacattgcagatattgccggaagatcactgctcgttgagcttattgccgccgagaatgacacccggacgctgatggagaaggatccggtagaagactatgcacaacgtgtatggttcgatggcgaatccgctgatgagaagtatgagtgcgtgtttgacatgcctgaagactttggaaccgtgggagccataaggatacaaaaccagcaccatcgagacatattcatcaaggagatggagcttgagttacccagcgggtccgttacgttttcatgccactcatgggtgcccccaagtccgttgacccagccaagaggatattcttctccagcaagtcctacataccttccgcaaccccggagactcttaaaaagctgcggaaggaggagctggagaccttgcaaggcaaaaaccgcaagaaagttggtgaattcgccaaacacgaacgcgtttatgactatgacgtgtacaacgatgtgggtgaccccgacaaagatgacgaactagcccgtcctgttattggaggcctctctcatccgtacccaagacggtgcaagactggtcgcaaacgctccgacaaagacccctccacggagaaacgcgaaggggacttctatgtccccagagacgaggagttctccacaaccaagggaacggcattcacgggcaaggccatcttggcagctcttccatccgtgttcacacaggtcgagtctattctgctggatcccaaatcgcccttcccacacttcaagtcaatagaagatctctttgacgttggcatcaaccttcccaaggatgctggccttttacctatgctccccaaacttattaaagttatttctgaagctcaagatgatcttctccagtttgatccccctattcttcttaacaaggatagattttcatggatccgagacgacgagtttgctcgccagacacttgcaggccttaacccctattgcattcagctagttacagagtggccgttgcaaagcaaactagaccctgcggtttatggtgatcccaactcactcattacttgggaaattgtggaaaaggaaattagaggagtcatgtcagttgatgaggctctaaagaacaagagactgttcatgttggattatcacgacttgctactaccgtatgtgaacaaagtgagggagttggatgacaccatgttatatgcttctcgaacactattcttcctcagcgatgatagcacactaagacctgttgccattgagttgactcgtcccccagatgtcaacaggccccaatggaagcaggtcttcacgccaggttatgagctacctcctgctggctatggaaacttgctaagactcacgttgttgctcatgatgccggttatcatcagcttatttcccactggctgaggacccattgctgtatggagccatacataatagcggcaaacagacaattaagtgccatgcatcctatctttaggcttttgcatccccacttccgctacaccatggagatcaacgctcgtgcacgccaaagtctcgtcaacgcaggtggaatcattgagacttgtttctggcccggcaagtattcattagagctaagttcagatgtctatggtaaactatggaggttcgacaaggaaggtttacctgcagacctcatcaacagggggctggctgtggaagatgagaaggcggaacatggggtgcgactgacgataccagactacccattcgcgaatgacggtctaatgctgtgggatgcactaaaagaatggatcacagactatgtgaatcactattatccagatgcaggactgatcacgtcggatgaggaactccaagcatggtggagtgaagtgaagaacatagggcatggagacaaaaaagacgaaccatggtggcctgagctcaaaacacaagatgacttgattggcgtggcgactacgattgcgtgggtggcttcaggtcaccatgcagctgtaaactttggacagtacgggtacggagggtacttccccaaccgaccaaccaccacaaggagaagaatgccagtggaagagcctacagaggaagagctaaaagaattctacgaggagccagagaaggtgttgctgaagacattcccgtcgcagaagcaggcgacgcaggtgatggtgactctggatctactatcgactcattcaccagacgaagagtatttgggagaagagccagaagcatcttgggtcgatgaacctgtcatctttgctgcatatgaacgattcaaaggcaggctccaatatctagaaggagtgatagatgagaggaacgtgaatgtttctctaaagaacagagctgg

SEQ ID NO: 803 - DNA, 2994 bp, Eutrema parvulum
attctccggatataattaaatataattgatttttagaaaggacaaaaacaggatgatatgatattaatatctagacttgtataaagagatgaagcgggatggagaaatatatggtaagcaaaatagaagcaaagagataaaaagatgttttgtaaagagtcgtcgagtctccagaccttgagcatagcaaagagctgcagctctattttccctaaaccatcagcactcatcaaccccattttggcaggacgtcgagacaagctgtgtcgtcgtcgaaatcttggtggaggatgtaaggtaacggcctcacagtccaatattgaacagaaaggtaaaatagtgaaagaaaaagttaagaaaatcaaagtaaagggattcataacggccgaagaagggtcgttgctggagggcctaggttggtcgagacctctcgatgacattaccgatatccgcggcagatcactgctcgtcgagcttatcagcgccgagactgacactcggacgttgatggagaaggatccagtagaagactatgcacaacgtgtatggttcgaatcccctgatgagaagtacgagtgcgtgtttgacatgcccgaagactttggaaccgtgggggctatcaggatacaaaaccagcaccataaagagatgttcatcaaggagatggagcttgagttacccagcggctccgttacgtttacatgtaactcatgggtgacccccaagtccgttgacccatcgaagcggatattcttttccaataagtcctacttgccttccacaaccccggagcctcttaaaaagttgcggaaggaggagctggagaccttgcaaggcaacaaccgcaagagagttggtgaattcaccaagtacgaacgcgtttatgactatgatgtgtacaatgatgtgggcgaccctgacagagatgaagaacttgcccgccctgttattggaggcctctcccatccgtacccaaggcggtgcaagactggtcgcgaaccttgcgataaagacccctccacagagaaacgccacggagatttttatgtccctagagacgaggagttctctacaacaaagggcactgcattcacgggcaaggccatcttggcagctcttccctccatattcccacagatcgagtctgctctactggatcccaacttgcccttcccacacttcaagtccatcgaagatctctttgaaattggcatcgagcttcccaaggatgctggccttttacctatgataccaagacttatcaaagctgttgctgaagctcaagatgatcttctccagtttcacccccctattcttcttaacaaggatagattttcatggatccgagacgacgagtttgctcgccagacactagcaggcctaaatccctattgcattcagctaattacagagtggccgttgaaaagcaaactagaccctgcggtctatggtgatcccaactcactcattacatgggatgttgtggaaaaagaaataagaggagtcatgtcagttgatgaggctctaaagaacaagaaattgttcgtgttggattatcacgatttgcttctaccgtatgtgaacaaagtgagagagttggatgataccaccttatatgcatctcgaacaatattcttcctcagtgatgatagcacattgaggcctgttgcaattgagttgactcgtcccccagatgtcaacaggtcccaatggaggcaggtcttcacgccaggctatgatgctacctcctgctggctatggagtcttgctaagactcacgctgttgctcatgatgccggttatcaccagcttatttcccactggctgaggactcactgctgtattgagccatacataatagcggcaaacagacaactaagtgccatgcatcctatctataggcttttgcatccccacttccggtacaccatggagatcaacgctcgtgcacgccaaagtctcgtcaacgcaggtggaatcattgagacttgtttctggcccggaaagtattcactagagctaagttcagacgtctacggtaaactatggaggttcgacagggaaggcttacctgcagacctcatcagcaggggtctggctgtggaagatgagaccgcggaacatgggctacggctgacgataccagactatccatttgcgaatgacggtctaatgctgtgggatgcacttaaggaatggatcacagactatgtaaagcactattatccagatgcaggactgatcatgttggatgaggaactccaaggatggtggagtgaagtgaggaacatagggcatggagacaagaaagacgaaccatggtggcctgtcatcagaacacaagatgacttgattgaagtggtgactacgattgcctgggtggcttcaggtcaccatgcagctgtaaactttggacagtacgggtatggaggatactttcccaaccgaccaaccacaacaaggacaagaatgccaatggaagaaccgacagaggaagagctcaaagagttttatgaggagccagagaaggtattgcttaagacatttccgtcgaagaagcaggctacgcaagtgatggtgactctggatcttttatcgactcattcaccagacgaagagtacctgggagaaaacccagaagcatcttgggccagcgatcctgtcatctttgctgcatatgaacgattcaaagccagactccaatatctagaaggagtgattgacgagaggaacgtgaacgtttctcttaagaatagagcaggagcaggtgttgttaagtacgagcttttgaagcccatctcgaaacccggtgttaccggaatgggtgttccctacagtgtctctatttgatctataatggcattgctttttctgaaattttatttccttgctaaattaagggtcaacattcaacaataattaagtaaacgatccgtttatttttttctaataataatatattaaaatctcaactgctctaaatacaaatcgttt

SEQ ID NO: 804 - DNA, 3773 bp, Brassica napus
gaagaacagcgctctaccattttgagcttacagatctattatatcaaatcttcaaaaatcaatatgagctcatagcaagacaacaagtaaccttccacttgcggatatagaaaatcaaaatcaaaaatcattcaaggcagttcagataggacacagcttttgagaaaaattatcaataaaatttgttggcagaattataacgtaataagacgagccgtaataatggatttacacttcgaaatctattaaggaattcatcaaagagtacacaaactgccattttagtaccttcattttcagtaaacaaggttttaggtcgggtctacaaacataccctaactattgttttcaccatgctccaagtgtgttcatcatgctccacgcttcttcagacatcaaatatcgagtaacagcatagccttgagaaattctcaaaatatacacctcaaaccagataaagagtaataaaaatacaatatacatgtgtatagatcggaaagctagttgttcaaaagcatttgtcaattctttaacaaaagagaaacaatataattagataagatcaatacaactgaacaacaataaaattgtaaaattgcatgacagacggaatgaataagaacaggtatgctgataactttgtatgagagtgattgcgatatacttttgagaaactaatttgtcttaaaaatacttgcgagtgcctgaatgttggggcatgaagaaacaaattgacacagctccaggttgatagctagctctggtattacgggtgtttcatgactatctgttagagttgtgatgcataataataaatagagtgtgtgaaagccgagagcaagacacgcacacaaggagaggagaacccgggataaaaaaaataacccgtgcgaactcccctcccaaccacaaaatatatatttttattaaggatctgtttttgacctgccatgcaagcgcacctgacatggcaaaggtcggatgacaaaagatgcaattcaacatcttctacatcctaattttaacttaacccacacaagaacaccgcttcacgtccataacgaattcgattcaacctcaaagcgcttcaacgcaaccgactcgcatcatagacacccctcacgcgatgatcccaccggcagatccgtagaggaagtataggtttcatgagatctgcgtcagatctaccgatgaaaggacttaaaacggttaaattgctggaaaatcaacaccgttgtgtagatcggaggactcgctatcacaaacagaagcaataaataaaagattcgtcgccatagaagcgagatctaaaggtatcgatgacattgcagatattgccggaagatcactgctcgttgagcttattgccgccgagaatgacacccggacgctgatggagaaggatccggtagaagactatgcacaacgtgtatggttcgatggcgaatccgctgatgagaagtatgagtgcgtgtttgacatgcctgaagactttggaaccgtgggagccataaggatacaaaaccagcaccatcgagacatattcatcaaggagatggagcttgagttacccagcgggtccgtacgtttcatgccactcatgggtggcccccaagtccgttgacccagccaagaggatattcttctccagcaagtcctacataccttccgcaaccccggagactcttaaaaagctgcggaaggaggagctggagaccttgcaaggcaaaaaccgcaagaaagttggtgaattcgccaaacacgaacgcgtttatgactatgacgtgtacaacgatgtgggtgaccccgacaaagatgacgaactagcccgtcctgttattggaggcctctctcatccgtacccaagacggtgcaagactggtcgcaaacgctccgacaaagacccctccacggagaaacgcgaaggggacttctatgtccccagagacgaggagttctccacaaccaagggaacggcattcacgggcaaggccatcttggcagctcttccatccgtgttcacacaggtcgagtctattctgctggatcccaaatcgcccttcccacacttcaagtcaatagaagatctctttgacgttggcatcaaccttcccaaggatgctggccttttacctatgctccccaaacttattaaagttatttctgaagctcaagatgatcttctccagtttgatccccctattcttcttaacaaggatagattttcatggatccgagacgacgagtttgctcgccagacacttgcaggccttaacccctattgcattcagctagttacagagtggccgttgcaaagcaaactagaccctgcggtttatggtgatcccaactcactcattacttgggaaattgtggaaaaggaaattagaggagtcatgtcagttgatgaggctctaaagaacaagagactgttcatgttggattatcacgacttgctactaccgtatgtgaacaaagtgagggagttggatgacaccatgttatatgcttctcgaacactattcttcctcagcgatgatagcacattaagacctgttgccattgagttgactcgtcccccagatgtcaacaggccccaatggaagcaggttttcacgccaggttatgatgctacctcctgctggctatggaaacttgctaagactcacgttgttgctcatgatgccggttatcatcagcttatttcccactggctgaggacccattgctgtatggagccatacataatagcggcaaacagacaattaagtgccatgcatcctatctttaggcttttgcatccccacttccgctacaccatggagatcaacgctcgtgcacgccaaagtctcgtcaacgcaggtggaatcattgagacttgtttctggcccggcaagtattcattagagctaagttcagatgtctatggtaaactatggaggttcgacaaggaaggtttacctgcagacctcatcaacagggggctggctgtggaagatgagaaggcggaacatggggtgcgactgacgataccagactacccattcgcgaatgacggtctaatgctgtgggatgcactaaaagaatggatcacagactatgtgaatcactattatccagatgcaggactgatcacgtcggatgaggaactccaagcatggtggagtgaagtgaagaacatagggcatggagacaaaaaagacgaaccatggtggcctgagctcaaaacacaagatgacttgattggcgtggcgactacgattgcgtgggtggcttcaggtcaccatgcagctgtaaactttggacagtacgggtacggagggtacttccccaaccgaccaaccaccacaaggagaagaatgccagtggaagagcctacagaggaagagctaaaagaattctacgaggagccagagaaggtgttgctgaagacattcccgtcgcagaagcaggcgacgcaggtgatggtgactctggatctactatcgactcattcaccagacgaagagtatttgggagaagagccagaagcatcttgggtcgatgaacctgtcatctttgctgcatatgaacgattcaaaggcaggctccaatatctagaaggagtgatagatgagaggaacgtgaatgtttctctaaagaacagagctggagctggtgttgtcaagtacgagcttttgaagcccatctctgaacccggtgttaccggaatgggtgttccctacagtgtctctatctaatgcatctgaacatgaatacttgctaaaatcatt

SEQ ID NO: 805 - DNA, 2893 bp, Brassica rapa
ggtatgcggaacacaaacaaatagataaaatatgttttgtaaagagtcgccgagtctccagaccttgagcacagcacagagcctcagctctctgttccctaaaccatcagcactcatcaaccccattttgacaggacgtcgagacaagccgtgtcgtcgtcaaaacttccgtggacgatgtaggatcacagcctcacagttcaatattgcacagaaaggtaaattactgaaagagaaagttaagagaatcaaagttaagggattcataactgctgaagaagggctgctggagagcttaagttggttgagacctctcgatgtcattacagatatccgcggcagatcactgctcgtcgagcttattagcgccgagactgacacccggacggttatggaggagggtccagtagaagactatgcacaacgtgtatggttcgaatcccgtaatgagaagtacgagtgcgtgttcgacatgcccgaagactttggaaccgtgggggccatcagggtacaaaaccagcaccgtagagaaatgttcatcaaggagatgaagcttgagttacccagcggctccgtaacgtttacatgtaactcatgggtgacccccaagtccattgacccaaccaagcggatatttttctccaacaagtcctacttgccatccgcaactccggagcctctcaaaaagctgcggaaggaagagctggagaccttgcaaggcaacaaccgcgagcgagttggtgaattcgccaagtacgaacgcgtttacgactatgatgtgtacaacgatgtgggtgaccctgacaaagatgaaagacttgcccgtcctgttatgggaggcctctctcatccgtacccgagacggtgcaagactggtcgcaaaccctgcgagaaagatgcctcctcagagaaacgcgaaggggagttctatgtccccagagacgaggagttctcttcaacaaagggcactgcattcacgggcaaggctatcttagcagctcttccctccgtgttcccacagatcgaggctgctctgcttgatcccaacttgcctttcccacacttcaagtccatagaagatctctatgaagttggcatcgacattcccaaggacgctggccttttacctatgatccccaaacttatcaaagttgttgctgaagctcaagacaatcttctacagtttgacccccctattcttcttaacaaggatagattttcgtggatccgagacgacgaatttgctcgccagacacttgcaggccttaatccatattgcattcagctagttacagagtggccgttgaaaagcaaactagaccccgcggtttatggtgatcccaagtcactcattacttgggacattgtggaaaaagaaatcagaggagtcatgtcagttgatgaagccctaaagaataagagattattcatgttggattaccacgatttgcttctaccgtatgtgaacaaagtgagagagttggacgacaccaccttatatgcttctagaacactattcttcctcagcgatgatagcacattgaggcctgttgccattgagttgactcgtccccctgatgtcaacaggccccaatggagtcaggtcttcacaccaggctatgatgctacctcctgctggctatggaatcttgctaagactcacgctgttgctcatgatgctggttatcatcagcttatttctcactggctgaggactcattgttgtatggaaccatacataatagctgcaaacagacaactaagtgccatgcatcctatctataggctgttgcatccccacttccgctacaccctggagatcaacgctcgcgcacgccaaagtctcgtcaacgcaggtggaatcattgagacttgtttctggccaggcaaatattcattagagctaagttcagatgtttatgctaaactatggaggttcgacagggaaggtttacctgcggacctcatcagcagggggctggctgtggaagatgagaccgcagaacacggactgcggcttactataccagactacccatttgcgaatgacggtttaatgttgtgggatgcactcaaagaatggatcacagaatctgtgaagcattattatcccgatgcggcactgatcacgtgtgatgaggaactccaagcatggtggagtgaagtgaggaacatagggcatggagacaagaaagacgaaccatggtggcctgtcctcagaacacaagatgacttgattggcgtcgtgaccacgattgcgtgggtggcttcaggtcaccatgcagctgtaaactttggacagtacgggtatggagggtactttcccaaccgaccaaccacaacaaggataagaatgccagttgaagagccaacagaggaagagctaaaagagttctatgaggagccagagaaggtgctgcttaagacattcccgtcgcagaagcaggcgacgcaagtgatggggactctggatcttctatcgacccattcaccagacgaagagtatcttggagaagagccagaagcatcttgggtcgacgatcctgttatctttgctgcatatgaacggttcaaaggcaggctcaaacatcttgaagacgtgatagatgagaggaacgtgaacgtttctctaaagaacagagctggagcaggtgttgttaagtatgagcttctgaagcccatctcccaacccggtgttaccggaatgggtgttccctatagtgtttctatctaaatgcattattgtttctctagtaaaaaaaaaaagtgaacgatccattttcctttttgttttcataatactaaatctcaactgtccaaaaactcttcgtcaccacaagctgaagagaaaacacagcaatttcaaaaaaaatacaatatcccttgataactg

SEQ ID NO: 806 - DNA, 2936 bp, Eutrema halophilum
tagaacacaacataaatttgtaacgtaacaatctttgcttctttttcttttcatatttttagaaatgacaccaaaaagagaagaaaaaaaagaatatctttagactacttgtataaagagatgactcgggaggaaggggaatgcagaggaagtaaagcaaaatagaaagcaaagagataaaaagatgttttgtagagagtcttcctcgagtctccagactttaaacatagcaaagagtgtaaactctctattccctaatccatcagcactcatcaagcccatttcggtaggaggtcgagacaagctgtgtcgtcgtcgtcgtcaaaacctcggaggacgatgtaaggtcacgagctcacagtctaatatcgaccagaaagctaaaatagtgaaagaaaaagtcaagaaaataaaagtaaaaggatacataacggccaaagaagggacgttgctggagggcctaggttggacgagacctctcgatgacattaccgatatccgcggcagatcgctcctcgtcgagcttataagcaccaagactgacactcacacgctgatggagaaggatccggtcgaagactacgcacaacgtgtatggttcgaggccccggatgagaagtacgagtgtgtctttgacatgcccgaagactttggaaccgtgggggccattagggttcaaaaccagcaccataaagagatgttcatcaaggagatggagctagagttacctagcggctcggtgacgtttacatgtaactcatgggtgacaccaaagtctggatccagccaagcgaatattcttctccaacaagtcctacttgcctaacgaaacaccagggcctcttaaaaagctacgaaagcaagagttggagaccttgcaaggcaagaaccgtgagcgagatggtgaattcaccaagtacgagcgtgtttacgactatgacgtttacaacgatgttggtgaccctgacagagatgtggaacttgcacgtcctgttattggaggtctctctcatccgtatccaagacgctgcaagactggtcgtaaactctgcgataaggatccttcctcagagaaacgctatggagagttctatgttccaagagacgaggagttctctacagataagggaaatagtttcactagcaaggccatcttggcagctcttccttctgttttcccacagattgagtgtgctcttcttgatcctaggtcaccctttccacacttcaagtccatagaagatctctttgaagtaggcatccagcttcctaaagatgctggccttttacctatgatccctagacttatcaaagctgttgctgaagctcaagatgatcttctccagtttgatcctcctgttctccttaacaaggatagattttcatggatccgagatgacgagttcgctcgccagacacttgcaggccttaatccctattccattcaactagttgaagagtggccgttgaaaagtgaactagaccctgcggtttatggtgatcccaactcactcatcacttgggaaattgttgaaaaagaaatcagaggagtcatgtcagttgatgaggctctaaagaataaaagattattcatgttggactatcacgatttgcttctaccgtatgtgaacaaagtgagagagttggatgataccaccttatatgcatctcgaacactattcttcctcagcgatgatagcacattgagacctgttgccattgagttgactcgccctccagatgtcaacaggccccaatggaagcaggtcttcacaccaggctatgatgctacctcctgctggctatggaagcttgctaagactcacgctgttgctcatgacgctggttatcaccagcttatttcccactggctgaggactcattgctgtacggagctatacataatagctgcaaacagacaactaagtgccatgcatcccatctataggcttttgcatccccacttccgttacaccatggagatcaacgctcgtgcacgccaaagtctcatcaacgcaggtggaatcattgagtcttgtttttggcctggcaagtattcagtagagctaagttcagacgtctatggtaaactgtggaggttcgacaaggaaggcttacctgcagacctcattagaagagggctggctgtggaagatgagactgcagaacatagagtacgactaacgataccagattacccatttgcaaatgatggtctaatgctatgggatgcactaaaagaatggataacagactatgtgaaccactattatccagatgcaggactgatcatgttggatgaggaactccaaggatggtggagtgaagtgaggaacatagggcatggagacaagaaagacgaaccatggtgggcctgtcatcaaaacacaagatgacttgatcagtgtggtgaaaaagattgcatgggtggcctctggtcaccatgcagctgtaaattttggacaatacggatatggaggatactttccaaaccgaccaaccacaacaaggataaaaatgccagtggaagagccaacagaggaagagctaaaagagttctatgagcagccagagaaagtgttgcttaatacattcccatcgcagaagcaggcaacgacagtgatggtaactctggatcttttatcgactcattcaccagatgaagagtaccttggagaagagccagaagcattttgggccaacgaacctgtcatctatgctgcatatgaacgattcaaaggcaggcttcaatatctagaaggtgtgatagatgagaggaacgtgaacgtttctctaaagaatagagctggagctggtgttgttaagtacgagcttttgaaacccatctctgaaccaggtgttactggaatgggtgttccctatagtgtttctatctaataatatatatttattttgaattagtatgtgtttcttct

SEQ ID NO: 807 - DNA, 2656 bp, Brassica napus
attttgacaggacgtcgagacaacccgtgtcgtcgtcaaaacttccgtggacgatgtaagatcacagcctcacagtccaatattgcacagaaaggtaaattactgaaagagaaagttaagagaatcaaagttaagggattcataactgctgaagaagggctgctggagagcttaagttggtcgagacctctcgatgtcattacagatatccgcggcagatcactgctcgtcgagcttattagcgccgagactgacacccggacggttatggaggaggatccagtagaagactatgcacaacgtgtatggttcgaatcccgtaatgagaagtacgagtgcgtgttcgacatgcccgaagactttggaactgtgggggccatcagggtacaaaaccagcaccatagagaaatgttcatcagggagatgaagcttgagttacccagcggctccgtaacgtttacatgtaactcatgggtgacccccaagtccattgacccaaccaagcggatatttttctccaacaagtcctacttgccatccgcaactccggagcctctcaaaaagctgcggaaggaagagctggagaccttgcaaggcaacaaccgcgagcgagttggtgaattcgccaagcacgaacgcgtttacgactatgatgtgtacaacgatgtgggtgaccctgaaaaagatgaaagacttgcccgtcctgttatgggaggtctctcttatccgtacccgagacggtgcaagactggtcgcaaaccctgcgagaaagatgcctcctcagagaaacgcgaaggggagttctatgtccccagagacgaggagttctctacaacaaagggcactgcattcacgggcaaggccatcttagcagctcttccctccgtgttcccacagatcgaggctgctctgcttgatcccaacttgcctttcccacacttcaagtccatagaagatctctatcaagttggcatcgacattcccaaggacgctggccttttacctatgatccccaaacttatcaaagttgttgctgaagctcaagacaatcttctacagtttgagccccctattcttcttaacaaggatagattttcgtggatccgagacgacgagtttgctcgccagacacttgcaggccttaatccatattgcattcagctagttacagagtggccgttgaaaagcaaactagaccccgcggtttatggtgatcccaagtcactcattacttgggacattgtggaaaaagaaatcagaggagtcatgtcagttgatgaaggcctaaagaataagagattattcatgttggattaccacgatttgcttctaccgtctgtgaacaaagtgagagagttggatgacaccaccttatatgcttctagaacactattcttcctcagcgatgatagcacattgaggcccgttgccattgagttgactcgtccccctgatgtcaacaggccccaatggagtcaggtcttcacaccaggctatgatgctacctcctgctggctatggaatcttgctaagactcacgctgttgctcacgatgccggttatcatcagcttatttctcactggctgaggactcattgttgtatggaaccatacataatagctgcaaacagacaactaagtgccatgcatcctatctataggctgttgcatccccacttccgctacaccctggagatcaacgctcgcgcacgtcaaagtctcgtcaacgcaggtggaatcattgagacttgtttctggccaggcaaatattcgttagagctaagttcagatgtttatgctaaactatggaggttcgacagggaaggtttacctgcagacctcatcagcagggggctggctgtggaagatgagaccgcagaacacggactgcggctaacgataccagactacccatttgcgaatgacggtttaatgttgtgggatgcacttaaggaatggatcacagaatatgtgaagcattattatccagatgcggcactgatcatgtgtgacgaggaactccaagcatggtggagtgaagtgaggaacatagggcatggagacaagaaagacgaaccatggtggcctgtcctcagaacacaagatgacttaattggcgtcgtgaccacgattgcgtgggtggcttcaggtcaccatgcagctgtaaactttggacagtacgggtatggagggtactttcccaaccgaccaaccacaacaaggataagaatgccagtggaagagccaacagaggaagagctaaaagagttctatgaggagccagagaaggtgctgcttaagacattcccgtcgcagaagcaggcgacgcaagcgatggtgactctcgatcttctatcgacccattcaccagacgaagagtatcttggagaagagccagaagcatcttgggtcgacgatcctgttatctttgctgcatatgaacggttcaaaggcaggctcaaacatctagaagaagtgatagatgagaggaacgtgaacgtttctctgaagaacagagctggagcaggtgttgttaagtatgagcttttgaagcccatctcccaacccggtgttaccggaatgggtgttccctatagtgtttctatctaaatgcattattgtttctctagaaaaaaaaaaagtgaacgatccattt

SEQ ID NO: 808 - DNA, 2847 bp, Arabidopsis lyrata
tatttttaaacgttgtgtaattctttaataaaatatatatattattttcttacagctgtatcaacaaaaataatttcaaacttgtataaatagatgaagtggagatgtagaggaattgtaagccagatagaagagataaaaagatgttttgtagagagtccttgtcgagtctccaaaccttgagcgtagcaaagagtctcagctctttgttccctaaacaatcagcactcatcaacccgatttccaccggacgtcgaaacaacttgcctcgtccgaacctcagaagacgatgtaaggtcaccacttcacggtctaatattgaacaggaaggtaacatagtgaaagaacccattcagaaaatcaaagtaaagggatacataacagcccaagaagagtttctggagggcataacttggtccagaggtctagatgacatcgctgatatccgtggcagatcattgcttgtcgagcttattagcgccaagagtgaccagcggattacggtagaagactatgcacaacgtgtatgggccgaagcccccgatgagaagtacgagtgcgagtttgagatgcctgaagactttggacccgtgggagccatcaaggttcaaaaccaataccatagacagttgttcctccaagggatggagcttgagttacccggcgggtcggttacgtttacatgtgagtcatgggtggcccctaagaacgttgacccaaccaagaggatattcttctccaaccagtcttacttgccttccgaaacaccggagcctcttaaaaagtatcgaaaggaggagctagagaccttacaaggcaagaaccgcgagcaagttggtgaatttaccaagtttgagcgcatttacgactatgatgtgtacaacgatgtgggtgatcctgacaatgatcctgaacttgctcgtcccgtcattggaggcctccaacatccgtatccaaggcgttgcaagactggtcgcaaaccttgtgagactgacccttcctcagagcaacgctacgggggagagttctatgtcccaagagacgaggagttctctacagccaagggcacttcattcacaggaaaggccgtcttggcagctcttccctccgtcttcccgcagatcgaatctgttctgttggatccccaatcgccatttccacatttcaaggccatacaaaatctctttgaagaaggtatccagcttcccaaggatgctggccttttacctctgctccccagaatcatcaaagctcttggtgaagctcaagatgatattcttcagtttgaagccccagttctcattaacagggatagattttcatggttacgagacgacgagttcgctcgccaaacacttgcaggccttaatccttatagcattcagctagttgaagagtggccgttaaaaagtaaactagacccggcagtttatggagatcccacctcactcattacttgggaaattgtagaaaaagaagttaaaggaaacatgacagttgatgaggctctaaagaataagagattgttcgtgttggattatcacgatttgcttctaccatatgtgaacaaagtgagagagttggataacacaaccttatatgcttctcgaacactattcttcctcagtgatgatagcacattgaggcctgttgccattgagttgacttgtcccccaaatgtcaacaagccgcaatggaaacaagtcttcacgccaggctatgatgctacgtcatgctggctatggaatcttgctaagactcatgctatctcgcatgacgccggttatcatcagcttatttcccattggttgaggactcattgttgtacggagccatacataatagcggcaaatagacaactaagtgccatgcatcctatttatagacttttgcaccctcatttccgctacaccatggagatcaacgctcgtgcacgccaaagtcttgtcaacgcaggtggaatcattgagacttgtttttggcccgggaagtattcattagagctaagttcagccgtctatggtaaactatggaggttcgacaaggaaggcttaccggcagatctcatcggaagggggctggctgtggaagatgagaccgcggaacatggactacgcctaaggataccagactacccatttgcgaatgacggtctaatattgtgggatgcacttaaggaatgggtgacagactatgtgaaacactattatccagatgatggactgatcacatcggacgacgaactccaaggatggtggcatgaagtgcggaccatagggcacggtgataagaaagacgaaccttggtggcctgtcctcaaaacacaagatgacttgattggtgtggtaactacaattgcatgggtcacctcaggtcaccatgcagcagtaaactttggacagtacggatatggaggatactttcccaaccgaccaacgacaacaaggagaagaatgccagtggaagatccgacagatgaagacctaaaagagttctatgagtcgccagaaatagtgttgcttaagacatacccgtcgcagaaacaggcaaccctagtgatggtcactttggatcttttatcaacccattcacctgacgaagagtacataggacaacaaccagaagcatcttgggccaatgaccctgttatcaatgctgcatttgaaaaattcaaaggtaagctccaatatctagaaggagtgatagatgagagaaacgtgaacgttactctaaagaatagagctggagctggtgttgttaagtatgagcttttgaagcccctctctgaccatggcgttaccggaatgggtgttccttatagtatttctatttgatctatgcattttt

SEQ ID NO: 809 - DNA, 1573 bp, Hordeum vulgare
gagaagcgaaacccgaacagacgaggccatcttccccccctcatccacgatgctcgcgacagcctcgccgcacctccacgccgcggcgcatcgcctctccctggcggcgcccgcgcgcgccgcccgctccgcgcgcctcccgttaaggcgccccctccgctacccgtcgctgcgcctgcgcgcctcggccgcggcggaggccgccccgtccgcgaaggagggggccgaggcgctggggttcgaggagatggccgcccgcacgacgcggcggtactacatgctcggcgggaaggggggcgtcgggaagacgagctgcgcggcgtcgctggccgtgcgcttcgccaacagcggccatcccaccctcgttgtctccaccgaccctgcccactcgctgagcgattcgtttgcgcaggatttgactggcggggctctcgcacctgtcgaaggtaccgattcgccattgtttgcgcttgagataaatcctgagaagtctcgtgaagagtttcggacaataaatcaaaagaatggagggaccggagtaaaagatttcatggatggcatgggcctagggattcttgctgagcagcttggggagttaaaactgggggagttattggacacaccaccaccaggattggatgaagcaatagcaatttcaaaggttatacaattcctcgaagcaccggagtatagcatgtttagccgcattgtatttgacactgctcctacgggccatacactccgattattatctttgccagacttccttgatgcatccattgggaagatcttgaagcttaggagcaagattgcttcagcaacatctgctattaagtcagtatttggacaagaagttcaacagcaggatgcagcaaacaaattggagcaactcagagaaaggatggtcaaggtgcgagagcttttccgtgatacagaatcgactgaatttattattgtgacgattccaacggtcatggcaatcagtgaatcagcgagattgcattcttccttgcaaaaggaaagtgttcctgtaaggagacttattgttaaccaagttctaccaccttcatcatcagactgtaaattttgtgctataaaaagaaaggatcaaacacgtgctttggatatgataaagagtgatccagagttgatggggttgaacataatgcaagcacctctcgtggacatggaaattagaggagttcctgctctgaagtttttgggtgatatagtgtggaagtgaccttagtttgcggaaaaaatgtgataacttcagtggaactacttgatcgatacaactgtttatccaatccaagttctttagagctactgggtagaatccagcttagcagatgtccattcctaacgtgagtaaatagcacataaaaccagagggtttcactgagctagcatatgagctttgctatacttggcagtaatacaagattggttacacagttgcattttcctcccaatgcagcccagttaccgtagtgttctgcttgtttgtctataggatcacctgtgggatttcagatccaaaactttgtgtattttttattttactatgtgg

SEQ ID NO: 810 - DNA, 1624 bp, Triticum aestivum
ccctcatccacgatgctcgcgaccgcctctccgcacctccacgccgcggcgcaccgcctctccctggcggcgcccgcgcgcgccgcccgctccgcgcgcctcccgttaaggcgccccctccgctacgcgccgctgcgcctgcgcgcctcggccgctgcggaggccgccccgtccgcgaaggagggggccgaggagctggggttcgaggagatggtggcccgcacgacgcggcggtactacatgctcggcgggaaggggggcgtcgggaagacgagctgcgcggcgtcgctggccgtgcgcttcgccaacagcggccaccccaccctcgtcgtctccaccgaccccgcgcactccctgagcgattcgtttgcacaggatttgactggcggggctctcgcgcctgtcgaaggtactgattcgccattgtttgcgcttgagataaatcctgagaagtctcgtgaagagtttcggacaataaaccaaaagaatggagggaccggggtaaaagatttcatggatggcatgggcctagggattcttgctgatcagcttggggagttaaaactgggcgagttattggacacaccaccaccaggattggatgaagcaatagcaatttcaaaggttatacaattcctcgaagcaccggagtatagcatgtttagccgcattgtatttgacactgctcctacgggccatacactccggttattatctttgccagacttccttgatgcatccattgggaagattttgaagcttaggagcaagattgcttcagcaacatcagctattaaatcagtatttggacaagaagttcaacagcaggatgcagcgaacaaattggagcaactcagagaaaggatggtcaaggtgcgagagcttttccgtgacacagaatcgactgaatttataatcgtgacgattccaacggtcatggcaatcagtgaatcagcaagattacattcttccttgcaaaaggaaagtgttcctgtaaggagactcattgttaaccaagttctaccaccttcatcatcagactgtaaattttgtgctataaaaagaaaggatcaagcacgtgctttggatatgataaagagtgatccagagttgatgggattgaacataatgcaagcacctctcgtggacatggaaattagaggagttcctgctctcaagtttttgggtgatatagtgtggaagtgaccttagtttgcgggaaaatgtgataacttcgggtggaactacttggtcgatacaactgtttatccaatccaagttctctagagctactgggtagaatccagcttagcagatgcccatccctaacgtgagtaaatagcacataaaaccagagggtttcactgagctagcatatgggatttgctatactttttttatgagaaaagggatttgctatacttgacagtaacactacaagattggttacacagttgcattatcctgccaatgcagcccagttaccgtagtgttctgcttctttgtccttataggatcacttgtgggatttcagatccaaaactttgtaaacaaaaattctatgtgcggcatgtaaatgttaatagcaatgaggagtgtttgtcgaaaaaaaaaaaaaaaacga

SEQ ID NO: 811 - DNA, 1621 bp, Triticum aestivum
ccctcatccacgatgctcgcgaccgcctctccgcacctccacgccgcggcgcaccgcctctccctggcggcgcccgcgcgcgccgcccgctccgcgcgcctcccgttaaggcgccccctccgctacgcgccgctgcgcctgcgcgcctcggccgctgcggaggccgccccgtccgcgaaggagggggccgaggagctggggttcgaggagatggtggcccgcacgacgcggcggtactacatgctcggcgggaaggggggcgtcgggaagacgagctgcgcggcgtcgctggccgtgcgcttcgccaacagcggccaccccaccctcgtcgtctccaccgaccccgcgcactccctgagcgattcgtttgcacaggatttgactggtggggctctcgcgcctgtcgaaggtactgattcgccattgtttgcgcttgagataaatcctgagaagtctcgtgaagagtttcggacaataaaccaaaagaatggagggaccggggtaaaagatttcatggatggcatgggcctagggattcttgctgatcagcttggggagttaaaactgggcgagttattggacacaccaccaccaggattggatgaagcaatagcaatttcaaaggttatacaattcctcgaagcaccggagtatagcatgtttagccgcattgtatttgacactgctcctacgggccatacactccggttattatctttgccagacttccttgatgcatccattgggaagattttgaagcttaggagcaagattgcttcagcaacatcagctattaaatcagtatttggacaagaagttcaacagcaggatgcagcgaacaaattggagcaactcagagaaaggatggtcaaggtgcgagagcttttccgtgacacagaatcgactgaatttataatcgtgacgattccaacggtcatggcaatcagtgaatcagcaagattacattcttccttgcaaaaggaaagtgttcctgtaaggagactcattgttaaccaagttctaccaccttcatcatcagactgtaaattttgtgctataaaaagaaaggatcaagcacgtgctttggatatgataaagagtgatccagagttgatgggattgaacataatgcaagcacctctcgtggacatggaaattagaggagttcctgctctcaagtttttgggtgatatagtgtggaagtgaccttagtttgcgggaaaatgtgataacttcgggtggaactacttggtcgatacaactgtttatccaatccaagttctctagagctactgggtagaatccagcttagcagatgcccatccctaacgtgagtaaatagcacataaaaccagagggtttcactgagctagcatatgggatttgctatacttcttttatgagaaaagggatttgctatacttgacagcaatacaagattgcttaaacagttgcattatcctgccaatgcagcccagttaccgtagtgttctgcttctttgtccttataggatcacttgtgggatttcagatccaaaactttgtaaacaaaaattctatgtgcggcatgtaaatgttaatagcaatgaggagtgtttgtcgaaaaaaaaaaaaaaaacga

SEQ ID NO: 812 - DNA, 1887 bp, Setaria italica
ggcagctcgtggctgcgccggtgcttcgcggtggtgcgagaccgagagcgcagaagagcctcgtcgctagaagcgaagagaagagaagagaaacccaagcaatccgcctcatcccccgctcgccacgatgctcgcgaccgccacgccgggcctccacgccgccgtgcgccgcctcacgctggcggcgcccgccgccgcggcgcaggtccgctgcgtcgtacgcctcccacaacggcgcccgggacgttccgcctctctgcgcgcggtggcgtcggcggctgcggcggaggccgccccgcccgcgaaggatggggcggaggagctgggattccaggagatgacgtccgggacgcggcggcggtactacatgctcgggggaaagggtggggtcgggaagacgagctgcgcggcgtcgctggccgtgcgcttcgccaacgacggccacccgaccctcgtcgtctccaccgaccccgcgcactcgctgagcgactccttcgcgcaggatttgactggcgggtcgctcgtgcaggtagagggtcctgatgcgcccctgtttgcgctcgagataaatcctgagaaggctcgagaagagtttcggacagcaagtcaaaagaatggaggaactggggtaaaagatttcatggacagcatgggccttggagtgcttgttgagcagcttggggagttaaaattgggtgagcttttggacacgccaccaccaggattggatgaagcaatagcaatttcaaaggttatgcaatttcttgaagcacaggagtacagcatgtttagccgcattgtatttgatactgcccctacgggacatacacttcggttactatcattgccagacttcctggatgcatccattggaaagatcctgaagctgaggagcaagattgcttctgcgacatcagctattaaatcagtatttggacaagaggttcaacagcaggatgcagccaacaaattggagcaactgagagaaaggatggtgaaagtgcgagagctttttcgtgacacggaatcaacggagtttataattgtgacaatcccaacggtgatggcaatcagtgagtcatcaagactacattcttcattacaaaaggaaagtgtacctgtaagaagactcattgtgaaccaagttctaccaccttcaacatcagactgtaaattttgtgctataaaaagaaaggatcaaacacgtgccttggacatgataaggagcgatccagaattgatgggtttgaacattatccaagcaccgcttgtggacatggagatcagaggtgttccggctctcaagtttttgggtgatattgtgtggaagtagcttctgtaaggaaagtatagtcacttgagggtgcttaatagctcaatttgactgttagcccgttgagagctgctgcccagtcaagctgcttcgcaaagtatggacacttagcagttgagccagctatcagcttgggcagttgggcagttcttcacagtttggatgctggtagcatacgccaatactttaaatctgagtaaatggcctccaactggagggaattgctgcactagcgtatgatacatttagcagtgaggctggattggatttatttccagatcatgtcaactgagctgagatgcgtagcttctttatcccttagatagtgatacatatgcccttttggctccatgacttcggtaaaactttgttcctctatatgaatcatgtaaattttatacaagaggtgagttttctcccctccttttcctgctgcaattgttcaggatccttaacctcggtttctttgcatagagccttgaggatttgggatcgctgatgtgtatagcaggccagccgggtcaccatctgagcaatgcttgctattggcacgg

SEQ ID NO: 813 - DNA, 2056 bp, Sorghum bicolor
aattccagccggcccaaactcttggcctgccacggacgactgcgctatttcttcctgatgtgggctcgtgacacagcccgggtggctggttgggctgcctcgggccttgcggcgttggcgtggcagctcgtggctgcgccggagccccgcggtggtgcgagaccgagagccgagaagcgaagcgaagcgaagagaagagaaaccaagcaatccgccgcctcatccccggctcgcccacgatgctcgcgaccgcctcgccgcacctgcaggcggcggccgcgcgccgcctctctttagcggtgcccgtgaatcagggctgcagcagcgtccgcctcccgcgccgacggcccggccggtacgcgtcggtgcgcgcggcgtcggcgtcggcgtcggcgtcggcttcggcggccgccccgccagcgaaggagggggcggaggacctggggttccaggagatgtcgtccgggacgcggcggcggtactacatgctcgggggcaaaggtggggtcgggaagacgagctgcgcggcgtcgctggccgtgcggttcgccaacaacggccacccgaccctcgtcgtctccaccgaccccgcgcactcgctcagcgattccttcgcacaggatttgagtggtgggacgctcgtgcaggtcgacggccctgattcacctctgtttgcgcttgagataaatcctgagaaggcccgggaggagtttcggacagcaaatcaaaaaaatggagggactggggtaaaagatttcatggatagcatgggccttggtgtgcttgctgagcagcttggagagctgaaattgggggaattgttggacacaccaccacctggcctggatgaagcaattgcaatttctaaggttatgcaatttctcgaagcacaagaatacagcatgtttagccgcattgtatttgacactgcccctacgggccatacactccggttactgtccttgccagatttcttggatgcatccattgggaaaatcttgaagctaaggagccagattgcttctgcaacatcagctattaaatcagtatttggacaagaggtccaacagcaggatgcagcgaacaaattagagcagctcagagaaaggatgctcaaagtgcgagagctttttcgcgacacggaatcaacagagtttataattgtgacaatcccaacggtgatggcaatcagtgagtcatcaagacttcattcttcgctgcaaaaggaaagtgttcctgtaaggagactcattgtgaaccaagttcttccgccatcaacatctgactgtaaattctgtgctataaaaagaaaggatcaaacacgtgcactggatatgataaggagcgacccagagttgatggatttgaacatcatccaagcacctcttgtggacatggagattagaggtgttccggctctcaagtttttgggtgatatagtttggaagtaacttcagttgtgggaaacagtatcagttataagggtgcttaattgccaatatcactgttagcctgctgcacaattgcactgctctgaactaacaatctgtgggcgcttctggtataagcttgagaagttgtttgcagctcctacaatacaggaacatacccccgtacattaaatctgagtagaaagcaccgaattggagggttttgctgcacgcctgcaccttcctttgatgacctgttactcttggcagtgatgtactgatgtcagattggatttagccccaaaaaggctaattgaactgaaatgctgtaatgtttatccgtttagacattatccccaagatagatagcaacacttatggcctcgacgactctgtagaactcttcgttttttccatatgtgccatgtgaattttgtacaagaaatgaattttctttctccctcactggtgcagttattcaggatatttaagctttggttttacagtatctaccttgcattgcaatgatgcttgggtttggcagtccgggctgcacattaatgtgatctgacacaaagaacagtaaaaacacacaacagccttgtttagttccgaaatgtgaaaac

SEQ ID NO: 814 - DNA, 1804 bp, Sorghum bicolor
ccccgcggtggtgcgagaccgagagccgagaagcgaagcgaagcgaagagaagagaaaccaagcaatccgccgcctcatccccggctcgcccacgatgctcgcgaccgcctcgccgcacctgcaggcggcggccgcgcgccgcctctctttagcggtgcccgtgaatcagggctgcagcagcgtccgcctcccgcgccgacggcccggccggtacgcgtcggtgcgcgcggcgtcggcgtcggcgtcggcgtcggcttcggcggccgccccgccagcgaaggagggggcggaggacctggggttccaggagatgtcgtccgggacgcggcggcggtactacatgctcgggggcaaaggtggggtcgggaagacgagctgcgcggcgtcgctggccgtgcggttcgccaacaacggccacccgaccctcgtcgtctccaccgaccccgcgcactcgctcagcgattccttcgcacaggatttgagtggtgggacgctcgtgcaggtcgacggccctgattcacctctgtttgcgcttgagataaatcctgagaaggcccgggaggagtttcggacagcaaatcaaaaaaatggagggactggggtaaaagatttcatggatagcatgggccttggtgtgcttgctgagcagcttggagagctgaaattgggggaattgttggacacaccaccacctggcctggatgaagcaattgcaatttctaaggttatgcaatttctcgaagcacaagaatacagcatgtttagccgcattgtatttgacactgcccctacgggccatacactccggttactgtccttgccagatttcttggatgcatccattgggaaaatcttgaagctaaggagccagattgcttctgcaacatcagctattaaatcagtatttggacaagaggtccaacagcaggatgcagcgaacaaattagagcagctcagagaaaggatgctcaaagtgcgagagctttttcgcgacacggaatcaacagagtttataattgtgacaatcccaacggtgatggcaatcagtgagtcatcaagacttcattcttcgctgcaaaaggaaagtgttcctgtaaggagactcattgtgaaccaagttcttccgccatcaacatctgactgtaaattctgtgctataaaaagaaaggatcaaacacgtgcactggatatgataaggagcgacccagagttgatggatttgaacatcatccaagcacctcttgtggacatggagattagaggtgttccggctctcaagtttttgggtgatatagtttggaagtaacttcagttgtgggaaacagtatcagttataagggtgcttaattgccaatatcactgttagcctgctgcacaattgcactgctctgaactaacaatctgtgggcgcttctggtataagcttgagaagttgtttgcagctcctacaatacaggaacatacccccgtacattaaatctgagtagaaagcaccgaattggagggttttgctgcacgcctgcaccttcctttgatgacctgttactcttggcagtgatgtactgatgtcagattggatttagccccaaaaaggctaattgaactgaaatgctgtaatgtttatccgtttagacattatccccaagatagatagcaacacttatggcctcgacgactctgtagaactcttcgttttttccatatgtgccatgtgaattttgtacaagaaatgaattttctttctccctcactggtgcagttattcaggatatttaagctttggttttacagtatctaccttgc

SEQ ID NO: 815 - DNA, 1782 bp, Zea mays
gtcctccgcggtggttctagaccgagacccgagagagtcagaagcgaagcggaacaaagagaggagaaaccaagcaatccgcctcatcccagctcgtcacgatgctcgcgaccgcctcgccgcaccttcaggcggccgcgcgccgcctcttcctggctgtacccgtgaatcagggctgcagtagcatccgcctcccgcgcagatgcttcggccggtacgcgtcggtgcgcgcggcgtcggtgaccgccccgcccgcgaaggagggggcggacgacctggggttcctggagatgtcgtccgggacgcggcgacggtactacatgcttgggggcaagggtggggtcgggaagacgagctgcgcggcgtcgttggccgtgcggttcgccaacaacggccacccgaccctcgtcgtctccaccgaccctgcgcactcgctcagcgattccttcgcacaggatttgagtggcgggacgctcgtgcaggtcgagggccctgattcacctctgtttgcgcttgagataaatcctgaaaaggcccgggaggagtttcggacagtaagtcaaaaaaatggaggaacaggagtaaaagatttcatggatagcatgggccttggggtgcttgttgagcagcttggagagttaaaattgggggaattgttggacacaccaccacctggcttggatgaagcaattgcaatttctaaggttatgcaattccttgaagcacaagaatacagcatgtttagtcgcattgtatttgacactgcccctacgggccatacactccggttattatccttgccagatttcttggatgcgtccattgggaaaatcttgaagctgaggagtaagattgcttctgcaacatcagctattaaatcagtatttggacaagaggtccaacagcaggatgcagcgaacaaattagagcaactcagagaaaggatggtcaaagtaagagagcttttccgcgacacggaatcaacagagtttataatcgtgacaatcccaacggtgatggcaatcagtgagtcatcaagactgcattcttcgttgcaaaaggaaagtgttcctgtaaggagactcattgtgaaccaagttctgccaccttcaacatcggactgtaaattctgttctataaaaagaaaggatcaaacgcgtgcattggatatgatacggactgacccagagttaaaaggtttgaacattatccaagcacctcttgtggacatggagattagaggtgttccggctctcaattttttgggtgatatactgtggaagtaacttcagttatgggaaacaggatcgcttataagggtgcttaattggccaatatcactgttagcctgctgcacaattgcactgctctgcaactagcaatctgtgggctcttctggttgtttccagctaacaattgcacaataagcttaagttgtttccagctacaatacagcacaacacattctccatggtgcgttaaatctgagtagaaagcaccaaattggagggttttgctgcactcctgcactagcatttgatgacctgttactcttggcagtgatgcagattggatttagccccaaattaggctaattgaagtgaaatgctgtaatatttatccttttatcaattatccccaagattaatagcaacacttgtggccttttggttcggcgactttgtaaaactcttcgtttcttatgtgccatctcaattttgtacaagaaatgtgttttctcttctccctcactggggcagttattcaggatattttaagctt

SEQ ID NO: 816 - DNA, 1984 bp, Oryza sativa
cggtgtcgccgtgagagaacggagaagcggagaaaccgacccgtctccgcctcatccaccgctccgccacgatgctcgcgaccgccgccccgcgcctccgcgccgccgcgtggggcagcctctcgccgccggcgccagtgcgggcgcagttcgtgagtctcccgctcagtctccccggccgctacgcctcgctgcgcctgcgcgcctcggcggcggcggcggcgaaggaaggggcggaggagatggggttcgaggagatggcggccgggacgcggaggcgctactacatgctcggcgggaagggcggggtcgggaagacgagctgcgcggcgtcgctggccgtgcgcttcgccaacaacgggcaccccaccctcgtcgtctccaccgaccccgcgcactccctcagcgactccttcgcgcaggatttgagcggcggggcgctcgtgccggtcgaggggcctgaggcgccattgtttgcgcttgagataaatcctgagaaagcccgagaagagtttcgtgcagcaagtcagaagaatggagggactggggtaaaggacttcatggatggcatgggactgggagtgcttgctgagcagctgggggagttaaaactgggggagttattggacacaccaccaccaggattggatgaagcaatagcgatttcaaaggttatgcaattccttgaagcacaagagtatagcatgtttagacgcattgtttttgacactgctccaacgggccatacactccgtttattatccttgccagatttcctggatgcatctattgggaagatcttgaagcttaggagcaagatcgcttctgcaacatcagctattaaatcagtttttggacaagaagttcaacagcaggatgcagcaaacaaattggagcagctgagagaaaggatggtccaagtgcgagaactttttcgtgacacagaatcaactgaatttataattgtgactattccaacagtgatggcaataagtgaatcagcaagactacattcttccctaagaaatgaaagtgttcccgttaagagactcattgttaaccaaattctaccaccttcgtcatcagactgtaaattctgtgctataaaaagaaaggatcaaacacgtgctttggatatgataaggaatgatccagagctaatggggctgaacttaatccaagcacctcttgtcgacatggaaataagaggcgttcctgctctgaagtttttgggcgatatagtatggaagtaacttcacaatggaaaatacgataaacttcatcacacctacttattgaagtgctttgcaatgcaaactttggtagctgcaagtatcagcatggatagagctagaatgcaagtgtgcaacttagcagatgcccaatctcatgtgagtaagtagcatctcgctgaaggtttgccggaatagcatatactagggggattgtgttctaaaaaaaaagggggggggattggatcaagctgcactaatatcaagtccattgaggcaacatgccggtgatatttctgcttctttatccctttaataggagcgattctgagggttttgagtccataactttgcactaaaattaattttgttcgtgcatcatgtaaagtcggttagagaatgaagaatggagaaaatcagacaacacttttaagtaaattttcttacagattagtgtgacttaaatgtaaatagacaatattgacaagacagctgcagcagttgagattttaatttaagtagctgaaaattctaggaaaaactatcctacggggtaagtttttcaaacagaggtaggggtagtatacacaatggacgttgcagtactgataaaccagtgactggggtagtaatcttcctttctgtctttcgtagtactacaagacggttgaagatcttttccatcctatcgagatgtactactccacttctgttctgtgcaggttgaatatatgtggcccaatcacatcttg

SEQ ID NO: 817 - DNA, 1740 bp, Oryza sativa
cacgatgctcgcgaccgccgccccgcgcctccgcgccgccgcgtggggcagcctctcgccgccggcgccagtgcgggcgcagttcgtgagtctcccgctcagtctccccggccgctacgcctcgctgcgcctgcgcgcctcggcggcggcggcggcgaaggaaggggcggaggagatggggttcgaggagatggcggccgggacgcggaggcgctactacatgctcggcgggaagggcggggtcgggaagacgagctgcgcggcgtcgctggccgtgcgcttcgccaacaacgggcaccccaccctcgtcgtctccaccgaccccgcgcactccctcagcgactccttcgcgcaggtcgcctcccccgtcgagcacctgctgtctcggttcgaggatttgagcggcggggcgctcgtgccggtcgaggggcctgaggcgccattgtttgcgcttgagataaatcctgagaaagcccgagaagagtttcgtgcagcaagtcagaagaatggagggactggggtaaaggacttcatggatggcatgggactgggagtgcttgctgagcagctgggggagttaaaactgggggagttattggacacaccaccaccaggattggatgaagcaatagcgatttcaaaggttatgcaattccttgaagcacaagagtatagcatgtttagacgcattgtttttgacactgctccaacgggccatacactccgtttattatccttgccagatttcctggatgcatctattgggaagatcttgaagcttaggagcaagatcgcttctgcaacatcagctattaaatcagtttttggacaagaagttcaacagcaggatgcagcaaacaaattggagcagctgagagaaaggatggtccaagtgcgagaactttttcgtgacacagaatcaactgaatttataattgtgactattccaacagtgatggcaataagtgaatcagcaagactacattcttccctaagaaatgaaagtgttcccgttaagagactcattgttaaccaaattctaccaccttcgtcatcagactgtaaattctgtgctataaaaagaaaggatcaaacacgtgctttggatatgataaggaatgatccagagctaatggggctgaacttaatccaagcacctcttgtcgacatggaaataagaggcgttcctgctctgaagtttttgggcgatatagtatggaagtaacttcacaatggaaaatacgataaacttcatcacacctacttattgaagtgctttgcaatgcaaactttggtagctgcaagtatcagcatggatagagctagaatgcaagtgtgcaacttagcagatgcccaatctcatgtgagtaagtagcatctcgctgaaggtttgccggaatagcatatactagggggattgtgttctaaaaaaaaagggggggggattggatcaagctgcactaatatcaagtccattgaggcaacatgccggtgatatttctgcttctttatccctttaataggagcgattctgagggttttgagtccataactttgcactaaaattaattttgttcgtgcatcatgtaaagtcggttagagaatgaagaatggagaaaatcagacaacacttttaagtaaattttcttacagattagtgtgacttaaatgtaaatagacaatattgacaagacagctgcagcagttgagattttaatttaagtagctgaaaattctagg

SEQ ID NO: 818 - DNA, 1435 bp, Secale cereale
ccccctccgctacgcgtcgctgcgcctgcgtgcctcggccgcggctgaggccaccccatcggccaaggagggggccgaggagctgggggttcgaggagatggcggcccgcacgacgcggcggtactacatgctcggcgggaagggaggcgtcgggaagacgagctgcgcagcgtcgctggccgtgcgcttcgccaacagcggtcaccccaccctcgtcgtctccaccgaccccgcgcactccctgagcgattcgtttgcacaggatttgactggcggggctctcgcgcctgttgaaggtactgattcaccattgtttgcgcttgagataaatcctgagaagtctcgtgaagagtttcggacaataaaccaaaagaatggagggaccggggtaaaagatttcatggacggcatgggccttgggattcttgctgagcagcttggggagttaaaactgggtgagttattggacacaccaccaccaggattggatgaagcaatagcaatttcaaaggttatacaattcctcgaagcaccggagtatagcatgtttagccgcattgtatttgacactgctcctacgggccatacactccggttattatctttgccagacttccttgatgcatccattgggaagatcttgaagcttaggaacaagattgcttcagcaacatcagctattaaatcagtatttggacaagaagttcaacagcaggatgcagcgaacaaattggagcaactcagagaaaggatggtcaaggtgcgagagcttttccgtgacacagagtcaactgaatttataatcgtgacaattccaacggtcatggcaatcagtgaatcagcgagattacattcttctttgcaaaaggaaagtgttcctgtaaggagactcattgttaaccaaattctaccaccttcatcatcagactgtaaattttgtgctataaaaagaaaggatcaaacacgtgctttggacatgataaagagtgatccagagttgatggggttgaacataatgcaagcacctctcgtggacatggaaattagaggagttcctgctctcaagtttttgggtgatatagtgtggaagtgacatcagtttgcggaaaaatgtgataacttcagtggaactacttggtcgatacaactgtatccaatccaagttctctagagctactactgggtagaaaaattagcggatgcccatccctaacgtgagtaaatagcacataaaaccagagggtttcactgagctagcatatggggtttgctatacttgacagtaatacaagatcggttacatagttgcattatcctgccaatgcagcccagttaccgtagtgttctcctttctccttagaggaacaactgtgggatttctgatccagaacttctgtaatttttgttttctatgggcggcgagtaaatgtttat

SEQ ID NO: 819 - DNA, 1472 bp, Brachypodium distachyon
tgtcaaacacaagtacacaaactcttttcgcgtcccctgttcccttctgatcatatcatactctggctcagctccccaccgaccccgccgtccccgccacgccacctctcccccacccggcggcgaccagtccgccatcgcccccatgccgctcccgacgatgacccactcctcctccttcctcctcccgtccccgcccgccgaagccgccgccgccgccgacgcggtcgcctacgccgtcatcgtcctcaaccagcgcctcccccgcttcgcctccctgctctggacccgcgcgcagctgagggtgtgcgcggacgggggcgcgaaccggctgttcgacggcatgccggagctgcaccccggcgaggaccccgacgaggtccgcgcgaggtacaagcccgatgcaatcaaaggagatatggactctataagaccagaagtgaaggaattctattccaatttgggcgccaaaatagttgacgaatcacatgatcaggacaccactgacttgcacaaatgcatatcgttcatcaccagaaatccacctggccccgacaaggctaatctgtgcattcttgtccttggtgcacttggtggaaggttcgatcacgagatggggaacatcaatgtattatatcgcttctcaaacatcaagatcatcctcctgtcagacgagtccttgatctttctgctcccaaagacacacaatcatgagatccttgtcgatcaatcgatcgagggtcctcattgtggattgatccccatgggcatgccctcaagcagcagcaccaccactgggctacggtggaatttagataataccagcatgagttatggtgggctggtaagcacatcaaacatcgtggatgacaagaaagtaatggtgacttcagattctgatcttatctggacaatatcacttcgaaaccacacttaaattgtagtatatttgttccatcatggaccgtgctctaaattttggctcgtcaaatttgcgtcgatggattttacatttttaacccctctgtgatgatatcatcttcgactccactttccaattgataccagtaaacccgatccacgaatccattccacattgccaaaatgaggcatatatgttgtatggtttgagaaagttcattagttctttgcacatttatgtactacactttcagggggtttataagtgtgatgacatgatgcttacttgcattttgttgcctttgtgcgcctcgtggtggtgtaattgcagtttgttcggaaaaaaaaatactgaatgtgtgatgcaaatttacaatacttgtgtagagcattctaaagaataatatttgtactagaatgtgtaggattatgacacatgtcacacgtctcatggtcatgtacaattaatgtaataccttataaactagtattagcccctcaccttttcatataaaagcatgcaaggcttgcaaccttgcataaaaccaaaa

SEQ ID NO: 820 - DNA, 2235 bp, Brachypodium distachyon
gcggtccctgttcctaattgctgcacttgttgtttcacctttaccccccgcggattttctcgccaatcacaaaccacgcctccgcctctttcttcctcgtctccccactcttcgccccgcgactcgcagcctcccacgccgcttctcttctgcggccttgtagaaccttcctttgggttagggttccggctctgacggcggtgaagatgtctactcatgcgggggccgtggcgcgggagcagcgtaggtgaggcgtcgtcgcgcgtgctggattggaggaagagagcacggatggatccggacttctcgagggccagcggaggcccgagctacgaattcgccttcaactcggtcaacttctccgaccgggtcctgcggatcgagatcgtcgccggggacgacacagcgggggccaaaggtgccaccggcgagggatgctcgtccatcgccgactgggcacggcaccgcaagcgccgcagggaggagctacggcgagagaaagaatctggaaagcatatgttggacctaacaaacgtcaaagtcaaagcagaagaacctgatacctatgaggaaatcaacgaggagcctgtagctatgattgaagaatctccacctgatattggacaagatggtgaggatggaggaagcagtgactcatcctggaatatggagtgtaatagtgttttaagagtaaaatctatttatatcagctctgcaattctagctgcaaaaagtccttttttttacaagcttttttcaaatggcatgaaagaatctgatcagaggcacgcaacccttagaataactgcttcagaggaaaatgcccttatggagcttttaagctttatgtacagtggaaagttgacgacaaatcagccaacccttctgcttgacatcttgatgatttctgacaaatttgaagttgtttcttgcatgagacactgcagtcagttgctaagaagcttgcctatgaccacagaatctgcacttctctatcttgatctgccttccagcatttcaatggctgcagcagttcagccactcactgatgctgccaaggaattcctctccaacaagtacaaggatttaaccaagtttcaggatgaagccatgaacatcccccttgctgggatcgaagccattctgtggagtaatgaccttcaggtggcatcagaggatgcaatttatgactttgtgatcaaatgggctcgcgctcaatacccaaaattggaggaaaggcgtgaaatcttgggtacccgcttgctgccacttgttcggttctgtcatatgacctgcaggaagttgcggaaggtccttgcatgcaatgatctggatcatgagcaagcaactaaaagtgtgaccgatgcacttctgtacaaagctgatgcaccacatagacagcgcacgcttgctgcagatgtgttgacctgtaggaaatattgtgaacgagcttataaataccgtccacttaaggtggtggagtttgatcgaccatatccgcagtgcatagcgtacttggatctgaagcgtgaggagtgtacacggcttttcccgtctgggcggatatattcacaagcatttcatcttgctggacagggattcttcctctcagcacactgcaacatggatcagcaaagcgctttccactgctttggtctcttcttagggatgcaagagaaaggctcaacgagtgttaccgtggactatgagtttgctgcaaggacaaggccatcaggcgagttcgtcagcaagtacaaaggctactataccttcaccggtggaaaggcagttggttaccgaaatctatttgccatcccatggccatcatttatggctgatgacagcctctttttcatcaatggagtactgcacctgagagcagagttgaccataaagcaaccctaggtaatgcgtggtgtgctactaacttcgcatgtatgcttgctcatctccgaatttgtgcaatgatggggcttagggttgaatcttctgttgttcaaagcttgacgatgtctttacttgagcaccaaactgaacattttttaaacgagaaggaaaatcccttttgtttttacatcaaaagaggactgtctgttgtgcattagataatggtctgttctccggatgaaaaaatccatgtggaaattattttctgaaccaggtgcgtggcctttggatcaaggggcatgtttggatgaagctcaacctaccgtgtttcatgtaatttagaaagga

SEQ ID NO: 821 - DNA, 2220 bp, Oryza sativa
cgcttcgtcgtctcgtctttgcgattcgtccgcttttgcagattggcccctcgggttcgcgcgtatttacgaccacgcccccctccgcctcttcttcctcgcctccgcgggctccttctccttctggaagctgctgctgctgctctcgctagggttagggtttcggcgatggaggcggcggtggcggtggaggtggagaggtgaggagaggaggtcgcgggcgcacgagtgcggtttggttgattggaaggggaggagaggggggatggacccggacttctcgcgggcgagccgaggcccgagcttcgcgttcgccttcaactccgtcaacttctccgaccgggtgctgcggatcgagatcgtcgccggggacgacgcggcgggggccaagggcgccgcgggggaagggtgctcctcgctcgccgactgggcgcaccagcggaagcgacgccgggaggagctccgccgcgagaaagaatcaggaaaatacacggatctggaaacctgtaaagttgaagcagaagaatgtgatacctatgaggaaaataatgaggaacctgtagctatgatagaagaatctccaccagatattggacaagatggtgaggatggagacagctgcgattcatcctggagtatggagtgtacccaagtcttgagagtaaagtctatttacatcagttctgcaattctagctgcggaaagccctttcttttataagcttttctcaaatggcatgaaagaatctgatcagaggcatgctactcttagaataactgcttcagaggaaaatgccctcatggagcttttgagctttatgtatagtggaaagttgacaacaaatcagccaacccttctgctggatatcttgatgattgctgataaattcgaggttgtttcttgcatgaggcattgcagtcaattactaagaagcttgcctatgactacagaatctgcactgctctatctagaccttccttcgagcatttcaatggctgctgcagttcagccactgactgacactgccaaggcattccttgccaacaagtacaaagatttgaccaagcttcaagatgaagcgatgaatattcctctggctggtattgaagccatcctatggagtaatgatctgcaggtggcatcagaggacgccatctatgattttgtgatcaagtgggcacgttctcaatacccaaaactggaggagaggcgagagatcttgggtactcgtttgttgccactggttcggttttgtcatatgacctgcagaaagctgcggaaggtccttgcatgcaatgatctggatcatgaacaggcaactaaatgtgtcaccgaggcacttctatacaaagctgatgcaccacatcgacagcgtacccttgctgcagatgttttgacttgtaggaaatatgctgagcgagcttacaaatatcgtccacttaaggtggtggaatttgatcgaccatatccacagtgtatagcatacttggatctgaagcgtgaggagtgcagtcggcttttcccatctggacggatatactcacaagcgttccatctcgcagggcagggcttctttctctcagcacactgtaacatggatcagcaaagtgcattccattgctttggtctgttcctagggatgcaagagaaaggctcgactagtgttactgtagattacgagtttgccgcaagaacaaggccatcaggcgagtttgtcagcaagtacaagggctactataccttcaccggtggaaaggcggttggataccggaatctatttgcaattccatggtcatcgttcatggctgatgacagcctcttcttcatcgagggggtactacacttgagagctgaattaaccataaaacaaccctagatagtggacggcgtttaactaacagcgtctctgttcttgctgtgtccaaattagtgtgaaaaatgttgtgtgattcggacttactgttgttttctacttgagcaacctaaatagacagtttggaaacggcaagtaaaatcccttttgtttttacatcaaaagaggatcatgacatgtaacgcattgttatcgaactgtgaaaagtgattcttctaatcaaagttatgctgaatggtccacatcgtcaatgacattaagtgatggaagccataatagtattttcaacacaaaataaatgtaataaaacatttaatgttagatttagtgaaactaatttgtctttt

SEQ ID NO: 822 - DNA, 2221 bp, Oryza sativa
cgcttcgtcgtctcgtctttgcgattcgtccgcttttgcagattggcccctcgggttcgcgcgtatttacgaccacgcccccctccgcctcttcttcctcgcctccgcgggctccttctccttctggaagctgctgctgctgctctcgctagggttagggtttcggcgatggaggcggcggtggcggtggaggtggagaggtgaggagaggaggtcgcgggcgcacgagtgcggtttggttgattggaaggggaggagaggggggatggacccggacttctcgcgggcgagccgaggcccgagcttcgcgttcgccttcaactccgtcaacttctccgaccgggtgctgcggatcgagatcgtcgccggggacgacgcggcgggggccaagggcgccgcgggggaagggtgctcctcgctcgccgactgggcgcaccagcggaagcgacgccgggaggagctccgccgcgagaaagaatcaggaaaatacacggatctggaaacctgtaaagttgaagcagaagaatgtgatacctatgaggaaaataatgaggaacctgtagctatgatagaagaatctccaccagatattggacaagatggtgaggatggagacagctgcgattcatcctggagtatggagtgtacccaagtcttgagagtaaagtctatttacatcagttctgcaattctagctgcggaaagccctttcttttataagcttttctcaaatggcatgaaagaatctgatcagaggcatgctactcttagaataactgcttcagaggaaaatgccctcatggagcttttgagctttatgtatagtggaaagttgacaacaaatcagccaacccttctgctggatatcttgatgattgctgataaattcgaggttgtttcttgcatgaggcattgcagtcaattactaagaagcttgcctatgactacagaatctgcactgctctatctagaccttccttcgagcatttcaatggctgctgcagttcagccactgactgacactgccaaggcattccttgccaacaagtacaaagatttgaccaagcttcaagatgaagcgatgaatattcctctggctggtattgaagccatcctatggagtaatgatctgcaggtggcatcagaggacgccatctatgattttgtgatcaagtgggcacgttctcaatacccaaaactggaggagaggcgagagatcttgggtactcgtttgttgccactggttcggttttgtcatatgacctgcagaaagctgcggaaggtccttgcatgcaatgatctggatcatgaacaggcaactaaatgtgtcaccgaggcacttctatacaaagctgatgcaccacatcgacagcgtacccttgctgcagatgttttgacttgtaggaaatatgctgagcgagcttacaaatatcgtccacttaaggtggtggaatttgatcgaccatatccacagtgtatagcatacttggatctgaagcgtgaggagtgcagtcggcttttcccatctggacggatatactcacaagcgttccatctcgcagggcagggcttctttctctcagcacactgtaacatggatcagcaaagtgcattccattgctttggtctgttcctagggatgcaagagaaaggctcgactagtgttactgtagattacgagtttgccgcaagaacaaggccatcaggcgagtttgtcagcaagtacaagggctactataccttcaccggtggaaaggcggttggataccggaatctatttgcaattccatggtcatcgttcatggctgatgacagcctcttcttcatcgagggggtactacacttgagagctgaattaaccataaaacaaccctagatagtggacggcgtttaactaacagcgtctctgttcttgctgtgtccaaattagtgtgaaaaatgttgtgtgattcggacttactgttgttttctacttgagcaacctaaatagacagtttggaaacggcaagtaaaatcccttttgtttttacatcaaaagaggatcatgacatgtaacgcattgttatcgaactgtgaaaagtgattcttctaatcaaagttatgctgaatggtccacatcgtcaatgacattaagtgatggaagccataatagtattttcaacacaaaataaatgtaataatacatttaatgttagatttagtgaaactaatttggtctttt

SEQ ID NO: 823 - DNA, 2622 bp, Sorghum bicolor
cccggcgtgaagtgtatttatccagttgcccccaccggaaggtacgaatttactccgccttgttcagctgtcctttttcttcacgtgtaatttacatttacaaccccgcatttctctatatcacgacgctgccccctccacgtctccgcttcccgtgttcttgttcgtctcgtctcctcccctcgcctcaggcccctcacctctcacatacacctcgctcgctcgctcgctcccgctcccgcatcgcggtttccttttcgaagccttgctaggtttagagttgggggcctccgtctaccccgtcaatggctcctgaggcggctgtacttcagaggtgaggtgaggtgaggtgaggcgaggcgtgggggcgcgcgtggttggttggttcgaggaggcggggatggacccggacttctcgcgggcgagtggggggccgagctttgagttcgccttcaactcggtcaacttctccgaccgggtgttgcggatcgagatcgtcgctggggatgacgccctcggggccaagggcgccgccggcgaggggtgctcgtcgcttgccgactgggcgcgccaccgcaagcggcgacgggaggagctccgacgcggcaaagaatctggaaaatacatgccagacccaggaaactgcaaagttgaagctgaagaatgtgatgcctacgaggaaggcaatgagcctgtagctatgatagaagaatctccacctgatattgagccagatggtgaggatggagaaagcagcgactcatcctggagtatggagtgtactcaggttttgagagtaaagtctatctacatcagctctgcaattctagctgcaaagagccctttcttttacaagcttttttcaaatggaatgaaagaatccgatcagaggcatgcaactcttagaataactgcttcagaggaaaatgcgctgatggagcttctaagctttatgtatagtggcaagttgacgacaaaccagccaactgccctgctggatatattgatggtcgctgacaaatttgaggttgtttcctgtatgcggcactgcagtcaattgcttagaagtttgcctatgaccacagagtctgcactgctctatctggatctaccctcaagcatttcaatggctgctgcagttcagccactgacagacaccgccaaggaattccttgccaataaatacaaggatttgacgaagttccaagatgaagcaatgaacattcctcttgctggaattgaagccatcctatggagtaacgaccttcaggttgcatcagaggatgctatctacgactttgtgataaagtgggcacgtgctcaatacccaaaattggaggaaagacgtgagatcttgggcacacgcttgctgccccttgttcggttctgccatatgacctgcaggaagttgcggaaggttcttgcttgcagtgatctggatcatgagcaggcgactaaatgtgtcacagaggcacttctttacaaagctgatgcaccacataggcagcgtgcccttgcagcagatgtgatgacatgtaggaaatatgctgagcgagcttacaaatatcgtccgcttaaggttgtagagtttgatagaccatatccgcagtgcatagcatacttggacctgaagcgtgaggagtgcagccgactttttccatccggacggatatactcacaagctttccatctagctggacagggtttcttcctctcagcacactgcaacatggaccagcaaagtgcattctattgttttggtctcttcctaggaatgcaagagaaagggtcgacaagtgttacggtggattatgagtttgctgcaaggacaaggccgtcaggtgagtttgtcagcaaatataagggctactataccttcactggtggcaaggcggttgggtaccggaatctctttgcgatcccgtggccatcattcatggccgatgacagtctcttcttcatcgacggggtattgcatctcagagctgagctgaccataaaacagccctaggcgtggctgtgtactaactgcgtttgtgccgcggtgtccaaatctatgcaatgatgatctgcagtgtagagaatgaaattttctgtgcgtgctgtttttaccttttactgatgcacttaaatagacaatttgaaaacgagaactgaattctctcttgtttagttgtttttgcacctgaggaagatcatgtctctgtactcactaaactgtgaaaagtgattcagctaatcaaattttacgttggaagggcaatcctggctaagtaaacggtggtgcctttatcaatttatttaacttatttgttgaatggcagaagatgcttcgaatcggtttgcttcatgcagattggtatattttatttcttttgttgattagtatatattttgactattgttgtatttatcatcagacagaaaaaaaataaagggaattatagtaataataaatcgaggaagaagaggggtggatgataggtggggagcgtgattgagcaattaaattgcttcccactcattattgttgaagtacaaatgtaaatgaaagatggaagaatttgtgtactgcattgttctgatgcatgaatgaatatatgtatgcatggtgagggaggg

SEQ ID NO: 824 - DNA, 2318 bp, Sorghum bicolor
cgtgaagtgtatttatccagttgcccccaccggaaggtacgaatttactccgccttgttcagctgtcctttttcttcacgtgtaatttacatttacaaccccgcatttctctatatcacgacgctgccccctccacgtctccgcttcccgtgttcttgttcgtctcgtctcctcccctcgcctcaggcccctcacctctcacatacacctcgctcgctcgctcgctcccgctcccgcatcgcggtttccttttcgaagccttgctaggtttagagttgggggcctccgtctaccccgtcaatggctcctgaggcggctgtacttcagaggtgaggtgaggtgaggtgaggcgaggcgtgggggcgcgcgtggttggttggttcgaggaggcggggatggacccggacttctcgcgggcgagtggggggccgagctttgagttcgccttcaactcggtcaacttctccgaccgggtgttgcggatcgagatcgtcgctggggatgacgccctcggggccaagggcgccgccggcgaggggtgctcgtcgcttgccgactgggcgcgccaccgcaagcggcgacgggaggagctccgacgcggcaaagaatctggaaaatacatgccagacccaggaaactgcaaagttgaagctgaagaatgtgatgcctacgaggaaggcaatgagcctgtagctatgatagaagaatctccacctgatattgagccagatggtgaggatggagaaagcagcgactcatcctggagtatggagtgtactcaggttttgagagtaaagtctatctacatcagctctgcaattctagctgcaaagagccctttcttttacaagcttttttcaaatggaatgaaagaatccgatcagaggcatgcaactcttagaataactgcttcagaggaaaatgcgctgatggagcttctaagctttatgtatagtggcaagttgacgacaaaccagccaactgccctgctggatatattgatggtcgctgacaaatttgaggttgtttcctgtatgcggcactgcagtcaattgcttagaagtttgcctatgaccacagagtctgcactgctctatctggatctaccctcaagcatttcaatggctgctgcagttcagccactgacagacaccgccaaggaattccttgccaataaatacaaggatttgacgaagttccaagatgaagcaatgaacattcctcttgctggaattgaagccatcctatggagtaacgaccttcaggttgcatcagaggatgctatctacgactttgtgataaagtgggcacgtgctcaatacccaaaattggaggaaagacgtgagatcttgggcacacgcttgctgccccttgttcggttctgccatatgacctgcaggaagttgcggaaggttcttgcttgcagtgatctggatcatgagcaggcgactaaatgtgtcacagaggcacttctttacaaagctgatgcaccacataggcagcgtgcccttgcagcagatgtgatgacatgtaggaaatatgctgagcgagcttacaaatatcgtccgcttaaggttgtagagtttgatagaccatatccgcagtgcatagcatacttggacctgaagcgtgaggagtgcagccgactttttccatccggacggatatactcacaagctttccatctagctggacagggtttcttcctctcagcacactgcaacatggaccagcaaagtgcattctattgttttggtctcttcctaggaatgcaagagaaagggtcgacaagtgttacggtggattatgagtttgctgcaaggacaaggccgtcaggtgagtttgtcagcaaatataagggctactataccttcactggtggcaaggcggttgggtaccggaatctctttgcgatcccgtggccatcattcatggccgatgacagtctcttcttcatcgacggggtattgcatctcagagctgagctgaccataaaacagccctaggcgtggctgtgtactaactgcgtttgtgccgcggtgtccaaatctatgcaatgatgatctgcagtgtagagaatgaaattttctgtgcgtgctgtttttaccttttactgatgcacttaaatagacaatttgaaaacgagaactgaattctctcttgtttagttgtttttgcacctgaggaagatcatgtctctgtactcactaaactgtgaaaagtgattcagctaatcaaattttacgttggaagggcaatcctggctaagtaaacggtggtgcctttatcaatttatttaacttatttgttgaatggca

SEQ ID NO: 825 - DNA, 2443 bp, Setaria italica
cccctctccagtctccacacaacccgctcgctcctcccgcacccgcttcgcgatttccttgtcaaagctccgctagggttagggtttggcccccgtctgccccgtcgatggcttctgcgacggccgtgcgtcagaggtgaggcgaggggaggggaggcgcgtggttagttgattcgaggaggaggcagagggatggacccggacttctcgcgggggagcggggggccgagcttcgagttcgccttcaactcggtcaacttctccgaccgggttctgcggatcgagatcgtcgccggggacgacgcgcccggggccaagggcgccgccggcgagggctgctcgtcgctcgccgactgggcgcgccaccgcaagcggcgacgggaggagctccgacgcggcaaagaatcgggagcaaactgcaaagttgaagctgaagaatgtgatgcctatgaggaaggcaatgaggagcctgtagctatgatagaagaatctccacctgatattgagcaagatggtgaggatggagaaagcagcgactcatcctggagtatggaatgtactcaagttttgagagtaaagtctatctatatcagctctgcaattctagctgctaagagccctttcttttacaagcttttctcaaatggaatgaaagaatctgatcagaggcatgcaactcttagaataactgcttcagaggaaaatgcccttatggagcttctaagctttatgtatagtggcaagttgacaacaaatcagccaactctcctgctggatatattgatgattgctgacaaattcgaggttgtttcgtgtatgaggcattgcagtcaattgcttagaagcttgcctatgactacagagtctgcactgctctatctagatctcccttccagtatttcagtggctactgcagttcagccattgactgacactgccaaggaattccttgccaataaatacaaggatttgaccaagttccaagatgaagcaatgaccattcctcttgctggaattgaagccattctatggagtaatgaccttcaggtggcatcagaggatgctatctatgattttgtgatcaagtgggcacgtgctcaatacccaaaattggaagaaagacgtgagatcttgggcactcgcttgctgccccttgtccggttctgccatatgacctgtaggaagctgcggaaggttcttgcatgcagtgatctggatcatgagcaggcaactaaatgcgtcactgaggcacttctttacaaagcagatgcaccacatcggcagcgtgcccttgcagcagatgtgatgacctgtaggaaatatgctgagcgagcttacaaatatcgtccgcttaaggtcgtggagtttgatcgaccatatccgcagtgcatagcgtacttggacctgaagcgtgaggagtgtagccgacttttcccatctgggcggatatactcgcaagcattccatctagctggacagggcttcttcctctcagcacactgtaacatggatcagcaaagcgcgttctattgcttcggtctcttcctagggatgcaagagaaaggctcaacaagtgttactgtagattatgaatttgctgcaaggacaaggccatcaggtgagtttgtcagcaagtacaaggggtactacaccttcactggtgggaaggcggttggctaccggaatctctttgcaattccatggccctcgtttatggctgatgacagcctcttcttcattgacggggtactacatctgagagctgagttgaccataaagcaaccttagactgccgatggtgtgctactaactgcgtctgtgctgttgtgacaaaatctgtgcatgatgggcggcagtgtgtaaaatcttgtgttttcagacatgatgttttttactcacaactaaatagacaatttggaaacgagaactgaaaccccctttgtttttacacccaaagaggagcatgtcatgttctgcactggcattgaactgaggaaagtaattccgctgatcaaaagtgtgtaggttgaatgggctacattggctaagtactcgagaaatgaaacttctgctgaatttacttgttattcgtgttagtatatgtttttcccctggtcttccccaattggagcaggtgtttgaatggctgcagaaattcttcgaggtatttgagtgttacggaaggatttggtgtgcggtgatgtgagttgactccgagtgaggtggggaatgtgcagtcatgggacattgacattgaggtaggctgtgttgtgtcttgtgtttggtctgactggcttttgatgttatgcgccaacgaacgatcactcctccataaccatttacgcttgtggagttgtggtggtgcgggcgtagaatggtgtggtctatcattgccactaatggaacatgaggcttgcaaccgtactggtttgtgtggttggca

SEQ ID NO: 826 - DNA, 2099 bp, Secale cereale
gactcactcaccaccctctggtttcctcccctatcacacagccacgcctctctcttctccgtttcactcttgtccccgcgcccccgcttctgcggccttctgagggtagggttccggctccgacggcggcgaggatgccttctgcgggggccgcgctgcggcggaggtgaggcggcgggcgtggtgggattaggattgggattggtattggtattggaggaagggggcggtgctggtcgggatggacccggacttctcgcgggcgagcggtggcccgagcttcgagttcgccttcaactcggtcaacttctccgaccgggtcctgcggatcgagatcgtcgccggggacgacgcgccgggggccaagggcgccgccggcgagggctgctcctccatcgccgactgggcgcgccaccgcaagcgccgcagggaggacctccgccgcgagaaagaatgtggaaagtatatgtcagaaccagcaaacatcaaaattgaagcagatgaacgtgatacctatgaggaaaccaacgaggagcctgtagctatgatagaagaatctccacctgatattggacaagatggtgaggatggagaaagcagtgactcatcctggaatatggagtgtaatcaggttttgagagtgaagtctatatatatcagctctgcgattctagctgcaaaaagtcctttcttttacaagcttttctcaaatggcatgaaagaatccgaccagaggcatgcaactcttagaataactgcttcagaggaaagtgcccttatggagcttttaagttttatttacagtggaaagttgacgaccaatcagccaacccttctgcttgatatcttgatgatgtctgacaaatttgaagttgtttcttgcatgagacactgcagtcaactactaagaagcttacctatgaccacagaatctgcacttctctatctagatctgccttccagcatttcaatggctgcagcagttcagccactgactgatgctgccaaggaattcctcgccaacaaatacaaggatttgactaagtttcaggatgaagtgatgaacatcccccttgctgggattgaagccatcttatgtagtaatgaccttcaggtggcatcagaggatgcagtctatgacttcgtgatcaagtgggctcgtgctcaatactcaagaacggaagaaagacgtgaaatcttggggactcggttgctgccacttgttaggttttctcatatgacctgcaggaagttgcggaaggtccttgcatgcagtgatctggataatgagcaagcaactaaaagtgtcacggatgcactcctgtacaaagctgatgcaccacatcgacagcgcgcccttgctacagatgtattgacctctaggaaatatactgaacgagcttacaaatatcgtccacttaaggtggtggaatttgaccgaccatatcctcagtgcatagcatacttggatctgaagcgtgaggagtgtggccgactatttccatctgggcggatttactcgcaagcattccatcttgccggacagggattcttcctctcagcacattgcaacatggatcagcaaagcgctttccactgctttggtctcttcttagggatgcaagagaaaggctcatcgagtgttacagtggactacgagtttgctgcaaggacaaggccatcaggtgagtttgtcagcaagtacaagggctgctacaccttcactggtggaaaggcggttggctaccgcaatctctttgcaattccctggccgtcgtttatggctgatgatagcctcttcttcatcaatggtgtactacatctgagagcagaattgaccataaagcaactctagatggtgcttggcgcactactaacctcatctgtgtccttgctcacacctcagttcgtgcaactgtgggcctcagtgtggaaaatcttgtgtcagtcaaacatgtttctactctgcgccaaaatagacacttctgaaacgagaagccaaatcctttgttttacataaaaagaggactctcgtgttatgtaatagttttgaactttggaaactgaagctttgacacagagaatcaaaattacattct

SEQ ID NO: 827 - DNA, 2000 bp, Secale cereale
gacttccccatcacgaccacgccctccctccgcttctcctccgtctcccttccctcactcttctacccgcggctcccaccccacccacgcggggcgtgcccgtgccgttctagggcctcgttttcgtttcgggttatggtcccagctcggccggcggtgaggaggtccgctgcggagggcgcggtgcgagggcagcgacggtgaggcggcccgcgttggcggattgggattgggattggggggaagagggagccgtggtgcggccggcatggagccggacttctcgcgagcgagcggcggcccaagctacgagttcgcgttcaactcggtcaacttctccgaccgggtcctgcggatcgagatcgtcgccggggacgacgcgccgggggccaagggcgccgccggcgagggctgctcctccatcgccgactgggcgcgccaccgcaagcgccgcagggaggatctccgccgcgacaaagaatgtggaaagtacatgttggaaccatcaaaggtaaaaatcgaagcagaagaatgtgatacttatgaggaaaccggagaggagcctgtagctatgatagaagaatctccacctgatattggacaagatggtgaggatggagaaaacagtgactcatcctggaatatggagtgtaatcaggttttgagagtgaaatctatctatatcagctctgcgattctagcagcaaaaagtcccttcttttacaagcttttctcaaatggcatgaaagaatccgaccagaggcatgctactcttagaataactgcttcagaggaaagtgcccttatggagcttttaagctttatttacagcggaaagttgacgacaaatgagccaacccttctgcttgatatcttgatgatttctgacaaatttgaagttgtttcttgcatgagacactgcagtcaattgctaaggagcttaccaatgaccacagaatctgcacttctctatctagatctgccttccagcatttcaatggctgcagcagttcagccactgactgatgctgccaaggaattcctcgctaacaaatacaaggatctgacaaagtttcaggatgaagtgatgaacattccccttgctgggattgaagccatcctatgtagtaatgaccttcaggtggcatcagaggatgcagtctatgactttgtgatcaagtgggttcgtgctcaatacccaagaacggaagaaagacgtgaaatcttgggtactcgcttgctgccgctcgttcggttctctcatatgacctgcaggaagttgcggaaagtccttgcgtgcagtgatctggatcatgagcaagcatctaaaagtgtcactgatgcactcctgtacaaagctgatgcaccacatcgacagcgtgcccttgctgcagatgtgttgacttgtaggaaatatactgaacgagcttacaagtatcgcccgcttaaggtggtggaatttgatcaaccatatcctcagtgcatagcatacttggatctgaagcgtgaggagtgtagccgacttttcccatccgggcggatttactcgcaagcattccatcttgctggacagggattcttcctgtcagcacattgcaacatggatcagcaaagtgctttccactgctttggtctcttcttagggatgcaagagaagggctcaacgagtgttactgtggactatgagtttgctgcaaggacaaggccatcgggcgattttgtcagcaagtacaagggctactacaccttcactggtggaaaggcagttggctaccggaatctctttgcgattccctggccgtcgtttatggctgatgacagccttttcttcatcgatggagtactacatctgagagcggaactgaccataaagcaatcatagatagtggaaaatcttttgtggttcaatcatgtttttcctgagcaccaaaatagacacttttgaaacgagaagcaaaatctgtgaactgtgaaaactgaaaagtaacatcttatgaact

SEQ ID NO: 828 - DNA, 2073 bp, Secale cereale
gtttcacactcaccaccctctggtttcctcccctatcacacagccacgcctctctcttctccgtttcactcttgtccccgcgcccccgcttctgcggccttctgagggtagggttccggctccgacggcggcgaggatgccttctgcgggggctgcgctgcggcggaggtgaggcggcgggcgtggtgggattgggattggtattggtattggaggaagggggcggtggtggtcgggatggacccggacttctcgcgggcgagcggtggcccgagcttcgagttcgccttcaactcggtcaacttctccgaccggatcctgcggatcgagatcgtcgccggggacgacgcgccgggggccaagggcgccgccggcgagggctgctcctccatcgccgactgggcgcgccaccgcaagcgccgcagggaggacctccgccgcgagaaagaatgtggaaagtatatgtcagaaccagcaaacatcaaaattgaagcagatgaacgtgatacctatgaggagaccaacgaggaacctgtagctatgatagaagaatctccacctgatattggacaagatggtgaggatggagaaagcagtgactcatcctggaatatggagtgtaatcaggttttgagagtgaagtctatatatatcagctctgcgattctagctgcaaaaagtcccttcttttacaagcttttctcaaatggcatgaaagaatccgaccagaggcatgcaactcttagaataactgcttcagaggaaagtgcccttatggagcttttaagttttatttacagtggaaagttgacgaccaatcagccaacccttctgcttgatatcttgatgatgtctgacaaatttgaagttgtttcttgcatgagacactgcagtcaactactaagaagcttacctatgaccacagaatctgcacttctctatctagatctgccttccagcatttcaatggctgcagcagttcagccactgactgatgctgccaaggaattcctcgccaacaaatacaaggatttgactaagtttcaggatgaagtgatgaacatcccccttgctgggattgaagccatcttatgtagtaatgaccttcaggtggcatcagaggatgcagtctatgacttcgtgatcaagtgggctcgtgctcaatactcaagaacggaagaaagacgtgaaatcttggggactcggttgctgccacttgttaggttttctcatatgacctgcaggaagttgcggaaggtccttgcatgcagtgatctggataatgagcaagcaactaaaagtgtcacggatgcactcctgtacaaagctgatgcaccacatcgacagcgcgcccttgctacagatgtattgacctctaggaaatatactgaacgagcttacaaatatcgtccacttaaggtggtggaatttgaccgaccatatcctcagtgcatagcatacttggatctgaagcgcgaggagtgtggccgactattcccatctgggcggatttactcgcaagcattccatcttgccggacagggattcttcctctcagcacattgcaacatggatcagcaaagcgctttccactgctttggtctcttcttagggatgcaagagaaaggctcatcgagtgttaccgtggactacgagtttgctgcaaggacaaggccatcaggtgagtttgtcagcaagtacaagggctgctacaccttcactggtggaaaggcggttggctaccgcaatctctttgcaattccctggccgtcgtttatggctgatgatagcctcttcttcatcaatggtgtactacatctgagagcagaattgaccataaagcaactctagatggtgcttggcgcactactaacctcatctgtgtccttgctcacacctcagttcgtgcaactgtgggcctcagtgtggaaaatcttgtgtcattcaaacatgtttctactctgcgccaaaatagacacttctgaaacgagaagccaaatcctttgttttacataaaaagaggactcgtgttatgtaatagttttgaactttggaaactgaagctttgacaca

SEQ ID NO: 829 - DNA, 2016 bp, Saccharum officinarum
cggtttccttttcgaagctttgctaggtttagagttggggccttcgtttaccccgtcaatggctcctgaggcggctgtacttcagaggtgaggtgagccgtggggacgcgcgtggttggttggttggttggttggaggaggcggggatggacccggacttctcgcgggcgagtggggggccgagcttcgagttcgccttcaactcggtcaacttctccgaccgggtgttgcggatggagatcgtcgctggggatgacgccctaggggccaagggcgccgccggcgaggggtgctcgtcgcttgccgactgggcgcgccaccgcaagcggcgacgggaggagctccaacgcggcaaagaatctggaaaatacatgccggatccaggaagttgcaaagttgaagctgaaaaatgtgatgcctacgaggaaggcaacgagcctgtagctatgatagaagaatctccacctgatattgagccaaatggtgaggatggagaaagcagcgactcatcctggagtatggagtgtactcaggttttgagagtaaagtctatctacatcagctctgcaattctagctgcaaagagccctttcttttacaagcttttttcaaatggaatgaaagaatccgatcagaggcatgcaactcttagaataactgcttcagaggaaaatgcgcttatggagcttctaagctttatgtatagtggcaagttgacgacaaaccagccaactgccctgctggatatattgatggtcgctgacaaatttgaggttgtttcctgtatgcggcactgcagtcaattgcttagaagtttgcctatgaccacagagtctgcactgctctatctggatctaccctcaagcatttcaatggctgctgcagttcagccgctgacagacactgccaaggaattccttgccaataaatacaaggatttgaccaagttccaagatgaagcaatgaacattcctcttgctggaattgaagccatcctatggagtaatgaccttcaggttgcatcagaggatgctatctacgactttgtgataaagtgggcacgtgctcaatacccaaaattggaggaaagacgtgagatcttgggcacacgcttgctgccccttgttcggttctgccatatgacctgcaggaagttgcggaaggttcttgcttgcagtgatctggatcatgagcaggcaactaaatgtgtcacagaggcacttctttacaaagctgatgcaccacataggcagcgtgcccttgcagcagatgtgatgacatgtaggaaatatgctgagcgagcttacaaatatcgtccgcttaaggttgtagagtttgatagaccatatccacagtgcatagcatacttggacctgaagcgtgaggagtgcagccgactttttccatccggacggatatactcacaagctttccatctagctggacagggcttcttcctctcagcacactgcaacatggaccagcaaagtgcattctattgttttggtctcttcctagggatgcaagagaaagggtcgacaagtgttaccgtggattatgagtttgctgcaaggacaaggccgtcaggtgagtttgtcagcaaatataagggctactataccttcactggtggcaaggcggttgggtaccggaatctctttgcgatcccgtggccatcattcatggctgatgacagtctcttcttcattgacggggtattgcatctaagagctgagttgaccataaaacaaccctagacgcagctgtgagtctaagtgcgtttgcgccgcggtgtccaaatccatgcaattatgatctgaagtgtagaaaatgaaatcttctgtgcgtgctgtttttactttttactgatgcacttaaatagacaatttgaaaacgagaactgaattctctcttgtttatttagttgtttttgcacctgaggaggatcttgtcatgctgtgtactcactaaactgtgaaaagtgattcagctaatcaaattttatgttggatgggc

SEQ ID NO: 830 - DNA, 2070 bp, Triticum aestivum
atggagccggacttctcgcgggcgagcggcggcccgagctacgagttcgccttcaactcggtcaacttctccgaccgggtcctgcggatcgagatcgtcgccggggacgacgcgccgggggccaagggcgccgccggcgagggctgctcctccatcgccgactgggcgcgccaccgcaagcgccgcagggaggatctccgccgcgacaaagaatgtggaaagtacatgttggaaccatcaaaggtaaaaatcgaagcagaagaatgtgatacctatgaggaaaccggtgaggagcctgtagctatgatagaagaatctccacctgatattggacaagatggcgaggatggagaaaacagcgactcatcgtggaatatggagtgtaatcaggttttgagagtgaaatctatctatatcagctctgcaattctagctgcaaaaagtcccttcttttacaagcttttctcaaatggcatgaaagaatccgatcagaggcatgctactcttagaataactacttcagaggaaagtgcccttatggagcttttaagctttatttacagtggaaaattgacgacaaatgagccaacccttctgcttgatatcttgatgatttctgacaaatttgaagttgtttcttgcatgagacactgcagtcaattgctaaggagcttacctatgaccacagaatctgcacttctctatctagatctgccttccagcatttcaatggctgcagcagttcagccactgactgatgctgccaaggaattcctcgccaacaaatacaaggatttgactaagtttcaggatgaagtgatgaacattccccttgctgggattgaagccatcctatgtagtaatgaccttcaggtggcatcagaggatgcagtctatgactttgtgatcaagtgggttcgtgctcagtacccaagaacggaagaaagacgtgaaatcttgggtactcgcttgctgccgctcgttcggttctctcatatgacctgcaggaagttgcggaaggtccttgcgtgcagtgatctggatcatgagcaagcatcgaaaagtgtcactgatgcactcctgtacaaagctgatgcaccacatcgacagcgcgcccttgctgcagatgtgttgacttgtaggaaatatactgaacgagcttacaagtatcgcccgcttaaggtggtggaatttgatcaaccatatcctcagtgcatagcatacttggatctgaagcgtgaggagtgtagccgacttttcccatccgggcggatttactcgcaagcattccatcttgctggacagggattcttcctgtcggcacattgcaacatggatcagcaaagtgctttccactgctttggtctcttcttagggatgcaagagaagggctcaacgagtgttactgtggactatgagtttgctgcaaggacaaggccatcgggcgattttgtcagtaagtacaagggctactacaccttcactggtggaaaggcagttggctaccggaatctctttgcgattccctggccgtcgtttatggctgatgacagcctcttcttcatcgatggagtactacatctgagagcggaactgaccataaagcaatcatagatggtggaaaatcttgtgtggttcaaacatgtttttcctgagcaccaaaatagacacttttgaaacgagaagcagaatctgtgaactgtgaaaactgaaaagtaatatcttatgaactgtgaaggtgtagttgcgccacatgagttcttttcttgatgcgtagctctacatgagttaaatttgcagtttgttgaaatttctactcgttttgatggcgatcctttattggacatccggcatgtttggatagtgtcatgtagaatgtggtcaaggtacaaagggcgtttgctaaatgatgtcaagaagcaagtagttctatagaaaagaaaagggttacttcaaacgatggattttgcatcttactgtatttccttttagaaactgcttggtattgctggaggctctgtttagttaaaaaagaaaagtaccgctgcgtcggccgctcgtctgagactg

SEQ ID NO: 831 - DNA, 1971 bp, Triticum aestivum
acgcgttctagggcctcgtttctctttcgggttatggtcccggctcggccggcggtgaagaggtccgctgcggggggcgcggggcggtggcgggggcggcgagggtgaggcggccccgcgttcgctgattgggattgggattggattcgggggaagagggcgccgtggtgcggccggcatggagccggacttctcgcgggcgagcggcggcccgagctacgagttcgccttcaactcggtcaacttctccgaccgcgtcctgcggatcgagatcgtcgccggggacgacgcgccgggggccaggggcgccgccggcgagggctgctcctccatcgccgactgggcgcgccaccgcaagcgccgcagggaggatctccgccgcgacaaagaatgtggaaagtacatgttggaaccatcaaaggtaaaaatcgaagcagaagaatgtgatacctatgaggaaaccggtgaggagcctgtagctatgatagaagaatctccacctgatattggacaagatggcgaggatggagaaaacagcgactcatcgtggaatatggagtgtaatcaggttttgagagtgaaatctatctatatcagctctgcaattctagcagcaaaaagtccttttttttacaagcttttctcaaatggcatgaaagaatctgatcagaggcatgctactcttagaataactacttcagaggaaagtgcccttatggagcttttaagctttatttacagtggaaaattgacgacaaatgagccaacccttctgcttgatatcttgatgatttctgacaaatttgaagttgtttcttgcatgagacactgcagtcaattgctaaggagcttacccatgaccacagaatctgcacttctctatctagatctgccttccagcatttcaatggctgcagcagttcagccactgactgatgctgccaaggaattcctcgccaacaaatacaaggatttggctaagtttcaggatgaagtgatgaacattccccttgctgggattgaagccatactatgtagtaatgaccttcaggtggcatcagaggatgcagtctatgactttgtgatcaagtgggttcgtgctcaatacccaagaacggaagaaagacgtgaaatcttgggtactcgcttgctgccgctcgttcggttctctcatatgacctgcaggaagttgcggaaggtccttgcgtgcagtgatctggatcatgaacaagcatctaaaagtgtcactgatgcactcctgtacaaagctgatgcaccacatcgacagcgcgcccttgctgcagatgtgttgacttgtaggaaatatactgaacgagcttacaagtatcgcccgcttaaggtggtggaatttgatcaaccatatcctcagtgcatagcatacttggatctgaagcgtgaggagtgtagccgacttttcccatccgggcggatttactcgcaagcattccatcttgctggacagggattcttcctgtcggcacattgcaacatggatcagcaaagtgctttccactgctttggtctcttcttagggatgcaagagaagggctcaacgagtgttactgtggactatgagtttgctgcaaggacaaggccatcgggcgattttgtcagtaagtacaagggctactacaccttcactggtggaaaggcagttggctaccggaatctctttgcgattccctggccgtcgtttatggctgatgacagcctcttcttcatcgatggagtactacatctgagagcggaactgaccataaagcaatcatagatggtggaaaatcttgtgtggttcaaacatgtttttcctgagcaccaaaatagacacttttgaaacgagaagcagaatctgtgaactgtgaaaactgaaaagtaatatcttatgaactgtgaaggtgtagttgcgccacatgagttcttttcttgatgcgtagctctacatgagttaaa

SEQ ID NO: 832 - DNA, 2149 bp, Triticum aestivum
cccacgcgtccgcgcttaccaccctctggtttcctccccatcacaccacagccacgcctctctcttctccgtctcactcttgtccccacgcccccgcttccgcgaccttctggaaccttctctcgggctagggttccggctccgacggcggtgatgatgtcttctgcggcctgcgcgcagcggcggaggtgaggcggcgggcgtggccggattggtattggaggaagggggcggtggtggccgggatggacccggacttctcgcgggcgagcggcggcccgagcttcgagttcgccttcaactcggtcaacttctccgaccgggtcctgcggatcgagatcgtcgccggggacgacgcgccgggggccaagggcgccgccggcgagggctgctcctccatcgccgactgggcgcgccaccgcaagcgccgcagggaggacctccgcctcgagaaaggtggggaagaatgtggaaagtatatgtcagaaccagcaaacatcacaattgaagcagatgaacgtgatacctatgaggaaaccaacgaggagcctgtagctatgatagaagaatctccacctgatattggacaagatggtgaggatggagacagtgactcatcctggaatatggaatgtaatcaggttttgagagtgaagtctatatatatcagctctgcgattctagctgcaaaaagtcccttcttttacaagcttttctcaaatggcatgaaagaatccgaccagaggcatgcaactcttagaataactgcttcagaggaaagtgcccttatggagcttttaagttttatttacagtggaaagttgacgaccaatcagccaacccttctgcttgatatcttgatgatgtctgacaaatttgaagttgtttcttgcatgagacactgcagtcaactactaagaagcttacctatgaccacagaatctgcacttctctatctagatctgccttccagcatttcaatggctgcagcagttcagccactgactgatgctgccaaggaattccttgccaacaaatacaaggacttgactaagtttcaggatgaagtgatgaacattccccttgctgggattgaagctatcttatgtagtaacgaccttcaggtggcatcagaggatgcagtctatgactttgtgatcaagtgggctcgtgctcaatactcaagaacggaagaaagacgtgaaatcttggggactcggttgctgccacttgttaggttttctcatatgacgtgcaggaagttgcggaaggtccttgcatgcagtgatctggataatgagcaagcaactaaaagtgtcactgatgcactcctgtacaaagctgatgcaccacatcgacagcgtgcccttgctacagatgtgttgacctctaggaaatatactgaacgagcttacaaatatcgtccacttaaggtggtggaatttgatcgaccgtatcctcagtgcatagcatacttggatctgaagcgtgaggagtgtggccgactattcccatctgggcggatttactcgcaagcattccatcttgccggacagggattcttcctctcagcacattgcaacatggatcagcaaagtgctttccactgctttggtctcttcttagggatgcaagagaaaggctcaacgagtgttaccgtggactacgagtttgctgcaaggacaaggccatcgggtgagtttgtcagcaagtacaagggctgctacaccttcactggtggaaaggcggttggctaccgcaatctctttgcaattccctggccgtcgtttatggctgacgatagcctcttcttcatcaatggagtactacatctgagagcagaattgaccataaagcaactctagatggtgcttggcgcactactaacctcatctgtgtccttgctcacacctcagttcgtgcaacgatgggcctcagtgtggaaaatcttgtgtcattcaaacatgtttttactctgcgccaaaatagacacttctgaaacgagaagccaaatcctttgttttacataaaaaagaggactgtcatgtcatgcattagttttgaactttggaaactgtagctttgacgctgagaatcaaagttacattcgtaacatgttcagatgagttgaatttgcagtctgttagat

SEQ ID NO: 833 - DNA, 2115 bp, Triticum aestivum
ccacagccacgcctctctcttctccgtctcactttgtccccacgcccccgcttccgccgccttctggaaccttctttcgggctagggttccggctccgacggcggcgatgatgtcttctgcggtctgcgcgcagcggcggaggtgaggcggcgggcgtggcgggattggtattggaggaagggggcggtggtggtcgggatggacccggacttctcgcgggcgagcggtggcccgagcttcgagttcgccttcaactcggtcaacttctccgaccgggtcctgcggatcgagatcgtcgccggggacgacgccccgggggccaagggcgccgccggcgaggggtgctcctccatcgccgactgggcgcgccaccgcaagcgccgcagggaggacctccgccgcgagaaaggtggggaagaatgtggaaagtatatgtcagaaccagcaaacatcaaaattgaagcagatgaacgtgatacctatgaggaaaccaatgaggagcctgtagctatgatagaagaatctccacctgatattggacaagatggtgaggatggagacagtgactcatcctggaatatggagtgtaatcaggttttgagagtgaaatctatctatatcagctctgcaattctagcagcaaaaagtccctttttttacaagcttttctcaaatggcatgaaagaatccgatcagaggcatgctactcttagaataactacttcagaggaaagtgcccttatggagcttttaagctttatttacagtggaaagttgacgacaaatgagccaacccttctgcttgatatcttgatgatttctgataaatttgaagttgtttcttgcatgagacactgcagtcaattgctaaggagcttacctatgaccacagaatctgcacttctctatctagatctgccttccagcatttcaatggctgcagcagttcagccactgactgatgctgccaaggaattcctcgctaacaaatacaaggatctgaccaagtttcaggatgaagtgatgaacattccccttgctgggattgaagccatcctatgtagtaatgaccttcaggtggcatcagaggatgcagtctatgactttgtgatcaagtgggttcgtgctcagtacccaagaacggaagaaagacgtgaaatcttgggtactcgcttgctgccgctcgttcggttctctcatatgacctgcaggaagttgcggaaggtccttgcgtgcagtgatctggatcatgagcaagcatcgaaaagtgtcactgacgcactcctgtacaaagctgatgcaccacatcgacagcgcgcccttgctgcagatgtgttgacttgcaggaaatatactgaacgagcttacaagtatcgcccgcttaaggtggtggaatttgatcaaccatatcctcagtgcgtagcatacttggatctgaagcgtgaggagtgtagccgacttttcccttccgggcggatttactcgcaagcattccatctcgctggacagggattcttcctgtcagcacattgcaacatggatcagcaaagtgctttccactgctttggtctcttcttagggatgcaagagaagggctcatcgagtgttaccgtggactatgagtttgctgcaaggacaaggccatcgggcgattttgtcagcaagtacaagggctactacaccttcactggtggaaaggcagttggctaccggaatctcttcgcgattccatggccgtcgtttatggctgatgacagcctcttcttcatcgatggagttctacatctgagagcagaactgaccataaagcaatcatagatagtggaaaatcttgtgtggttcaaacatgtttttcctgagcaccaaaatagacacttttgaaatgagaagcaaaatctgtgaactgtgaaaactgaaaagtaacatcttatgaactgtgaaggtgtagttgcgccacataagttttttcttaatgtgtagcgctacatgagttaaatttgcagtttgttgaaatttctactcgttttgatggcgatcctttattggacatccggcatgtttggatagtgtcatgtagaatgtggtcaaggtacaaagggcgtttgctaaatgat

SEQ ID NO: 834 - DNA, 2067 bp, Leymus cinereus x Leymus triticoides
  misc_feature (32)..(35): n is a, c, g, or t
  misc_feature (184)..(184): n is a, c, g, or t
  misc_feature (271)..(271): n is a, c, g, or t
  misc_feature (296)..(296): n is a, c, g, or t
  misc_feature (336)..(336): n is a, c, g, or t
  misc_feature (697)..(697): n is a, c, g, or t
  misc_feature (709)..(709): n is a, c, g, or t
  misc_feature (760)..(760): n is a, c, g, or t
  misc_feature (783)..(783): n is a, c, g, or t
  misc_feature (791)..(791): n is a, c, g, or t
  misc_feature (916)..(917): n is a, c, g, or t
  misc_feature (1177)..(1177): n is a, c, g, or t
  misc_feature (1193)..(1193): n is a, c, g, or t
  misc_feature (1198)..(1198): n is a, c, g, or t
  misc_feature (1237)..(1237): n is a, c, g, or t
  misc_feature (1253)..(1253): n is a, c, g, or t
  misc_feature (1265)..(1265): n is a, c, g, or t
  misc_feature (1288)..(1288): n is a, c, g, or t
  misc_feature (2037)..(2037): n is a, c, g, or t
cccgcggctcccaccccccacgcacggcgcannnntgccgttctagggcctcgttttcgtttcgggttatggttccggcccggccggcggtgaggaggcctgctgcggggggcgcggggcgggggcggcgaaggtgaggcggcgcgcgttggcggattgggattggattggggggaagagggcncggtggtgggccgggatggagccggacttctcgcgggcgagcggcggcccgagctacgagttcgccttcaactcggtcaacttctcngaccgggtcctgcggatcgagatcntcgccggggacgacgcgccgggggccaagggcgccgccgncgaggggtgctcgtccatcgccgactgggcgcgccaccgcaagcgccgcagggaggatctccggcgggagaaaggtgggggagaatgtggaaagtatatgttggaaccatcaatcgtcaaaattgaagcagaagagcatgatacctatgaggaaactggtgaggagcctgtagctatgatagaagaatctccacctgatattggacaagatggtgaggatggagaaaacagtgactcatcctggaatatggagtgtaatcaggttttgagagtgaaatctatttatatcagctctgcgattctagctgcaaaaagtccctttttttacaagcttttctcaaatggcatgaaagaatccgancagaggcatgcnactcttagaataactgcttcagaggaaagtgcccttatggagcttttaagntttatttacagtggaaagttgangacaaatnagccaacccttctgcttgatatcttgatgatttctgacaaatttgaagttgtttcttgcatgagacactgcagtcaattgctaagaagcttacctatgaccacagaatctgcacttctctatctnnatctgccttccagcatttcaatggctgcagcagttcagccactgactgatgctgccaaggaattcctcgccaacaaatacaaggatttgactaagtttcaggatgaagtgatgaacattccccttgctgggattgaggccatcttatgtagtaatgaccttcaggtggcatcagaggatgcagtctatgacttcgtgatcaagtgggctcgtgctcaatacccaagaacggaagaaagacgtgaaatcttgggtactcgnttgctgccactcgttnggttntctcatatgacctgcaggaagttgcggaaggtccttgcntgcagtgatctggatnatgagcaagcanctaaaagtgtcactgatgcactnctgtacaaagctgatgcaccacatcgacagcgcgcccttgctacagatgtgttgacctctaggaaatatactgaacgagcttacaaatatcgtccgcttaaggtggtggaatttgaccgaccatatcctcagtgcatagcatacttggatctgaagcgtgaggagtgtggccgactattcccatctgggcggatttactcgcaagcattccatcttgctggacagggattcttcctctcagcacattgcaacatggatcagcaaagcgctttccactgctttggtctcttcttagggatgcaagagaaaggctcaacgagtgttaccgtggactacgagtttgctgcaaggacaaggccatcgggtgagtttgtcagcaagtacaagggctgctacaccttcactggtggaaaggcggttggctaccgcaatctctttgcaattccctggccgtcgtttatggctgatgatagcctcttcttcatcaatggggtactacatctgagagcagaattgaccataaagcaactctagatggtgcttggcgcactactaacctcatctgtgtccttgctcacacctcagttcgtgcaacgatgggcctcagtgtggaaaatcttgtgtcattcaaacatgtttttactcggcaccaaaatagacactttcgaaacgagaagccaaatcccttgttttgcatcaaaagaggattgtcatgttatgcattaattttgaactgtgaaaactgaaangtaacactgagaatcaaagttacattctga

SEQ ID NO: 835 - DNA, 2423 bp, Zea mays
gtctgacatgttttaaaccatatttgtactaatgatttctttaattacactcctaaaatttaagactaaactttagtctatagaaatcctatttaaaagatctattttagtcttcccgtttagtattttcaaaacaaaaaatgactcactaaaacttagaggttggaaccaaacaccacggagggtacgaatttctacttcgagggtacgaatttctacttcgtgaagtgcgtgaagtgtatttatctacctgtccccaccggagggtacgaatttactctgtcttgttcagctgtcctttttcttcccgtttaaacacccccagatttctctatatcacgacgctacccctccacgtctccgcttctcgtgttcttgttcgtctccgcctcaggcaactccacacggacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgaccgggtgttgcggatcgagatcgtcgctggggatgacgccctcggggccaagggcgccaccggcgaggggtgctcatctcttgccgactgggcgtgccaccgcaagcgacgacgggaggagctccgacgcgacaaagaatctagaaaatacatgccagatccagcaaactgcaaagttgaagctgaagaatgtgatgcctacgaggaaggcaatgagcctgtagctatgatagaagaatctccgcctgatattgaggcagatggtgaggatggaaaaagcagcgactcatactgtagtatggagtgtactcaggttttgagagttaagtctatgtacatcagctctgcaattctagctgcaaagagccctttcttttacaagcttttctcaaatggaatgaaagaatccgaccagaggcatgcaactcttaggataactgcttcagaggaaaatgcgcttatggagcttctaagctttatgtatagcggcaagttgacgacaaaccagccaactgtcctgctggatatattgatgatcgctgacaaatttgaggttggttcctgtatgcggcactgcagtcaattgcttagaaatttgcctatgaccacagagtctgcactgctctatctggatctaccttcaagcatttcaatggctgctgcagttcagccattgacggacaccgccaaggaattccttgccaacaaatacaaggatttgactaagttccaagatgaagcaatgaacattcctcttgctggaattgaagccatcctatggagcaatgaccttcaggtcgcgtcggaggatgctatctacgacttcatgataaagtgggcacgtgctcaatacccaaaattggaggaaagacgtgagatcttgggcacacgcttgctgccccttgttcggttctgccatatgacctgcaggaagttgcggaaggttattgcctgcagtgatctggatcacgagcaggcgacgaaatgtgtcacagaggcacttctctacaaagctgatgcaccacataggcagcgtgcccttgcagcagacgtgatgacatgtaggaagtatgctgagcgagcttacaaatatcgcccgcttaaggttgtagagtttgataggccgtaccggcagtgcatagcatacttggacctgaagcgagaggagtgcagccgacttttcccatctgggcggatatactcgcaagctttccatctagctggacagggcttcttcctctcagcacactgtaacgtggaccagcaaagtgcgttctattgttttggtctcttcctagggatgcaagagaaagggtcgacaagtgttaccgtggattatgagttcgctgcaaggacaaggccgtcaggcgagtttgtcagcaaatataagggctactatactttcactggcggtaaggctgttgggtaccggaatctctttgcgatcccgtggccgttattcatggctgatgacagtctcttctttatcgacggggtattgcatctcagagctgagctgaccataaaacaaccctagatgaggccgtgtttgtgccgcgcgcgtgtccaaatccatgcaatggtgttctgcagtgtagaatatggaaatcttgtgtgctgttttgttttgaaaacgacaactcaattctctcttgttcagttgtttgtacacctgaggaggatcatgtcatgttttgtactctcactaaactgtgataagtgatttagctaatcaaactttaagttcaccagcaacaaact

SEQ ID NO: 836 - DNA, 1765 bp, Triticum aestivum
aacttctccgaccgggtcctgcggatcgagatcgtcgccggggacgacgcgccgggggccaagggcgccgccggcgagggctgctcctccatcgccgactgggcgcgccaccgcaagcgccgcagggaggacctccgccgcgacaaagaatgtggaaagtacatgttggaaccatcaaaggtaaaaatcgaagcagaagaatgtgatacctatgaggaaaccggtgaggagcctgtagctatgatagaagaatctccacctgatattggacaagatggtgaggatggagaaaacagtgactcatcctggaatatggagtgtaatcaggttttgagagtgaaatctatctatatcagctctgcaattctagcagcaaaaagtccctttttttacaagcttttctcaaatggcatgaaagaatccgatcagaggcatgctactcttagaataactacttcagaggaaagtgcccttatggagcttttaagctttatttacagtggaaagttgacgacaaatgagccaacccttctgcttgatatcttgatgatttctgataaatttgaagttgtttcttgcatgagacactgcagtcaattgctaaggagcttacctatgaccacagaatctgcacttctctatctagatctgccttccagcatttcaatggctgcagcagttcagccactgactgatgctgccaaggaattcctcgctaacaaatacaaggatctgaccaagtttcaggatgaagtgatgaacattccccttgctgggattgaagccatcctatgtagtaatgaccttcaggtggcatcagaggatgcagtctatgactttgtgatcaagtgggttcgtgctcagtacccaagaacggaagaaagacgtgaaatcttgggtactcgcttgctgccgctcgttcggttctctcatatgacctgcaggaagttgcggaaggtccttgcgtgcagtgatctggatcatgagcaagcatcgaaaagtgtcactgatgcactcctgtacaaagctgatgcaccacatcgacagcgtgcccttgctgcagatgtgttgacttgcaggaaatatactgaacgagcttacaagtatcgcccgcttaaggtggtggaatttgatcaaccatatcctcagtgcatagcatacttggatctgaagcgtgaggagtgtagccgacttttcccatccgggcggatttactcgcaagcattccatcttgctggacagggattcttcctgtcagcacattgcaacatggatcagcaaagtgctttccactgctttggtctcttcttagggatgcaagagaaaggctcaacgagtgtcaccgtggactatgagtttgctgcaaggacaaggccatcgggcgattttgtcagcaagtacaagggttactacaccttcactggtggaaaggcagttggctaccggaatctctttgcaattccctggccgtcgtttatggctgatgacagcctcttcttcatcgatggagttctacatctgagagcagaactgaccataaagcaatcatagatagtggaaaatcttgtgtggttcaaacatgtttttcctgagcaccaaaatagacacttttgaaatgagaagcaaaatctgtgaactgtgaaaactgaaaagtaacatcttatgaactgtgaaggtgtagttgcgccacataagttttttcttaatgtgtagcgctacatgagttaaatttgcagtttgttgaaatttctactcgttttgatgg

SEQ ID NO: 837 - DNA, 2034 bp, Panicum virgatum
ccctctccccctcccggcctcctcccatctcgccctcctcccccctcgagccctccgccggctagggttacggccaccgcctccacccccgctccccgtcggcggaggagtaggggcgcggcggcggagatggacccggacttctcgcccgggggcggggggcccaacttcgagttcgccttcaacgaggtcaacttctccgaccgggagctgcggatcgaggtcgtcccgggggacgacgacgcgccgggctccagcggcgccggcgccgggggtggagggctcgccgactgggcgcgccaccgcaagcgccgccgcgaggagctcctcaaggagaaagaatctacaactcacatgtcagaccagacgaattgcgatgaagttgaagcagaagaatgtgatgcatatgaagaaaatcaagaggaacctgtagcaatgatagaagaatctccacctgatgttggtcaagatggtgatgatggacaaggtattgattcgtcttggaccgttgtaagtacgccagttttacgagtaaagacgatttatatcagctcagcaattcttgctgcgaagagtcctttctttttcaagcttttctcaaacggcatgaaagaatctgatcagagacatgcaacccttagaattactgattcagaggaaaccgccctcatggagcttttaagctttatgtatagtggaaagctgacgacaactgagcccactcttctgctggatatcctgatggcagccgacaaatttgaggttgtttcatgcatgaggtactgcagccaattgctcacaagcttgcctatgactacagagtcggcactactctacctagatctcccgtgctccatttcaatggcagctgcagttcaacctctgacagatgcagccaaggatttccttgccgtaaaatacaaggatttgactaagttccaagatgaagtgatgaacatccctcttgctgggatcgaagccatcttgtcaagtaatgaccttcaggtggcatctgaagataccatctatgacttcttgctcagatgggcccgtgcgcaatacccgaagccagaggagaggcgtgagatattgagctctcgtctgctccctcttgtgcgattcagtcacatgacctgtaggaagctgcggaaaggtcctaacatgcactgatatcgaccatgagcaagcaaccaagtgtgtcactgaggcacttctatacaaggctgatgcaccgcacaggcaacgcgctcttgcagcggatgcagtaacatgtcggaaattcgcagagcgggcttacaagtacagacctctgaaagtcgttgagtttgatcggccctacccacagtgcatagcatacttggatctcaagcgtgaggagtgctctcgactcttcccatcaggccggatatactctcaagcattccatctcgcagggcaaggcttcttcctctcagcccactgtaacatggagcagcagagcacgttctactgctttggcctcttcctagggatgcaagagaagggctcaatgagcgtgacagtggactatgagtttgctgcgaggacgagaccctccggcgagtttgtcagcaagtacaagggcaactacaccttcactggtgggaaggcagtcgggtacaggaatctctttgctatcccatggcagacgttcatggccgacgacagcctcttcttcatcgacgggatgctgcacctgagagctgagctgacgataaagcaaccctagagcggcagctgcgggatgtgctgccctgcccttcccttccgtcaggccgagtgggtgttgttgcgaagaatgttgtgtgctgcagatatcctttttgttttaccttttgtccatgcaccttaatccttttgttgatagacagtttggtgatgacaagttaaaaaggaaggcgaaaaagcctcctttgttccttcgctaggaagaaggttgtatgatccttgtccccgaatagtgaaaaaagttattacaccagctgaaaaaaagatatcggatgggaaaccttttac

SEQ ID NO: 838 - DNA, 2432 bp, Zea mays
agcccctccattgcctcattataaccaccaccgtctcttccttgtgtcttctcctcctttccctcccggccacttctctcgtttcgccctccccctcgagcaccccgccggctagggttacggccaccgccttccacgcctcccccacttcccgtaggcggaggctggtcggcgtgcacgcgaccgcggcggcggagatggacccggacttctcgcccgggggcggggggcccagctttgaattcgccttcaacgaggtcaacttctccgaccgggaattgcgtatcgaggtcgtcgccggggatgactacgctccggggtccagcggcgccggtgccggaggaggtggcctcgccgactgggcgcgccaccgcaagcgccgccgtgaggagctcctcaaggagaaagaatctacaactcacatgtcagaccaaacaaattgcaatgaagttgaagcagaagagtgtgatgcgtatgaagaaaatcaagaggaacctgtagcaatggtagaagaatctccacccgatgttggccaagatggtgatgatgggcaaggtattgattcgtcttggactgtggttggtacaccagttttacgagtcaagacaatttatatcagttcagcgattcttgctgcgaagagtcctttctttttcaagcttttctctaacggcatgaaagaatcggatcagagacatgcaacccttagaattactgactcagaggaaactgccctcatggagcttttaagctttatgtatagtggaaagttggcaactactgagcccactcttctgctggatatcttgatggctgccgacaaatttgaggttgtttcatgcatgaggtactgcagccagttgctcacaagcttgccgatgaccacagaatctgcacttctctacctagatctcccttgctcaatttcaatggcagcagcagttcaacctctgacagatgcagctaaggatttccttgctgtaaaatacaaggatttgactaagttccaagatgaagtgatgaacattcctcttgctggaattgaagccatcttgtcaagtaatgacctccaggtggcatctgaagataccatctatgacttcttgctcagatgggcccgtgcacaatacccgaaatcagaagagagacgtgagatccttagttctcggctgctccctcttgtgcgattcagtcacatgacatgtaggaagctgcggaaggtcctaacatgcacagatatagaccacgagcaggcaaccaagtgtgtcaccgaggctcttctgtacaaagctgatgcaccacaccggcaacgagctcttgcagcggacacaacaacctgtcggaaattcgctgagcgggcttacaagtacagaccactcaaggtcgttgagtttgatcggccctatccacagtgcatagcatacttggatctcaagcgcgaggagtgctctcgactctttcctgcaggccggatatactcgcaagcgttccacctcgcagggcagggcttcttcctctcagctcactgtaacatggagcagcaaagcaccttctactgctttggcctgttcctggggatgcaagagaagggctcaacgagcgtgaccgtggactatgagtttgctgcaaggacgagaccatccggcgagtttgtgagcaagtataagggtaactacacatttaccggtgggaaggcagttgggtacaggaatctctttggaatcccgtggcaggcgttcatggccgatgacagcctcttcttcatcgacgggatgctgcatctgagagctgagcttacgataaagcaacctacgtagatgtgctgccgtcgggttaagtgtgtccagtcatgggtgatgtggaaaatgctgtgtgctgcagatatcctttttgttttttttccttttgttcacgcaccttaatccttacattaatagacagtttggtgatgacaaaatataaaggaaaaaaaagggctggaaagctgccttttgttgtttcactaagatgaaggttgtatgatctctgtctcttcgtagtggaagttgttacaccagatgaaaaagaaaagatatcggatgggaatcctcactagcttgagttctctgcaagtttccagattggccggtatctcactgctaatgagctatgttctggttcgagcttttctttttcttttgttttcttttctttttttgatgggaaggacgagctgtcctattggcagcaaatgcggacgtttgtcgttggtaaggcctgctgctgctgcagtggcgctattgtttgatggcgcatttgacttgcccattgcaaggcggttgcagtgctattgttgtagcttagctaggtaggttgtgcctttctgatgaaccttgaactgtactgtcggcgagcaaacttctactcagttgcttatttgaggctggaaaagg

SEQ ID NO: 839 - DNA, 2927 bp, Sorghum bicolor
gcccgtttttcccatcttacccccctgcattgcctccttattataaccaccaccgtcttccctcctgtctcctcctcctcctcctccttcccctcccggccacacttctctcatttcgccctcccccccctcgagccctccgccggctagggttacggccaccgccttccacgcctcccccacttcccgtccagtaggcggcgggaggaggctggtcggcgcgccacgcgaccgcgggcggcggagatggacccggacttctcgcccgggggcggggggcccagcttcgagttcgccttcaacgaggtcaacttctccgaccgggaattgcggatcgaggtcgtcgccggggatgacgacgcgccgggctcaagcggcggcggcgccggaggaggtggcctcgccgactgggcgcgccaccgcaagcgccgccgcgaggagctcctcaaggagaaagaatctacaactcacatgtcagaccaaacaagttgcaatggagtcgaagcagaagagtgtgatgcatatgaagaaaatcaagaggaacctgtagcaatgatagaagaatctccacccgatgttggccaagatggtgatgatgggcaaggtattgattcatcttggactgtggtgggtacgccagttttacgagtcaagacaatttatatcagttcagcgattcttgctgcgaagagtcctttctttttcaagcttttctcaaacggcatgaaagaatcggatcagagacatgcaacccttagaattactgactcagaggaaactgccctcatggagcttttaagctttatgtatagtggaaagttgacaactactgagcccactcttctgctggatatcttgatggctgccgacaaatttgaggttgtttcatgcatgaggtactgcagccagttgctcacaaacttgccgatgaccacagaatctgcacttctctacctagatcttccctgctcaatttcaatggcagctgcagttcaaccactgacagatgcagctaaggatttccttgctgtaaaatacaaggatttgactaagttccaagatgaagtgatgaacatccctcttgctggaattgaagccatcttgtcaagtaatgacctccaggtggcatctgaagataccatctacgacttcttgctcagatgggcccgtgcacaatacccgaaatcagaagagagacgtgagatccttagttctcggctgctccctcttgtgcgattcagtcacatgacatgtaggaagctgcggaaggtcctaacatgcacggatatagaccacgagcaagcaaccaagtgtgtcaccgaggctcttctgtacaaagctgatgcaccacaccggcaacgagctcttgcagcggacacagtaacctgtcggaaattcgctgagcgggcttacaagtacagaccactcaaagttgttgagtttgatcgaccctacccacagtgcatagcgtacttggacctcaagcgtgaggagtgctctcgactctttcctgcaggccgtatatactcgcaagcattccacctcgcagggcagggcttcttcctctcagctcactgtaacatggagcagcaaagcacgttctactgcttcggtctctttctggggatgcaagagaagggctcaatgagcgttacagtggactatgagtttgctgcaaggacaagaccatctggcgagtttgtgagcaagtacaagggtaactacacgttcaccggtgggaaggcagttgggtacaggaatctctttgcaatcccatggcagacgttcatggccgatgacagcctcttcttcatcgacgggatgctgcatctgagagccgagcttacgataaagcagccctagagcaacggaacagctacatagatgtgctgccgtcaggttgagtttgtccggccgtgggtgatgctgcggaaaatgctgtgtgctgcagataatccttctcgttttttttcacccttattgttcatgcaccttaatccttttgttcatagacagtttggtgatgacaagcatataaagaaaaaaaaaaggctgaaagctgtgccttttgtcgtttcactagtccatagatgaaggttgtatgatctttgtctctgtatagtgaaagttgttacaccagatgaaaaaggaaagatatcggatggggaaacctcacaagcttgagctctctgcaagtttccagattggccggcatctcactgccagtgagctacattctggttcgaactgttgtgtttgttctctctgtaacggcgcattggcagcaaacgcaaaggtcttgggagacatttgtcgttgttggtatggcctgctgctactgcggtggcgcaatgtttcgttgacgcagcagcctagcccagtagcactgccgcagttgcaatgcggttgttgttgcttcgctaggtaggttgcgcctttctgctgaagcctgaaccgtactgtcggcgagcaaacatctactactcaaatgtttcttctttaaggctggaaaaaaggcgattaagagtcgatatcttcagcttggaatggaagtttgttaaataggtcttggaacatttcgctgggcacatatcacatatagagatccgcggcatgtgtagactgccacgcaggcagaatctatggttgcacgccaacacggcacgcagagacgagaagcctcgagccgacagcgcaagacacacattgttcacaagtggaggagaagctgcagctgcatcgccggtcgccgcgctagctagggtgtcgccgtccgggtccgggtcttgcaacaggccggcgacgcctcaactgtgaggcaacagcgaggtgccgtccgaacggcgaggctctccatccactggccactggccgctggggttgaggacgggggccgctgccaacgtccctgtcctgctggatcccct

SEQ ID NO: 840 - DNA, 2492 bp, Sorghum bicolor
cccctgcattgcctccttattataaccaccaccgtcttccctcctgtctcctcctcctcctcctccttcccctcccggccacacttctctcatttcgccctcccccccctcgagccctccgccggctagggttacggccaccgccttccacgcctcccccacttcccgtccagtaggcggcgggaggaggctggtcggcgcgccacgcgaccgcgggcggcggagatggacccggacttctcgcccgggggcggggggcccagcttcgagttcgccttcaacgaggtcaacttctccgaccgggaattgcggatcgaggtcgtcgccggggatgacgacgcgccgggctcaagcggcggcggcgccggaggaggtggcctcgccgactgggcgcgccaccgcaagcgccgccgcgaggagctcctcaaggagaaagaatctacaactcacatgtcagaccaaacaagttgcaatggagtcgaagcagaagagtgtgatgcatatgaagaaaatcaagaggaacctgtagcaatgatagaagaatctccacccgatgttggccaagatggtgatgatgggcaaggtattgattcatcttggactgtggtgggtacgccagttttacgagtcaagacaatttatatcagttcagcgattcttgctgcgaagagtcctttctttttcaagcttttctcaaacggcatgaaagaatcggatcagagacatgcaacccttagaattactgactcagaggaaactgccctcatggagcttttaagctttatgtatagtggaaagttgacaactactgagcccactcttctgctggatatcttgatggctgccgacaaatttgaggttgtttcatgcatgaggtactgcagccagttgctcacaaacttgccgatgaccacagaatctgcacttctctacctagatcttccctgctcaatttcaatggcagctgcagttcaaccactgacagatgcagctaaggatttccttgctgtaaaatacaaggatttgactaagttccaagatgaagtgatgaacatccctcttgctggaattgaagccatcttgtcaagtaatgacctccaggtggcatctgaagataccatctacgacttcttgctcagatgggcccgtgcacaatacccgaaatcagaagagagacgtgagatccttagttctcggctgctccctcttgtgcgattcagtcacatgacatgtaggaagctgcggaaggtcctaacatgcacggatatagaccacgagcaagcaaccaagtgtgtcaccgaggctcttctgtacaaagctgatgcaccacaccggcaacgagctcttgcagcggacacagtaacctgtcggaaattcgctgagcgggcttacaagtacagaccactcaaagttgttgagtttgatcgaccctacccacagtgcatagcgtacttggacctcaagcgtgaggagtgctctcgactctttcctgcaggccgtatatactcgcaagcattccacctcgcagggcagggcttcttcctctcagctcactgtaacatggagcagcaaagcacgttctactgcttcggtctctttctggggatgcaagagaagggctcaatgagcgttacagtggactatgagtttgctgcaaggacaagaccatctggcgagtttgtgagcaagtacaagggtaactacacgttcaccggtgggaaggcagttgggtacaggaatctctttgcaatcccatggcagacgttcatggccgatgacagcctcttcttcatcgacgggatgctgcatctgagagccgagcttacgataaagcagccctagagcaacggaacagctacatagatgtgctgccgtcaggttgagtttgtccggccgtgggtgatgctgcggaaaatgctgtgtgctgcagataatccttctcgttttttttcacccttattgttcatgcaccttaatccttttgttcatagacagtttggtgatgacaagcatataaagaaaaaaaaaaggctgaaagctgtgccttttgtcgtttcactagtccatagatgaaggttgtatgatctttgtctctgtatagtgaaagttgttacaccagatgaaaaaggaaagatatcggatggggaaacctcacaagcttgagctctctgcaagtttccagattggccggcatctcactgccagtgagctacattctggttcgaactgttgtgtttgttctctctgtaacggcgcattggcagcaaacgcaaaggtcttgggagacatttgtcgttgttggtatggcctgctgctactgcggtggcgcaatgtttcgttgacgcagcagcctagcccagtagcactgccgcagttgcaatgcggttgttgttgcttcgctaggtaggttgcgcctttctgctgaagcctgaaccgtactgtcggcgagcaaacatctactactcaaatgtttcttctttaaggctggaaaa

SEQ ID NO: 841 - DNA, 2183 bp, Setaria italica
ccccttcttcctccccttattataaccaccaccccttctggctcctcctctcctccttcccctcccggcctcccctcatctcgtcctccccccctcgagccctccgccggctagggttacggccaccgcctccccccacttcccgtcggcggaggaggagggtgcgcgggatggacccggacttctcgcccggtggcggggggcccagcttcgagttcgccttcaacgaggtcaacttctcagaccgggagctgcggatcgaggtcgtcgcgggggacgacgacgcgccgggctccagcggcgggggtgccggaggaggaggactcgccgattgggcgcgccaccgcaagcgccgccgcgaggagctccttaaggagaaagaatctacaactcacatgtcagaccagacaaattgcaatgaagtcgaagcagaagagtgtgatgcatatgaagaaaatcaagaggaacctgtagcaatgatagaagaatctccacctgatgttggtcaagatggtgatgatggaccaggtattgattcgtcttggaccgtggtgggtacgccagttttacgagtaaagacgatttatatcagctcagcgattcttgctgcaaagagtcctttctttttcaagcttttctcaaacggcatgaaagaatctgatcagagacatgcaaccctaagaattactgattcagaggaaactgccctcatggagcttttgagctttatgtatagtggaaagctgacgactactgagcccaatcttcttctggatatcctgatggcggctgacaaatttgaggttgtttcatgcatgaggtactgcagccagttgctcacaagcttgcctatgactacagaatctgcactactctacctagatctcccgtgctccatttcaatggcagctgcagttcaacctctgacagatgcagccaaggatttccttgctgtaaaatacaaggatttgactaagttccaagatgaagtgatgaacatccctcttgctgggatcgaagccatcttgtcaagtaatgaccttcaggtggcatctgaagataccatctacgacttcttgctcagatgggcccgtgcacaatacccaaaatcagaggagaggcgtgagatcttgagctctcgtctgctccctcttgtgcgattcagccacatgacctgtaggaagctgcggaaggtcctaacatgcactgatatagaccatgagcaagcaaccaagtgtgtcaccgaggcacttctatacaaggctgatgcaccgcaccggcaacgagctcttgcagcggatgcagtaacctgtcggaaatttgcagagcgggcttacaagtacagacctctgaaagtcgttgagtttgatcggccctacccccagtgcatagcatacttggatctcaagcgcgaggagtgctctcgactgttcccttcaggccggatatactcgcaagcattccatctcgcagggcagggcttcttcctctcagctcactgtaatatggagcagcagagcacgttctactgcttcggcctcttcctagggatgcaagagaagggctcgatgagcgtgacagtagactacgagtttgccgcgaggacgagaccctcgggtgagttcgtcagcaagtacaagggcaactacaccttcaccggtgggaaggcggtcgggtacaggaatctcttcgctatcccatggcagacgttcatggctgatgacagcctcttcttcatcgacgggatgctgcatctgagagctgagctgacgataaagcagccctagagcgatgcagcagctgcgcgatgtgttgccctgctgtcaggtcagagtttgtccagccgcgggtgttgttgcgaggaatggtgtgtgctgctgcagatatcctttttggtttttttcttttgcccatgcacattaatccttttgtcaatagacagtttggtgatgacaagttaaaaaagggaaggcgaaaaagcctccgctgttccttcattagaaagaaggttgtatgatccttgtccccgaatagtgaaaaagttattattacaccagctgaaaagatatctgatggcaaaccttttacaaacttgagttccctgcaagtttctagattgtccggcatctaacctgccggtgagctagatgctgatccggaaaacccgttgtgtttgcctctct

SEQ ID NO: 842 - DNA, 903 bp, Brassica rapa
gctttcataatttaaccctctacttttttcactactcaaatgaaacctccgcttaaaccctcagcttgcagagataaaaagataaggttgagagagtgaagcgaaagtgtgctaatggcttcttcagacgtagctcttctctcttctaggattcaatttcgttcatcctcgtccatccgttatgctcttccaacaatcttcaatctctcttcaccagctgcgagttcgtgcgcaaccaaatcgacccagtttcttaaacggcgtttgagagccaaatcgacgaacttttctctttcttcgttgcctcggagacggttcgtatgcagagctgcggagtacaagttcccggatccaatacccgaattcgccgaagctgagactaagaagttcagggaccatatggcaaagaaactatcaaagagggatctttttgaagactctgttgatgagattgtcggagtctgcactgagatcttcgagacgttcttgcggagcgagtatggaggacctggaacactcttggtcgtacccttcatcgacatggctgatactctcaatgaacgggaactgcctggaggtccacaagccgctcgtgcagctatcaaatgggctcaggatcatgtagacaaagattggaaggaatggaccggcactgattagtagcacctgaacctcaaatcatcaaaatatagttcagtactcatgtattgtctttgtaaaactgaattttgcagatttcagaattttattagttctcttcttatataaaatccttggtctcatcatttgtttcccaaggtgatcagtgtgtggttgagtagattcttccgatgtaccaaataagaattgaagatacctaagatctgttagttataattataatgattcaagattaatatgctc

SEQ ID NO: 843 - DNA, 822 bp, Brassica rapa
aaaagataaggttgagagagtgaagcgaaagtgtgctaatggcttcttcagacgtagctcttctctcttctaggattcaatttcgttcatcctcgtccatccgttatgctcttccaacaatcttcaatctctcttcaccagctgcgagttcgtgcgcaaccaaatcgacccagtttcttaaacggcgtttgagagccaaatcgacgaacttttctctttcttcgttgcctcggagacggttcgtatgcagagctgcggagtacaagttcccggatccaatacccgaattcgccgaagctgagactaagaagttcagggaccatatggcaaagaaactatcaaagagggatctttttgaagactctgttgatgagattgtcggagtctgcactgagatcttcgagacgttcttgcggagcgagtatggaggacctggaacactcttggtcgtacccttcatcgacatggctgatactctcaatgaacgggaactgcctggaggtccacaagccgctcgtgcagctatcaaatgggctcaggatcatgtagacaaagattggaaggaatggaccggcactgattagtagcacctgaacctcaaatcatcaaaatatagttcagtactcatgtattgtctttgtaaaactgaattttgcagatttcagaattttattagttctcttcttatataaaatccttggtctcatcatttgtttcccaaggtgatcagtgtgtggttgagtagattcttccgatgtaccaaataagaattgaagatacctaagatctgttagttataattataatgattcaagattaaaa

SEQ ID NO: 844 - DNA, 804 bp, Brassica juncea
aacctccgcttaaaccctcagcttgcagagataaaaagataaggttgagagagtgaagcgaaagtgtgctaatggcttcttcagacgtaactcttttctcttcccggattcaatttcgttcatactcgtccatccgttatgctcttccaacaatcttcaatctctcttcaccagctgtgagttcgtgcgcaaccaaatcgacccagtttcttaaacggcgtttgagagccaaatcgacgaacttttctctttcttcactgccacggagagggttcgtatgcagagctgcggagtacaagttcccggatccaatacccgaattcgccgaagctgagactaagaagttcagggaccatatgacaaagaaactatcaaagagggatctttttgaagattctgttgatgagattgtcggagtctgcactgagatcttcgagacgttcttgcggagcgagtatggaggacctggaacactcttggtcgtacccttcatcgacatggctgatactctcaatgaacgggaactgcctggaggtccacaagccgcacgtgcagctatcaaatgggctcaggatcatgtagacaaggattggaaggaatggaccggcactgattagtagcacctgaacctcaaatcatcaaaatatagttcagtactcatgtatcagaggatatattgtctttgtaaaactctgaattttgcagatttcagaattttattagttctcttcttatataaaatcgttggtctcatcatttgtttcccaaagtgatcactgtatggttgagtagattcttccgatg

SEQ ID NO: 845 - DNA, 628 bp, Brassica oleracea
gtgcaaatggcttcttcagacgtagctcttttctcttctatgattcaatttcgttcatcctcatccatccgtaatgctcttccaacaatcttcaatctctcttcaccagccgcgagttcgtgcgcaatcaaatcgacccagattcttaaccggcgtttgagagccaaatcgacgaacttatctctttcttcgttgccacggagagggttcgtatgcagagctgcggagtacaagttcccggatcccatacccgaattcgccgaagctgagactaagaaatttagggaccatatgacaaagaaactatcaaagagggatctttttgaagactctgttgatgagattgtcggagtctgcactgagatcttcgagacgttcttgcggagcgagtatggaggacctggaacactcttggttgtaccgttcattgacatggctgatactctcaatgaaagggaactgcctggaggtccacaagccgcacgtgcagctatcaaatgggctcaggatcatgtagacaaagattggaaggaatggaccggcaccgattaagaacacccgaacctcaaatcatcaaaaatatagttcagtactcatgtatcaaaaggatatattggtctttgtaaaa

SEQ ID NO: 846 - DNA, 840 bp, Raphanus sativus
cagagtaaaaagataaggtttcgagagtgaagcggaagtgtgcaaaatggcttctctagacgcggctctctgctctactcggcttcaattccattcatcaatccgttgtgctcttccaacaatcttcaatctttcttcacgagccgggagttcgtgcgcaatcaaaccgacccagtttcttcaccggcgtttgacagccaaatccacgaacttttctctttcttctttgccacggagagggttcttatgcagagctgcggagtacaagttcccggatcccatacctgaattcgccgaagctgagacgaagaaattcaaggaccatatgacaaagaaactatcaaagagggatctttttgaagactctgttgatgagattgtgggagtttgcactgagatcttcgagacgttcttgcgcagcgagtatggaggacctggaacacttttggtcatacccttcatcgacatggctgatacactcaatgaaagggaactgcctggaggtccacaagccgcacgtgcagctatcaaatgggctcaggatcatgtagacaaggattggaaagaatggactggcactgattagtaacaccacccgaacctcaaatcatcaaaatatagttcagtactcatgtatcagatgatagattgtctttgtaaaactctgaattttgcagatttcggtattctgttagctctgttgttatacaatcgcatggtctcatcagcttttttcctagttgattcatgtatggttcagtagattagcttgaacatgtggagtgtaacgatggccgacaactaactcggtacatcttgaataaatcggttttatcggtt

SEQ ID NO: 847 - DNA, 763 bp, Raphanus sativus
  misc_feature (443)..(443): n is a, c, g, or t
  misc_feature (455)..(455): n is a, c, g, or t
  misc_feature (514)..(514): n is a, c, g, or t
  misc_feature (545)..(545): n is a, c, g, or t
  misc_feature (600)..(600): n is a, c, g, or t
  misc_feature (602)..(602): n is a, c, g, or t
  misc_feature (618)..(618): n is a, c, g, or t
gagtaaaaagataaggtttcgagagtgaagcgaaagtgtgcaaaatggcttctttagacgcagctctcttctctcctcggcttcaattccattcatccatccgttgtgctcttccaacaatcttcaatctctcttcacaagccgggagttcgtgcgcaatcaaaccgacccagtttcttcaccggcgtttgagagccaaatccacaaacttttctttttcttctttgccacggagagggttcgtatgcagagctgcggagtacaagttcccggatccaattcccgaattcgccgaagctgagactaagaaattcaaggaccatatgacaaagaaactatcaaagagggatctttttgaagactctgttgatgagattgtgggagtttgcactgagatcttcgagacgttcttgcgcagcgagtatggaggacctggaacactnttggtcataccnttcatcgacatggctgatacctcaatgaaagggaactgcctggaggtccacaagccgcncgtgcagctatcaaatgggctcaggatcatntagacaaggattggaaagaatggactggcactgattagtaacaccaccagaaccncnaatcatcaaaatatanttcagtactcatgtatcagaggatagattgtctttgtaaaactctgaattttgcggatttcggtattctgttagctctgttgttatacaatcgcatggtctcatcagcttttttcctagttgattcatgtatggttcagtagatt

SEQ ID NO: 848 - DNA, 815 bp, Raphanus sativus
  misc_feature (210)..(210): n is a, c, g, or t
  misc_feature (213)..(213): n is a, c, g, or t
  misc_feature (216)..(216): n is a, c, g, or t
  misc_feature (225)..(225): n is a, c, g, or t
  misc_feature (231)..(231): n is a, c, g, or t
  misc_feature (252)..(252): n is a, c, g, or t
  misc_feature (261)..(261): n is a, c, g, or t
  misc_feature (268)..(268): n is a, c, g, or t
  misc_feature (273)..(273): n is a, c, g, or t
  misc_feature (362)..(362): n is a, c, g, or t
  misc_feature (369)..(369): n is a, c, g, or t
  misc_feature (408)..(408): n is a, c, g, or t
  misc_feature (423)..(423): n is a, c, g, or t
  misc_feature (429)..(429): n is a, c, g, or t
  misc_feature (460)..(460): n is a, c, g, or t
  misc_feature (480)..(480): n is a, c, g, or t
  misc_feature (483)..(483): n is a, c, g, or t
  misc_feature (486)..(486): n is a, c, g, or t
  misc_feature (520)..(520): n is a, c, g, or t
  misc_feature (560)..(560): n is a, c, g, or t
  misc_feature (563)..(564): n is a, c, g, or t
  misc_feature (634)..(634): n is a, c, g, or t
  misc_feature (647)..(647): n is a, c, g, or t
  misc_feature (651)..(651): n is a, c, g, or t
aaagtgtgcaaaatggcttctttagacgcagctctcttctctactcggcttcaattccattcatccatccgttgtgctcttccaaccatcttcaatctctcttcaccagccgcgagttcatgcgtaatcaaaccgacccagtttcttcaacggcgtttgatatccaaatcgacgaacttttctctttcttccttgccacggagagggttngtntgnagagctgcngagtanaagttcccggatcccataccngaattcgcngaagctnagacnaagaaattcaaggaccatatgacaaagaaactatcaaagagggatctttttgaagactctgttgatgagattgtcggagtctgcactgngatcttngagacgttcttgcgcagcgagtatggaggacctggaacnctcttggtcataccnttcatngacatggctgatactctcaatgaaagggaantgcctggaggtccacaagcngcncgngcagctatcaaatgggctcaggatcatgtagacnaggattggaaggaatggaccggcactgattagtaacccanccnnacctcaaatcatcaaaatatagttcagtactcatgtatcagaggggatagattgtctttgtaaaactctnaattttgcagatntcgntattctgttagctctgttcttatacaatcgcttggcctcatcagctgttttcctagttgattcatgtatggttcggtagattatcttgaacatgtggagtgtaacgatgaccgataactaactcggtacatcttaaataaatcggttatatcggttcacagacc

SEQ ID NO: 849 - DNA, 702 bp, Brassica juncea
ccgttcaattacgtttcatcctcgtccatcccgtttacttgctctttcctaaccaaatacttcaatactctcttcaccagctgtgagttcgtgcgcaaccaaatcgacccagtttcttaaacggcgtttgagagccaaatcgacgaacttttctctttcttcactgccacggagagggttcgtatgcagagctgcggagtacaagttcccggatccaatacccgaattcgccgaagctgagactaagaagttcagggaccatatggcaaagaaactgtccaagagggatctttttgaagattctgttgatgagattgtcggagtctgcactgagatcttcgagacgttcttgcggagcgagtatggaggacctggaacactcttggtcatacccttcatcgacatggctgatactctcaatgaaagggaacttcctggaggtccacaagccgcacgtgcagctatcaaatgggctcaggatcatgtagacaaagattggaaggaatggaccggcactgattagtagcacctgaacctcaaatcatcaaaatatagttcagtactcatgtatcagaggatatattgtctttgtaaaactctgaattttgcagatttcagaattttattagttctcttcttatataaaatccttggtctcatcatttgtttcccaaagtgatcactgtatggttgagtagattc

SEQ ID NO: 850 - DNA, 855 bp, Arabidopsis thaliana
ccctcaaaactttcaatttcttacattttcaccctttaattgaaacctcgctaaaaccctcagctgttttattgcagaaaacaagagataaggttgaagagtgaagcaaagcttagtaatggcttcaatgcacgaagctctgttctcttctcggcttcttcaagtcaattcttctttttccttccgttgcgctcttccaattatctcttcaccagctgcagtatcttgcgcaatcaaatcgacccagttttttaaacagcgttgtagaaccaaagtgagggacttttctctatcttcactgtcccggagagggttcgtttgcagagctgctgagtacaagtttccggatcccatacctgaattcgccgaagctgagactgagaaatttagggaccatatgttaaacaaactatcaaaaagagatctttttgaagactctgttgatgaaattgttggagtctgcactgagatcttcgagacgttcttgcgcagtgagtatggaggacctggtacactcttggtgatacctttcattgacatggcagatactctcaacgaaagggaattgcctggaggtccacaagccgcccgagcagctattaaatgggctcaggatcatgtagacaaggactggaaggaatggaccggcactgattagtcccctgggagcattaagtataatccgtgagttatttagtttagtagtggggtagcagatgtgtcattgtaaaactctgattactatgtcgtgaagcacttaatctttgatcaaaaactgtttggtgtaaacttgtccaaacgactggaaacaagaaaaagaaaagatggcaaaagctttttattgttcttattcag

SEQ ID NO: 851 - DNA, 980 bp, Arabidopsis thaliana
gaacaggatctgttctataggctcgtacctctgtttccttgatttctaaggagacaggccctaaaccctggttgatgaaccatgaccgtgcggtcagagcgtgattgatggctacgatcgtcttcggacgcatccggtgctgtagaggatcgttactcggcttggtcttccttgccggggtggtcgcacggcggtctgacagaaaacaagagataaggttgaagagtgaagcaaagcttagtaatggcttcaatgcacgaagctctgttctcttctcggcttcttcaagtcaattcttctttttccttccgttgcgctcttccaattatctcttcaccagctgcagtatcttgcgcaatcaaatcgacccagttttttaaacagcgttgtagaaccaaagtgagggacttttctctatcttcactgtcccggagagggttcgtttgcagagctgctgagtacaagtttccggatcccatacctgaattcgccgaagctgagactgagaaatttagggaccatatgttaaacaaactatcaaaaagagatctttttgaagactctgttgatgaaattgttggagtctgcactgagatcttcgagacgttcttgcgcagtgagtatggaggacctggtacactcttggtgatacctttcattgacatggcagatactctcaacgaaagggaattgcctggaggtccacaagccgcccgagcagctattaaatgggctcaggatcatgtagacaaggactggaaggaatggaccggcactgattagtcccctgggagcattaagtataatccgtgagttatttagtttagtagtggggtagcagatgtgtcattgtaaaactctgattactatgtcgtgaagcacttaatctttgatcaaaaactgtttggtgtaaacttgtccaaacgactggaaacaagaaaaagaaaagatggcaaaagctttttattgttcttattcag

SEQ ID NO: 852 - DNA, 1005 bp, Eutrema halophilum
gaacaggatcagttctataggctcgtacctctgtatcctagatttctaaggagacaggccctcaaaacctggttgatgaatcatagccgtgcgacttgagtgtgattgacggctacgattctcctcggagtctccgcgctgtagaggatcgctacctggtctggtcttgacctagccagggtggtcgcacggttgtctgacagataaagataaggttcgatagtgaaagcaaaaccgttactaatggcttctttacacgaagctcttttctcttctcggcttcaattctatacgtcttccattatctctacttcttcttcatcttcgtccttccgttgtgctcttccagttttctctaatctctcttcaccagccgcgagctcttgcggaatcaaatcgacccagtttcttaggcggcgttctagagccaaattgacggacttttctctttcttctctgtctcggagagggtttgtctgcagagcttccgagtataaatttccggatcccataccggaattcgccgaagctgagactgagaaatttagggaccatatgctaaagaaactatccaagagagatctttttgaagactccgttgatgaaatcgtcggagtctgcactgagatattcgggacattcttgcgcagtgagtatggaggacccggaacactcttggtcatacccttcatcgacatggcagatactctcaatgaaagggaattgcctggaggtccccaagctgctcgagcagctattaaatgggctcaggatcatgtagacaaggactggaaggaatggaccggtactgattagtattaacctcgaatcctcaaaatataattcgtcggagtcatttagttcagtagtgatgtatcagaggatagaagtgtcgttgtaaaactctgaattttgagatattggtctgttatagtgtctgttctaataatcgtttttggcatcatttgttctcttggtgatttgtgtatgtttgaatagattctt

SEQ ID NO: 853 - DNA, 791 bp, Thellungiella halophila
ggatgaccaaacagacgttgctcttgcagagataaagataaggttcgatagtgaaagcaaaaccgttactaatggcttctttacacgaagctcttttctcttctcggcttcaattctatacgtcttccattatctctacttcttcttcatcttcgtccttccgttgtgctcttccagttttctctaatctctcttcaccagccgcgagctcttgcggaatcaaatcgacccagtttcttaggcggcgttctagagccaaattgacggacttttctctttcttctctgtctcggagagggtttgtctgcagagcttccgagtataaatttccggatcccataccggaattcgccgaagctgagactgagaaatttagggaccatatgctaaagaaactatccaagagagatctttttgaagactccgttgatgaaatcgtcggagtctgcactgagatattcgggacattcttgcgcagtgagtatggaggacccggaacactcttggtcatacccttcatcgacatggcagatactctcaatgaaagggaattgcctggaggtccccaagctgctcgagcagctattaaatgggctcaggatcatgtagacaaggactggaaggaatggaccggtactgattagtattaacctcgaatcctcaaaatataattcgtcggagtcatttagttcagtagtgatgtatcagaggatagaagtgtcgttgtaaaactctgaattttgagatattggtctgttatagtgtctgttctaataatcgtttttggcatc

SEQ ID NO: 854 - DNA, 3112 bp, Brassica rapa
atatttttgcaattttgaaccatcgaagtcatttactattttgtatggcgaggctatctctacgtggcgcaatgtctaccaggaaatctgaatcgacgacttgactaaggattcacatgactcgtaactcctccttggcaccgttactaatctaacatctctctctctctctgtggaactctcatcaccttatcatctcccgtaacaaaaccaaaatgttcctcttaaagacatggagatcaaccgctttcgggatttatggctatatgaatttcaccaagaatggtttcctagaccattcaaagaagttcaaacctgaagatatgcagatacaaatccaaggaaagaactgtgtggtcactggagctaactctggtattggttacgccgctgctgaaggtcttgcttcacgtggagcaactgtttacatggtgtgtcggaacaaggaaagaggagaagaggctctttctaagattcaaaactctacaggaaaccagaatgtctaccttgaagtttgtgatttgtcttctgttaatgatataaagtcatttgcttcgagttttgcttccaaggatgttccggttcatgtgctggttaataacgccggtttgcttgagaacaaacgaacgactacacctgaaggattcgagttgaacttcgcggtgaatgtacttgggacatacacaatgacagagctgatgcttccactgttggagaaagcgtcgcctgactccaaagtcatcacggtctcctctggtggaatgtacacgtcgccacttacaacagatcttcagtttagtggtgaaaagttcgatggagtgttacaatatgcacggaataaaagaatccaggtggctctgacagaaaaatgggctgagaagtacaagaacaaaggcataggtttctactcaatgcaccctggctgggctgagacgcctggtgtcgccaggagtttgcccagtttcaaagaatcgttctctggtaagcttagaacgagcgaagaaggggcagacacagtcgtttggctagcacttcagcctaaagagaagctggtctctggtgcattctattttgatagagcagaagcaccaaaacatctgacgcttgcaggtacaagcaagtctcatgaccttatagactctgtcattgacacattgcattccatggcagctcttgatccttaaaatctatatcttctacatggtttttttctcgagaataatttgtgatcgatctctggtaaatatcacaatggaataagattcaaatattaaacttttctattctttccttggaaagtattattgtgctggatgattacatagtatcagatgaacataacaaatacacatggtttttaacattggcatagtagccatgttatggttcccatcatgatttttttttgtgtgtaatattttacttatgagatgagtagaaaggtaaaagctggtgttttcgaagccaatactgtttgaatctctgcttcgaatactcgagataattgaagtcaatcttgttcacatagccctagatgattccccataaaccccagaagagatggctcgccaatgtatacttctcgacatcatccaaaagctgttctatgtcttcctctcttggttcttcacctgttttaaaaccaagtcttaagtcataggaagtaactttcttactaaatttttaaaactaacggaataggctttttaacctgaagaggcgaggtagttgcagatgaatctcctcctttcttcttctcctgcaactccaaaccatgaattcaaaaagcctacatctagatgatggaattacaaaagattcgttaattgatcactgtacctggatataaagtgtagtccaagatatgaggagtgtcagaatggtaatttgctaccatctcacagaagtgatttgctatgtcataagcaactggattgtaacttgcatactcataatcctgtccaaaacccccattgattagacatagaaactaaacgattcagcttcatcaatgcatgatgacaatgtttagcctttgagttaatggtaaggttttttttttttgtaccatgctagaaaagaaaatgaaagtgtttaaaagaaaaatgtgtatgtaagactttacaatgatagtgatggcattggtgtcttcatcaatcatgatgttaccatactgcaaatcattgtgagaaaaacctatttcttgttggtggtactcattgttcacttcttgttctagcaagttgatttcatcttcaatattgtctagaccaaactcttctgaatgttcagctgaacacagattcttggcttgtcctacccaagtcctgttatgtttccaatgaaaattacttttgtgtgatctaaacatttattgggaaaaaggactaatacgaactgaagtttcttacctcatcctgtcccagatgtgaacagtttgatctccaggaatgtttatgctgtgaaattttcttagcttagttgccactaaagctgatatgttgggatcacgaagatcgcttgctgatagggtctgatccaaagatcaacaaagaattttggttatgcatctaatggaaacactgtggacaacttttaaaccctcatataactcaatcggtataaagctaaacaggccattactaatttactcggttggattttactacagtttaaaacgcagattaatatgtaaaaccaattataagagcggataaggtttgctactttgctcaatctagttaacctggaccagaattgtaccaaaaccaaaggaagtatagaccgatatcggtttctttaatttcataagtgagagcgaaccgaaagaaaaatagacagagttaaaaactatccgaaaacaaatagaaaataaaggaaacagtcaaacagcccatgattgtattcggtttcaatccgatttcaatatttcataaaccgaacaaatagaaaatcaaataaagatgcaaccaaaaaaaaaagattggacattttctacacttttcacatctaaaccggatgaatctcctcggtttggaatcatccggtttaaactccaacagcaagggtaaaccattttatactagcgaatcaaatatattagcaagtcggt

SEQ ID NO: 855 - DNA, 1879 bp, Brassica napus
gtcgtctccccccgaacccgtagagtttgttaatcttagtaagaagacccctactctctctctctgtggaactctcatcaccttatcatctcccgtaacaaaaccaaaatgttcctcttaaagacatggagatcaaccgctttcgggatttatggctatatgaatttcaccaagaatggtttcctagaccattcaaagaagttcaaacctgaagatatgcagatacaaatccaaggaaagaactgtgtggtcactggagctaactctggtattggttacgccgctgctgaaggtcttgcttcacgtggagcaactgtttacatggtgtgtcggaacaaggaaagaggagaagaggctctttctaagattcaaaactctacaggaaaccagaatgtctaccttgaagtttgtgatttgtcttctgttaatgatataaagtcatttgcttcgagttttgcttccaaggatgttccggttcatgtgctggttaataacgccggtttgcttgagaacaaacgaacgactacacctgaaggattcgagttgaacttcgcggtgaatgtacttgggacatacacaatgacagagctgatgcttccgctgttggagaaagcgtcgcctgactccaaagtcatcacggtctcctctggtggaatgtacacgtcgccacttacaacagatcttcagtttagtggtgaaaaattcgatggagtgttacaatatgcacggaataaaagaatccaggtggctctgacagaaaaatgggctgagaagtacaagaacaaaggcataggtttctactcaatgcaccctggctgggctgagacacctggtgtcgccaggagtttgcccagtttcaaagaatcgttctctggtaagcttagaacgagcgaagaaggagcagacacagtcgtttggctagcacttcagcctaaagagaagctggtctctggtgcattctatttcgatagagcagaagcaccaaaacatctgacgcttgcaggtacaagcaagtctcatgaccttatagactctgtcattgacacagtgcattccatggcagctcttgatccttaaaatctatatcttctacatggtttttttctcgagaataatttgtgatcgatctctggtaaatatcacaatggaataagattcaaatattaaacttttctattctttccttggaaagtattattgtgctggatgattacatagtatcagatgaacataacaaatacacatggtttttaacattggcatagtagccatgttatggttcccatcatgatttttttttgtgtgtaatatttacttatgagatgagtagaaaggtaaaagctggtgttttcgaagccaatactgtttgaatctctgcttcgaatactcgagataattgaagtcaatcttgttcacatagccagagatgattccccataaaccccagaagagatggctcgccaatgtatacttctcgacatcatccaaaagctgttctatgtcttcctctcttggttcttcacctgaagaggcgaggtagttgcagatgaatctcctcctttcttcttctcctggatataaagtgtagtccaagatatgaggagtgtcagaatggtaattgctaccatctcacagaagtgatttgctatgtcataagcaactggattgtaacttgcatactcataatcaatgatagtgatggcattggtgtcttcatcaatcatgatgttaccatactgctaaatcattgtgagaaaaacctatttcttgttggtggttactcattgttcacttcttgttcttagcaagttgatttcatcttcaatattgtctagaccaaaactacttctgaatgttcaagctgaacacagatttcttg

SEQ ID NO: 856 - DNA, 1252 bp, Brassica rapa
  misc_feature (717)..(717): n is a, c, g, or t
  misc_feature (906)..(906): n is a, c, g, or t
attttactattttgtatggagaggctatctctacgtggcgcaatgtctaccaggaaatctgaatcgacgacttgactaaggattcacatgactcgtaactcctccttggcaccgttactaatctaacatctctctctctctctgtggaactctcatcaccttatcatctcccgtaacaaaaccaaaatgttcctcttaaagacatggagatcaaccgctttcgggatttatggctatatgaatttcaccaagaatggtttcctagaccattcaaagaagttcaaacctgaagatatgcagatacaaatccaaggaaagaactgtgtggtcactggagctaactctggtattggttacgccgctgctgaaggtcttgcttcacgtggagcaactgtttacatggtgtgtcggaacaaggaaagaggagaagaggctctttctaagattcaaaactctacaggaaaccagaatgtctaccttgaagtttgtgatttgtcttctgttaatgatataaagtcatttgcttcgagttttgcttccaaggatgttccggttcatgtgctggttaataacgccggtttgcttgagaacaaacgaacgactacacctgaaggattcgagttgaacttcgcggtgaatgtacttgggacatacacaatgacagagctgatgcttccactgttggagaaagcgtcgcctgactccaaagtcatcacngtctcctctggtggaatgtacacgtcgccacttacaacagatcttcagtttagtggtgaaaagttcaatggagtgttacaatatgcacggaataaaagaatccaggtggctctgacagaaaaatgggctgagaagtacaagaacaaaggcataggtttctactcaatgcaccctggctgggctgagacncctggtgtcgccaggagtttgcccagtttcaaagaatcgttctctggtaagcttagaacgagcgaagaaggggcagacacagtcgtttggctagcacttcagcctaaagagaagctggtctctggtgcattctattttgatagagcagaagcaccaaaacatctgacgcttgcaggtacaagcaagtctcatgaccttatagactctgtcattgacacattgcattccatggcagctcttgatccttaaaatctatatcttctacatggtttttttctcgagaataatttgtgatcgatctctggtaaatatcacaatggaataagattcaaatattaaacttttc

SEQ ID NO: 857 - DNA, 1130 bp, Brassica juncea
cgcttccaacctaacatctctctctccctctccaccaagttccaagtcaggaactcgcatcaccttataatcttccgtaacaaaacccaaaatgttcctcttaaagacatggagatcaaccgctttcgggatttatggctatatgaatttcaccaagaatggtttcctagaccattcaaagaagttcaaacctgaagatatgcagatacaaatacaaggaaagaattgtgtggtcactggagctaactctggtattggttacgctgctgctgaaggtcttgcttcacgtggagcaactgtttacatggtgtgtcggaacaaggaaagaggacaagaggctctttctaagattcaaaactcgacaggaaaccagaatgtctaccttgaagtttgtgatttgtcttctgttaatgatataaagtcatttgcttcgagttttgcttccaaggatgttccggtccatgtgctggttaataacgccggtttgcttgagaacaaacgaacgactacacctgaaggattcgagttgaacttcgcagtaaatgtacttgggacatacacaatgacagagctgatgcttccactgttggagaaagcgtcacctgactccaaagtcatcacagtctcctctggtggaatgtacacgtctccacttacaccagatcttcagtttagtggtgaaaagttcgatggagtgttacagtacgcacggaataaaagaatccaggtggcactgacagaaaaatgggctgataagtacagaaacaaaggcataggtttctactcaatgcaccctggctgggctgagacacctggtgtcgccaggagtttgcccagtttcaaagaatcgttctctggtaagctaagaacaagcgaagaaggagcagacactgtcgtttggctagcacttcagcctaaggagaagcttgtctctggtgcattctattttgatagagcagaagcacctaaacatctgacacttgcaggtacaagcaagtctcatgacattatagactctgtcgttgataccgtgcactccatggcagctcttgatccttaaaatctatatcttctacaaggttttctctcgagaataaaatgtgatcgatctctggtaaatatcacagaat

SEQ ID NO: 858 - DNA, 1334 bp, Raphanus sativus
ggaactcctcctcggcaccgttacgactaatctaacacctctctctctccaccaactcaggaactcgcatcatcttatcatcatcttccgtaactaaaccaaaatgttcctcttaaagacatggagatcaaccgctttcgggatttatggctatatgaatttcaccaagaatggtttcctagaccattcaaagaagttcaaacctgaagatatgcagatacaaatacaaggaaagaattgtgtggtcactggagctaactctggtattggttacgccgctgctgaaggtcttgcttcacgtggagcaaatgtttacatggtgtgtcggaacaaggaaagaggagaagaggctctttctaagattcaaaactctacaggaaaccagaatgtctaccttgaagtttgtgatttgtcttctgttaatgatataaagtcatttgcttcgacttttgcttccaaggatgttcctgttcatgtcctggttaataacgccggtttgctcgagaacaaacggactactacacccgaaggattcgagcttaacttcgcaataaatgtacttgggacatacacgatgacagagctgatgcttccactgttggagaaagcctcacctgactccaaagtcatcaccgtctcctctggtggaatgtacacgtcgccacttacaacagatcttcagtttagtggtgaaaagttcgatggagtgttacaatacgcacggaataaaagaatccaggtggctctgacagaaaaatgggctgataagtacaagaacaaaggcataggtttctactcaatgcaccctggctgggctgagacacctggtgtcgccaggagtttgcccagtttcaaagaatcgttctctggtaagcttagaacaagcgaagaaggagcagacactgtcgtatggctagcacttcagcctaaggagaagctcgtctctggtgcattctatttcgatagagcagaagcaccaaaacatctgacgcttgcaggtacaagcaagtctcatgaccttatcgactctgtcattgattcagtgcactccatggcagctctttgatccttaaatctctatcttatcttctccattgtggttttctctcgagaataaaatgtgatcgatctcaggtaaatatcacacaattgaataaagattcaaatattaaacttttctttctttccgtggaagtattattgtactcataacagaagaaatacacatggtttttcaacattggcatagtagctaatattgtggatcccaaacattggattctttttttacttatgagatgagtagaaaggtaaaatctggtgctttctaagcc

SEQ ID NO: 859 - DNA, 1372 bp, Eutrema parvulum
ttctctcatatgaatcgacaacttaactaaggattaaacgccgtcgcatgacttgtgacgccgcaccattactaatctaagatctctttccaccaactcaggaactcgttttatctcccgtaacgaaaatgttcctcttaaagacatggagatcaaccgctttcggtttttacggctacatgaatttcaccaagaatggtttcctagaccattcaaagaaatttaaacctgaagatatgcagatacaaatagaaggaaagaactgtgtggttactggggctaactctggtattggttacgctgctgcagaaggtcttgctgcacgtggagcaactgtttacatggtgtgccggaacaaggaaagaggacaagaggctctttctaaaatccaaagctcaacaggaaaccagaatgtgtaccttgaagtgtgtgatttgtcctccgttaacgatataaagtcgtttgctacgagttttgcttctaaggatgttccagttcatgtgctggttaataatgctggtttacttgagaacaaacgtactactacgcctgaaggattcgagttaaattttgcggtgaatgtactcggaacatacacaatgacagagctgatggttccactgttggagaaagcgtcaccagactccaaagttataaccgtatcctctggtggaatgtacacgtcgccactcacaacagatcttcagtttagtggtgaaaaattcgatggagtgttacaatacgcacggaacaagcgcattcaggtggctctgacagaaaaatgggctgataagtacaagaacaaaggcataggtttctactcaatgcaccctggctgggctgagacacctggtgttgccaggagtttgccgagtttcaaagaatcgttctcaggtaaacttagaacaagcgaagaaggagcagacacaatcgtttggttagcactgcaagctaaagataagctggtctctggttcattctatttcgatagagcagaagcaccaaaacatctgacgcttgcaggtacaagcaagtctcatgatcttatagactcggtcattgataccgtgcactccatggcagctcttgatccttaaagtctctatcttcgacatgtttttgttctcaagaataaaatgtgatcacaggtaaatatcacagtgaaataagattctagtattaaacttctctttcttttcaggaaattattattgtgctggatgatttatatcttattactcattacatagtatcagaacagaagagtcacacatagtttttagcattggcatagctatattatggatccatcattgtataacgttctacttatgagatgggtagaaagataaaagctggggctttcgaagcc

SEQ ID NO: 860 - DNA, 2445 bp, Eutrema halophilum
gtggcgcatcctctaccggaagttctctcttctgaatcgacgacttgtctaaggattcccaaacgccgtcgcatgagtttgaaactcggcaacattacttaatctaacatctctctctacaccaaatcagtaaaaacaaacaaaatgttcctcttaaagacatggagatcaaccgcattcggaatttacggctacatgaacttcacaaagaacggtttcctagagcattcgaagaagtttaaacctgaggatatgcaaatacaaatagaaggaaagaattgtgtggttactggtgctaattctggtattggttacgccgctgctgaaggtcttgcttcacgtggtgcaaatgtttatatggtgtgccggaacaaagaaagaggacaagaggctcttactaagattcaaagctcaactggaaaccagaatgtgtacctagaagtgtgtgatttgtcttccgttaacgaaataaagtcatttgctacgagttttgcttcaaaggatgttccggttcatgttctggttaataatgccggtttgcttgagaacaaacgtacaattacacctgaaggattcgagttaaacttcgcggtcaatgtactcggaacgtacacaatgacaaagctgatgcttccactgttggagaaagcgtcaccagacgccaaagtcatcactgtttcctctggtggaatgtacacttcaccacttacaacagatcttcagtttagtggtgaaaattttgatggagtgttgcaatacgcacggaacaaacgaatccaggtggctctgactgagaaatgggctgaaaaattcaagaacaaaggcatagggttctactcaatgcaccctggatgggctgagacacctggtgtggcaaagagtttgccgagtttcaatgaatcgttctctggtaaacttagaacaagtgaagaaggagcagatacaatcgtttggttagcattgcagcctaaagagaaactagtctctggttcattctatttcgatagagcggaagcaacaaaacatttgacgcttgcaggtacaagcaagtctcatgaccttatagactcagtcattgatactgtgcattcaatggcagctcttgatccttaatctccatcttcgacacggatttttttttctcgaaaataagttgtgattgcaggtaaaagtatggaacttttctctcttctgtggagttattatttattgtactgattatttatagcttttactcgttcaatagtatcagaacagaagcaagcattatagttatagatattatgcgtccattatcgtttttgtagaatattttactttggagatgggttgaatgacaaaagctggggctttcgaagccaatactgtttgaatctctgcctcgaatactcgatataatcaaactcaatcttgttcacatagccctagattattccccataagccccagaagagatggcttgccaatgtatatttctcaatatcatccaaaagctgttttatgtcttcttctcttgcttcttcatctgttaaaaaccaagttttagctttagtcataaggagtcttctcaagtcttttaaacaaaaagaacatagcttttacctgaagagctgaaatagttgcagataaatctcctcctattttcttctcctgcatttcccaaaccataattttttttttttttttgtaaactctactagattatggattataaatatttatttggttaatctatgtacctgggtatagagtatagtccaagatatgaggagtgtcagaatggtagtttgctaccatctcacagaagtgatttgctatgtcataagcaattggattataacttgcatactcataatcctgtccaaaatccatttttcacacaaactccactaatgattagacagataaattacacaagtagagaaatttcatgttcatcgatttacctcgagtaaattggggatttaattactttttccccattctggaaaaaaaaaaggaaaaaaaggttaagaaaatttgtggttatgagtaagacttacaatgatagtaatggcatttgtctcttcatcaatcatgatgttaccatactgcaaatcattgtgacaaaaaccaatttcttgctcattgttcatatcttgttctaacaagttgatttcatcttcaatgttgtctagaccaaactctgttgaatcttcagttgaacatagattcttggcttgtcctacccaagtcctgttatgttcccatggatattaccatcttgtaatcgaaacatttattgaaaaagctgaatttttttaagtttgttacctcattctgtcccagatgagaacagttttatctcctggaatgtatatgctgtgaaatcttcttagcttagatgcaaccagagctgatatgttcgggtcacgaagatcggttgcggatagggtctgattcgaa

SEQ ID NO: 861 - DNA, 1589 bp, Thellungiella halophila
  misc_feature (12)..(12): n is a, c, g, or t
  misc_feature (1473)..(1473): n is a, c, g, or t
ggccatcacggnggcgcatcctctaccggaagttctctcttctgaatcgacgacttgtctaaggattcccaaacgccgtcgcatgagtttgaaactcggcaacattacttaatctaacatctctctctacaccaaatcagtaaaaacaaacaaaatgttcctcttaaagacatggagatcaaccgcattcggaatttacggctacatgaacttcacaaagaacggtttcctagagcattcgaagaagtttaaacctgaggatatgcaaatacaaatagaaggaaagaattgtgtggttactggtgctaattctggtattggttacgccgctgctgaaggtcttgcttcacgtggtgcaaatgtttatatggtgtgccggaacaaagaaagaggacaagaggctcttactaagattcaaagctcaactggaaaccagaatgtgtacctagaagtgtgtgatttgtcttccgttaacgaaataaagtcatttgctacgagttttgcttcaaaggatgttccggttcatgttctggttaataatgccggtttgcttgagaacaaacgtacaattacacctgaaggattcgagttaaacttcgcggtcaatgtactcggaacgtacacaatgacaaagctgatgcttccactgttggagaaagcgtcaccagacgccaaagtcatcactgtttcctctggtggaatgtacacttcaccacttacaacagatcttcagtttagtggtgaaaattttgatggagtgttgcaatacgcacggaacaaacgaatccaggtggctctgactgagaaatgggctgaaaaattcaagaacaaaggcatagggttctactcaatgcaccctggatgggctgagacacctggtgtggcaaagagtttgccgagtttcaatgaatcgttctctggtaaacttagaacaagtgaagaaggagcagatacaatcgtttggttagcattgcagcctaaagagaaactagtctctggttcattctatttcgatagagcggaagcaacaaaacatttgacgcttgcaggtacaagcaagtctcatgaccttatagactcagtcattgatactgtgcattcaatggcagctcttgatccttaatctccatcttcgacacggatttttttttctcgaaaataagttgtgattgcaggtaaaagtatggaacttttctctcttctgtggagttattatttattgtactgattatttatagcttttactcgttcaatagtatcagaacagaagcaagcattatagttatagatattatgcgtccattatcgtttttgtagaatattttactttggagatgggttgaatgacaaaagctggggctttcgaagccaatactgtttgaatctctgcctcgaatactcgatataatcaaactcaatcttgttcacatagccagagattattccccataagccccagaagagatggctgcncaatgtatatttctcaatatcatccaaaagctgttttatgtcttcttctcttgcttcttcatctgaagagctgaaatagttgcagataaatctcctcctatcttcttctccgggta

SEQ ID NO: 862 - DNA, 1248 bp, Arabidopsis thaliana
ctctctattctctcaatcgacaaacttgacttaaggattccaaacgtcgtcgcatgacttgtaactctgcaccattgctaatctaacatctcattctccaaaaactcaggaactcgaactatcttccacaactcacgaaaatgtttctcttaaagacatggagatcaaccgcttttggggtttatggctacatgaatttcaccaagagtggtttcttagatcattcaaagaagtttaaacctgaagatatgcagttacaaattgaaggaaagaattgtgtagttactggagctaattcaggtattggttttgctgctgcagagggtcttgcttcacgtggagcaactgtttacatggtgtgccggaacaaggaaagaggacaagaggctctttctaagattcaaacctcaacaggaaaccaaaatgtgtacttggaagtatgtgatttgtcttccgttaatgaaatcaaatcatttgcttcgagtttcgcttccaaggatgttccggttcatgtgctggttaataatgctggtttgcttgagaacaaacgtactactacacctgaaggattcgagttaagttttgcggtgaatgtacttgggacatacacaatgacagagttgatgcttccattgttggagaaagcaacaccagacgccaaagtcattacagttgcctctggtggaatgtacacttcgccgcttactacagatcttcagtttagtggtgaaaaatttgatggagtggaacaatacgcacggaacaaaagaatccaggtggctctgacagaaaaatgggctgataagtacaaaaataaaggcatagggttctactcaatgcaccctggctgggctgagacaccaggtgttgccaagagtttaccgagtttcagtgaatcgttcgcgggtaagcttagaacaagcgaacaaggagccgatacaatcgtttggttagcactgcagccaaaagagaagcttgtctctggtgcattctatttcgatagagctgaagcaccaaaacatctaaagcttgcaggtacaagcaagtctcatgaccttattgactcagtcattgattctgtgcattccatggcagctcttaatccttaaatgtccatcttcgacatagtttttttcttgaaaataaaatgtgattgcacgtaacagtattagtcttttctcattattgtggaaatattatagtatggaatatttatatcttttacttattacatagtatcagaagttc

SEQ ID NO: 863 - DNA, 1161 bp, Arabidopsis lyrata
taactccgcaccattatcgctaatctaacatctcattctccaaaaactcaggaactatcttccacaactcacgaaaatgtttctcttaaagacatggagatcaaccgcttttggggtttatggctatatgaatttcaccaagaacggtttcatagagcattcaaagaagtttaaacctgaagatatgcagttacaaattgaaggaaagaattgtgtggttactggagctaattctggtattggttatgctgctgcagagggtctagcttcacgtggggcaactgtttacatggtgtgccggaacaaggaacgaggacaagaggctctttctaagattcaaacctcaacaggaaaccagaatgtgtacctggaagtatgtgatttgtcttccgttaatgaaataaagtcatttgcttcaagtttcgcttccaaggatgttccggttcatgtgctggttaataatgccggtttgcttgagaacaaacgtactactacacctgaaggattcgaattaaatttcgcggtgaatgtacttgggacttacacaatgacagagttgatgcttccattgttagagaaagcaacaccagacgccaaagtcattacagttgcctctggtggaatgtacacctcgccgcttacaacagatcttcagtttagtggtgaaaaattcgatggagtggaacaatacgcacggaacaaaagaatccaggttgctctaacagaaaagtgggctgataagtacaaagaaaaaggcatagggtactactcaatgcaccctggctgggctgagacacctggtgttgccaagagtttaccgagtttcagtgaatcgttcgcgggtaagcttagaacaagcgaacaaggagcagacacaatagtctggttagcactgcagcctaaagagaagctggtctctggttcattctatttcgatagagctgaagcaccaaaacatctaaagcttgcaggtacaagcaagtcccatgaccttatagactcagtcattgatactgtgcattccatggcagctcttgatccttaaatgtccatcttcgtcgtaatttttttttcttgaaaataaaatgtgattgcaggtaacaatatcaatctttctcctttgtggcattgttattgtgctggatatttattaacttttac

SEQ ID NO: 864 - DNA, 1209 bp, Cleome spinosa
cgattccaccaaaccgtttacttgcaccgtcgccgaaccaaactcgagaacgcgatcttgctctccaccatgttcctcctaaaggcatggagatcgacggctttcggtgcttatggctacctcaacttcaccaagaacggtttcgtagagcattcgaagaggttcaaccctgaagatatgcagatacagattgatgggaagaattgtgtggttactggtgccaattctggtatcggttacgccactgcgaagggccttgcttcccaaggggcaacagtgtacatggtgtgtcggaacaaggaaaggggagaagaggcactttccaagattcagagctcaacaggaaacaagaatctgcatcttgaagtatgtgatctgtcatccgttcaagaaataaagtcctttgcatcaagattcgcttccaaggatgtacccgttcatgttctggttaacaatgccggcttgcttgagaacaaacgaatcaccacacccgaaggatacgagctgaactttgcggtgaacgtattaggaacatacacaatgacagagctgatgctgccattgttggagaaagccgcaccagacgccaaagtcataacagtttcctcggggggaatgtacacttctcctcttactacagatctacagtttagcgaggaaagattcaatggagtcgagcaatacgcacgaaacaaacggctgcaggtggccctgacagagaagtgggcagagaagtacaagaataaaggaatagggttctactcaatgcaccctggatgggccgaaacacccggagtcgcaaatagtttgcccagtttcaatcaatcgttttcgggaaaacttcgaacgagcgaggaaggagcagacacgatcgtctggttggcactgcagccgaaagaaaaactggtggaaggtgctttttactttgacagagcagaagcaccaaagcacttgaagtttgcaggtacaagcaaatctcatagccttatcgactccatcaccggtactctgcattccgtggcgtctctcgattcttcaaacccgccgctatcatgatcgtctcaacaacgctctttaagattgaataaatacgatgcagaacatagttagtgattgttattcataatggatttgagtaaagttttcacatttttgtaaaaattctgagtgtgttgtacattgaacattacaagacaaggatttggtttg

SEQ ID NO: 865 - DNA, 1423 bp, Tropaeolum majus
ggcacaacagaggccataatctacgtcctctacttgtttaggccatttggctcatttcaacaaccaaaaaacaaagaacattcgtgaatactcaaatcaattcgctcactgtgatttttaaacttcgaagttaatttgtcttatcgaatttcagcaaccgactccagtaatgtttctcgtcaagacatggaggtcaacagtttttggtgtgtttgggtacctcaatttcacgaggaatggtttcctggaacactctaaaaaattcaagccagaagacatgcagatacgaattgaaggcaagaattgcatagttactggagccaattccggaattggatatgcaactgctgagggtcttgcttcacgtggagcaactgtctatatggtatgccgtaacaaggagaggggagaagctgctgtttctaaaattcaatctgcaactggcaattcaaatgttcatttggaggtatgcgatctttcatcggtaaatgagatcaagtcccttgcatccagatttgcttctaaagatgtgcccgttcatgttctggttaacaacgcggggttgctagagaataagcgcagtacaacaccagaaggattcgagtttagttttgctgtaaatgtgttaggaacatatgcgatgaccgagttgatgttgcctatgttggaaaaagcagcacctgatgcaaaagtcatcacagtttcgtcgggtgggatgtacagtgttcctttaacaacagatcttcagtttagtgaagaaaaatatgatggggtggtgcagtatgctcgaaacaagcgagttcaggttgcgttgacggaaaagtgggccgatatgtacaagaacaaaggtatcggattctactcaatgcacccaggttgggcagagacaccaggattgactaagagtttaccggatttcactacatcgttttcaaaaaagcttagaacaagcgaagaaggcgcagatacagtcgtctggttagcgttgcaaccgaaagaaagattggtttccggtgcgttctatttcgatagagctgaagcaactaagcacttggtgtcggcagctactgccaagtctgatagactaattgaacctattgtggatactcttcgttcaatggccttactttcgtagtacgtaacaaatttgcgaattgatatgtttcggagctcgattctaatatgtaaaatatcgtcgaagccaatgttgttgtgatgtatgcatctgcatataaatgtatggatttggttaaccgacatgtatatgtgtggttcggttttggttagttttttgcggttcggtttgtgtttactttaccttttacaatataaaaactcacacagttcatgcggttcgatttggttaaccaacaaaaagtgaaattaatttgaaaacctagtataataaaacatgaaataattt

SEQ ID NO: 866 - DNA, 1218 bp, Heritiera littoralis
gctaagtctacactcttggcagatgaaaaatgcaacattttacattgaaattcacatatccattagagcactaatcatgttccttctcaagacttggagagcatctgtttttggagtttatgggtacttgaatttcacaagaaatgggttcttggaccactccaagagattccaaccagaagacatgcaaatacgaatagaggggaagaactgcatagtcacaggagcaaactcgggcattggttttgcaactgctgagggtcttgcatcacgtggggcaactgtctatatggtgtgtcgtaacaaggagaggggagaagctgctctttcaaagattcagtcttcaacaggcaatccaaatgttcatttggagatttgtgatctttcatccatcagtgagatcaagtcctttgcatccagattctcttcaaaagatgttccagttcacgttcttgtcaacaatgctggattgatcgagcacaaacgagtcagcacatctgaaggatttgagttcaactttgctgtaaatgtattgggaacttatgccacaacagagtcaatgttgcctttgctggagaaagcagcacctgatgctcgagtcatcacagtttcatctggtggaatgtacactgctcccttgaccagtgatctacagttcagtgatggaaaatttgatggggtagagcaatatgctaggaacaagcgagttcaggtggcattaacagaaaagtgggctgaaatgtacaagaacaaaggaattgggttttactcgatgcacccaggctgggctgagacacctggagtagctaggagtttacctggtttcaacaattcgctttcaggaaagctcagaaccagtgaagagggtgctgacacagttatatggttgggtttgcagcctaaagagaagctggtgtctggtggcttctactttgatagagcagaagcacctaagcacttgaagttagctgctacaagccagtctcacgcaataatagactccattgtggacactcttcgttccatgttagcctctcatgattctaaaatttagctcccaagaaagcaggtaatcctctggtttgtaacgggcactttgaaagtaactacattaaaactttatgatatagagaaagaaactttggttgtattgccgtctcttactgagaaagcatgtattcttcaattttacttcgaaagacttttatttctagaccg

SEQ ID NO: 867 - DNA, 2336 bp, Eutrema parvulum
ccaaatttctccagtaatgataattatcattttttaaaaggtaggactaataagaaacgtcgtacaagtcaacaccaacgacgcgttcattgactaaaaaaagtactcgccgtctcctttgggctatctctcctctctgttaaaatcaggagaagaagctcacaagcagaactccttcaatcaacaccacccacacatggcttcgcgtacgctccacgcgctctccgtctcacccttgtttcttcttatccttctcttcgccgcgtcttcaccggcggaggctcagcaaccgtacgtcaacaaccaccagctggcctgcgaggtccgggactacgacaacataaccaatggcttcacctgtaatggcccgagctcttgccgttcctacctcactttctggtctcaaccaccgtacaacacggcgaactccatcgccggactcctcaacgtctccgccaccgagatccagtcgatcaacaacctcacctcagtaaccgccataatccccacccgtcgattggtcgttatcccggccaactgctcttgctccggcggcgggctttaccagcacaacgccacttacagacactccggcagacaggagacgtatttctcggtggccaacgatacctaccaagctctgtccacttgtcaagccatgatgtcgcagaacccttacggcgagaaaaacctaaccgccggattagacctcctcgtccctctacgttgcgcttgccccaccgaaaatcaaaccgccgccggattcaaatacctcctgacttatttggtcgcccggggagacagtatctccgccatcgccgagatgttcaggagcacatcagacgctgtaaccaacggtaacgagctcacgtcagacaacatcttctacttcacgcctcttctggttcctctcaggactgaacctaccagaatcgagatatctccgtcacctcctccgccggttgcaacgccgcctcagtcgtcgccggtggaacctccgggatcttcttctcacaagtgggttttcgtcggaattgggatcggagccggtttgcttcttttgatctcaatcttagctctcgtcttctgtttctacaaacgaaaatcgaaatcgccgtcgtcgtcgacggagcagaacaagctcactgattcatcgaccaaacaatctgttcccactacaggaacaaaccaatggtcaatcgatttatcaaaatcttcagaaaaatctggtctcaaatccgcaatcgaatctctaactctttacagattccacgatctccaatccgcgacttcgaacttcagcgacgagaacaaaatcaaaggctcggtgtatcgcgcaacgatcaacggagacgatgcggcggtgaaagtgatcaaagcagacgtctcttcctcggagatcagtctgttgaagaagctaaatcattccaatatcatccgtctctccggtttctgcatccgcgaaggaacctcgtaccttgtctacgagtactcggagaacggatcgatcagcgattggcttcactcttcggagaagaagaaaactctgacatggaaacagagagttgaaatcgctcgggacatagcagaagcattagactaccttcacaactacataacaccacctcatatccacaaaaacttggaatccaccaacgttcttcttgattctaatttcagagccaagatttcgaatttcggtgtagcgaggattcttgacgaaggcgatctcgatcttcagttaaccagacacgttgaaggaacacaaggctacttagctcccgagtatgtcgaaaacggagtcataactccgaagctagacgtgttcgcctttggagttgtggttcttgagcttctttcagggaaagaagcagtgacgatacagaaggagaaggaaaaagaagaacaagtagagatgttgtgtaaagagataaacaatgtgctaggaggtgagaatgtgagagagaagctaaaaacattcatggatccatctctaggaaacgagtatccgttagagcttgcttacaccatggctcagcttgctaagagctgcgtcgcaacagatcttaactcgcgtccatctatctctcaggttctaaccacgctcttgatgatcgtctcgtcctctatcgattgggagccttctcatgaccttcttcatgattcaggctctctttgcaactagttcttttatcccttttctttttatgtttgtcattaacaactatttagattttagattttgtgtaaacagataagataaggaccataaggtctaaaataattaccactctgtacaacaaagtaataaaatatatctgatagagaagctttgt

SEQ ID NO: 868 - DNA, 2316 bp, Eutrema halophilum
aaattccccacttatcatcattttcattttgacaggtaggagaagcaccaataagaaatgtcacggaaagtcaacaccaacgaccgcgtccgttgactaagaaagtccttcgccgtctcctttggttcatcatcatcttcttcctctctgttaaaatcaggagagaactcttccaatcaaaacaaacaccacaaccatggcttcactctccatctccaccttatttctcctcctcctcttcgccacgtcatcaccggcggaggctcagcaaccgtacgtcaacaaccgccagctcgactgcgaaaaccgagccttcgacaacataaccaacggtaacacctgtaacggcccaacctcttgccgctcctacctcactttctggtctcatccaccgtacaacacagccaactccatcgccggactcctcaacgtctccgccgccgagatccaatccatcaacaacctcaccaccgtcaccgccacaatcactcctcgtcaacttgtcatcatcccggccaactgctcctgctccggcgccggattctaccagcacaacgccacttacagaatctcaagacacgagacgtatttctccgtggccaacgatacataccaagctctgtccacgtgtcaagccatgatatcacagaactcttacggcgagaaaaaccttgtccctggatctgacctcctcgtccctctccgatgtgcttgccccaccgtgaatcaaaccgccgccggattcaattatctcttgacctatttggtctctcagggagacagtgtctccaccatcgccgatatgttcaggagcacaaccgacgccgttttagacggtaacgagctcaagtcaagcgacttgatctacttcttcactcctctttcggttcctctcaggactgaacctaccagaatcgtgacatctccgtcgcctcctccgccggttgctacgccgcctcagtcgccgccggtggagcctccgggatcctcctcttctcacaaatgggttttcgtcggaatcggaatcggagccggtttgcttctcttaatctcactctttgctctcttcttctttttctacaaacgaagatcgaaaccggaacagaacaagctcactgattcatcgaccaaacactctgttctcacaacaactcctcctcaatggtcaatcgatttgtccaaatcctcagatacatttggtctgaaatccgcaatcgagtccctgacgatttacagattccacgatctccaatcagctacttcgaatttcagcgaggagaacaaaatcaaaggctcggtgtatcgcgcaacgatcaacggcgacgatgcggcggtgaaagttatcaaaggagacgtctcttcctctgagatcagtctcttgaagaagcttaatcactccaatatcatccgcctctccggattctgcatccgagaaggaacctcgtaccttgtctacgagtactcggagaacggatcgattggtgattggcttcactcatcggacaagaagagaactttgacatggaaacagagagttgaaatcgctagggacatagcagaagctttggattaccttcataactacgtaacaccacctcatatacacaagaacttggaatccaccaacatacttctcgattctaatttcagagccaagatttcgaattttggggtagcgaggattcttgatgatggtgatcttgatcttcagttaactagacacgttgaaggaacacaaggctacttagctccagagtatgtcgaaaacggagtgatcactccgaagctagacgtgtttgcctttggagttgtggttcttgagcttctttcagggaaagaagtagtgacgatacagaaggagaagggagaagaagaagtggagatgttgtgtaaagagataaagaacgtgcttggaggagagaatgttagagaaaagctaaaagcgttcatggatccatctctagagaatgagtatccgttagagctggcttacaccatggctcagcttgccaagagctgtgtcgcacctgatcttaactcgcgtccatctattgctcaggtcttaaccaagctcttgatgatcgtctcgtcctccatggattgggaaccttctcatgaccttcttcatgattcgggctctcttggcgactagttcttcatttattttttttcaataataagtaattagattttagatttttttttgtactagacaagatatgggatcataaagctaaaacatttaggtagcagataaaataattggtaccactctttacaacaaagtaataagatatgatagagaagctttgtgta

SEQ ID NO: 869 - DNA, 2312 bp, Arabidopsis lyrata
atcatcctctttgtttaaatcaggagaaagctcacgagaatccctcttcaaatcagaaacaccacaaaacatggctgcgcgtacactccacgcgctctcagtctccaccttattcctcctcctcctcttcttcgccgcatcaccagcgaaagctcagcaaccgtacgtcaacaaccaccagctcgcctgcgaggtccgcgatttcgacaacataaccaacggattcacatgtaatggcccaatttcttgccgctcctacctcactttctattctcaaccaccgtacaacacggcggactcaatcgccaaactcttaaacgtttctgccgcagagatccaatcaatcaacaaacttcccaccgtcaccaccagaatccgtacccgtgacttggtcgtgatcccagctaactgctcctgctcctcctcctcctcctcctccggaggattttaccagcacaacgccacttacaatctctccggcaacagaggggaagagacttatttctcggtggctaacgatacttaccaagctttgtccacgtgtcaagccatgatgtcacagaaccgttacggcgagaaagaactaacccccggattaaacctccttgttcctctccggtgtgcttgccccaccgcgaaacaaaccgccgccggttttaaatatctcttgacttacttagtcgccaggggagatagtatctccgtcatcgccgataggttcaatagcacaaccgctgctataaccgaaggtaacgagcttacatcagaagacactatctacttcttcacgccggttcttgttcctctcagaactgaacctaccaaaatcgttatatctccgtcgcctcctcctccacctgttattgctacgccgcctcaaacgccggtggatcctccgggatcttcttcttcttctcacaaatcgatttacatcggcattggaatcggagctggtttgcttctcttaatctctatcttagctctctgcttctacaaacgaaggtctaagaacaaatcatcgtcgtcgtcgttaccggaggagaataagctctttgattcatctaccaaacaatctattcccacaacaacgactcaatggtcaatagatttatccaattcatcagaagctttcggtctgaaatccgccatagaatctctaacactatacagattcaacgatcttcaatccgctacttcgaatttcagcgacgaaaacagaatcaaaggctctgtttatcgcgcgacgatcaacggagatgatgcggctgttaaagtgatcaaaggagatgtttcttcctctgagatcaaccttttgaagaagctaaatcattctaatatcatccgtctctccggtttctgtatccgcgaaggaacctcgtacctcgtcttcgagtattcggagaatggatcgatcagtgattggcttcactcatcggataagaaagttctgacatggaaacagagagttgaaatagctagggatgtagcagaggcattagactatcttcataactacataactccacctcatatccacaagaacttggaatccacaaacatacttcttgattctaatttcagagccaagattgcgaatttcggggttgcgaggattcttgatgaaggtgatcttgatcttcagttaacaagacatgttgaaggaacacaaggctacttagctccagagtatgtggagaatggagtcattactccgaaacttgatgtgtttgcttttggagttgtggttcttgagcttctttcagggagagaagcagtgacaatacataagaagaaagagaaggaagaagaagaagaagtggagatgttgtgtaaagtgataaacaatgtgcttggaggagagaatgtgagagagaagttaaaagagttcatggatccatctctaggaaatgagtatccgttggagctggcttacaccatggctcagcttgctaagagctgcgtcgcaactgatcttaactcgcgcccatctgtcactcaggttctaaccacgctttcgatgatcgtctcctcctccatcgattgggagccttctgatgaccttcttcgttcgggctctcttggcaactagtttagttttttttttcttattggtagtcaataagtatttagattttagataaggaccataaggctaaaacgttgagatcaaataagtaccacactgtgaaacaaagtaataagaagatatcatagagaaactttatttagatcttggcatgttatttcagtagtcttttgtatttcagaaaaaaataatcattttcttccaatgagaagtagaatcttgagga

SEQ ID NO: 870 - DNA, 2289 bp, Arabidopsis thaliana
atcgtcctctctgtttaaatcaggagaaagctcacgagaatccctcttcagatcagaacaccacaaaacatggctgcgtgtacactccacgcgctctcagtcaccttattcctccttctcttctttgccgtgtcaccggcgaaagctcagcaaccgtacgtcaacaaccaccagctcgcctgcgaggtccgtgtctacgacaacataaccaacggattcacatgtaacggcccaccttcttgccgctcatacctcactttctggtctcaaccaccgtacaacacggcggactcaatcgccaaactcctcaacgtctccgccgcagagatccaatcaatcaacaacctccccacagccaccaccagaatcccaacccgtgaattagtcgtgatcccagctaactgctcctgctcctcctccagcggaggattttaccaacacaacgccacttacaatctctccggtaacagaggagatgaaacctatttctcagtggctaacgatacttaccaagctttatccacgtgtcaagccatgatgtcacaaaaccgttacggcgagagacaactaacccccggcttaaacctccttgttcctctccgatgtgcttgtcccaccgccaaacaaaccaccgccggatttaaatatctcctgacttacttagtcgccatgggagatagtatctccggcatcgccgagatgttcaacagcacatccgccgccataaccgaaggtaacgagcttacatcagacaatatcttcttcttcacaccggttctagttcctctcacaactgaacctaccaaaatcgttatatctccgtcgcctcctcctccacccgttgttgctacgccgcctcaaacgccagttgatcctccgggatcttcttcttctcacaaatggatctacatcggaattggaatcggagctggtttgcttctcttactctcaatcttagctctctgcttctacaaacgaaggtctaagaagaagtcattaccgtcgtcgttgccggaggagaacaagctctttgattcatcaaccaaacaatctattcccacaacaacaacgactcaatggtcaatagatttatccaattcatcagaagctttcggtttaaaatccgccatagaatctctaacactatacagattcaacgatcttcaatcagctacttcgaatttcagcgacgaaaacagaatcaaaggctctgtttatcgcgcgacaatcaacggcgacgatgccgctgtgaaagtgatcaaaggagatgtttcttcctctgagatcaatcttttgaagaagctaaatcattctaatatcatccgtctctcaggtttctgtatccgtgaaggaacatcgtacctcgtcttcgagtattcagagaatggatcgatcagtgattggcttcactcgtcgggcaagaagagtttgacatggaaacagagagttgaaatagcaagggatgtggcagaggcgttagattatctccataactatataactccacctcatattcataagaacttggaatcaacaaacatacttctggattctaatttcagagccaagattgcgaatttcggtgttgcgaggattcttgatgaaggtgatcttgatcttcagttaacaagacatgttgaaggaacacaaggctacttagctccagagtatgtggagaatggagtcattacttcgaaactagacgtgtttgcttttggagttgcggttcttgagcttctttcggggagagaagcagtaacgatacataagaagaaggaaggagaagaagaagtggagatgttgtgtaaagtgataaacagtgtgcttggaggagagaatgtgagagagaagttaaaagagtttatggatccatctctagggaatgagtatccgttggagctggcttacaccatggctcagcttgctaagagctgtgtcgcaactgatcttaactcgcgtccatctgtcactcaggttctaaccacgctctcaatgatcgtctcctcctccatcgattgggagccttctgatgaccttcttcgttccggctctcttggcaactagttcagttttttttttctattggtagtcaataacaagtatttagactttagataaggaccatacggctaaaaagttgagatctaataagtaccccactgtgaaacatagtaataagaacatatcatagagaaactttatttagattttgacatgttgcttcagtagtcttttgtatttcagaaaaaaataatcattttcttccaatgagaagtagaatcttgagga

SEQ ID NO: 871 - DNA, 2878 bp, Brassica rapa
tctatcctctctcctgaggaatgagatacgaagctcttttccgagatttaatgttgctcaatccatctcctcgcacttcgcttatcgcaatccacttcgtcttcttcttcatgtaagtctccacctcaatcaaataacaccaatggcttatcgtttccctctacattcaccatctccacactctcacttcctctctccctcaaaccaccctagaaaacacccctcctcaatctcaatctcatgccacaacacaaacgatcctcaccacgacgacgacgaagaaaaatccaaaatcaatctcctcgcaataccaatcacactcactctaatctccgcctctcttccccaaccctccctcgccgccgccgccgccgcaacgaagaagagatccctcaagaagcctcaagaagccttaaaacccgaacagctcaaatcctggtccaaagacctccccgtagtctccaaacgcatcccctacaccgaccttctaaccctcaaatcccaaaacaaactcaaacacgtcatcaaacctcaatccttaaccctacgccaaaaaccagagcccgtcttaatagtcttagaagactcgcacgtgctgagaaccgtgcttccgtcaatagacggtaacaaacggttttgggaacaatgggacgagttaaacatcgattcagtttgcgttaacgcttactcccctcccgttaagaagccacctgtcccatctccttacttggggttcctatggagagtcccgtcgtacatgctgacgttagccaagcccaagaaggagtctaaacgggccgcggagctgaagcggatgagggaggatttcaagaggcagaggaaggaggagatggagaggatgaacgaggagagcgaggagatggagaaggccatcaaggcgcagaagaagatgcaagagaggaagaagaggaaagctctcaggaagaagaagtacgaggagtctttagtagaagcgaggaggaactaccgtgacatgggccttatgtgggccagacttgccgaggattcgaacgtagcgactgctctcggattagtcttcttctacatcttttaccgcgtggttgtgttgaactataggaagcagaagaaggactacgacgataggttgaagatcgagaaggcggaggcggaggagaggaagaagatgagggagttggagagggagatggaaggggttgagttggatgatgaggaggaggaaggaggagggagtggggagaagaatccttacctgcagatggcgaagcagtttatgaagtcaggggcgcgtgtgaggagagcgtcgtcgaataggaggatgcctgagtatcttgagaggggtgtggatgtgaagtttacggatgttgcggggcttgggaagattcgtcttgagttggaggagattgttaagtttttcactcatggagagatgtataggaggagaggtgtcaagatcccaggtggtattctattatgtgggccacctggggtggggaagacgttactggcgaaagctgtagctggtgaagctggagtgaacttcttctctatctctgcttctcagtttgttgagatatatgttggtgttggtgcctctcgtgtacgagcgttgtatcaggaagctagagacaatgctccatctgtggttttcattgatgagttggatgctgttggaagagagcgtgggttgataaagggatctggaggacaagaaagggatgccactcttaatcagctccttgtttctttagatggttttgaaggaagaggagaggtgattaccatcgcgtccacaaatagaccagacattctagatcctgcgcttgtgaggcctggaaggttcgaccgcaaaatcttcattcctaagcctggtcttatcggacgtatggagattctacaggttcatgctcgtaagaagccgatggctgaagatttggactatatggcagttgctagcatgacagacggcatggttggagcagagcttgctaatatcgttgaaatcgcggctatcaatatgatgcgtgatggaagaactgagttaacaacagatgatttgcttcaagcggcacaaatagaagaaagaggaatgttagatagaaaagataggagctctgagacgtggagacaagttgctataaacgaagctgctatggctgttgtcgcagtgaactttcctgatctcaagaatatcgaatttctgacaatcaaccctagagctggtagagaattgggttatgtccgggtgaagatggatcacataaaattcaaagaaggcatgcttagccgacaatccctgttggatcacataactgttcagctagcacctcgtgctgcagatgaactatggtacggtgaggatcagttaagtaccatatgggctgaaacatcggataacgcaaggtcagctgctagatcactggttcttggtggtctctctgagaaacatcatggcttgaataacttctggatggctgatcgaatcaacgatattgatgtggaggcattgcggatattgaacatgtgttacgaccgtgctaaagagattctccaaaagaaccggacgctcatggacgaggtggtagagaaactggttcagaagaaaagtctttcgaaacaagagttcttcactcttgttgagctctatggctccattaaaccaatgccaccaagcatacttgaactcaggaaaatcaaacggctccagctccaagaggccgtgatgaaacaggacatgactagtgcaaggaacagttgataagatgatttgtggcaaaacgtagaccttgttgtaaccgtagtgacatgtgaacgagcttcaataaaaaaaaagttattttttcagttttgaaggaaatttcagtttcaaataattttg

SEQ ID NO: 872 - DNA, 2846 bp, Eutrema halophilum
tctatcccttggcctgggaaatgaggctagacgactacacgaagctcttttctgcgttttaatggcgctcaatctctctcgttgcgcttcgattattgcaattcacttcttcatgtaagtggaattcatctttactttgatcgaattacatcatggcttgtcgtttccctctgcattcgtcgccacactctcaattcctttctccggagaaccgtccaagaatcctgagatttcccagaaattacccctcaatttcatgccaaaacatttcagctacgaaggatgttcacgatgaagacggtgataacgaaaaagccaaggcaaaccaagtcaatcttctcgccatacccattacactcactgtgatatccgcttctcttgcccaaccgtcgcttgctgcggcggcgacgaaggtatccgagagaaagaaaacccagaagaaacctcaggaagctttgacacttgaacagctaaaagcttggtccaaagatctacctgtagtttcgaaacgtataccttataccgacattttgagcttaaaggatgaaggtaagcttaagcatgtaataaagccttcaggtttaagtttgcggcaaaaagcagagcctgtgttagtagttttggaggattctcaggtactgaggactgtgttgccttctctagagggtaataagaggttttgggaacaatgggatgagttagggatcgatgtagcgtgtgttaatgcatatactcctccggttaagaagccacctgtgccgactccttatttagggttcttatggaaagttccttcttatatgttaacatgggttaagccaaagaaggagtcgagacgtgctgctgaattgaagagaatgagggaggatttcaagaggcagaggaaggaggagatggagaggatgaaagaggaaagggagatgatggaaaagacaatgaaggcgcagaagaaacagcaggagaggaagaaaaggaaggcgcttaggaagaagaaatatgatgagtctttacgtgaggcgaggaggaattaccgagatatggcggatatgtgggcaagattggctcaggattctaatgtggctacggctcttggattagtgtttttttatatattctatcgtgtagtggtgctcaactacaggaagcaaaagaaggactatgaagacaggttgaagattgagaaggcggaagcagatgagaggaagaaaatgagagagttggagagggagatggaggggattgaggaagttgatgaggagcttgaggaaggaacgggtgagaaaaatccatacttacagatggcgatgcagttcatgaagtcaggcgcacgagtgagaagagcatcgaataggaggctacctgagtatctggagaggggtgtggatgtgaaatttacagatgttgctgggcttgggaagattcgccttgaactcgaggaaatcgtcaagtttttcactcatggagagatgtaccgcaggagaggagttaagattccaggtggtattcttttatgtgggcctcctggggtgggaaaaactttactggcaaaagctgtagctggtgaagcaggagtgaatttcttctctatctctgcgtctcagtttgtggaaatatatgttggtgtcggtgcatctcgtgttcgagcattgtaccaggaagctagagacaatgctccatctgtggtcttcattgatgaattggatgctgttggaagggagcgtgggttaataaagggatctggaggacaagaaagggatgctacccttaatcagctccttgtttcgctagatggttttgaaggaagaggagaggtcattaccatcgcttccacaaacaggccagacattctagaccctgcacttgtgaggcctggaaggttcgatcgtaaaatttttatccctaaacctggtcttattgggcgaatggagattctgcaggttcatgctcgtaagaagccaatggctgaagatttggattatatggcagttgctagcatgacagatggtatggttggagcagagcttgctaatatagttgagatagcggcaataaatatgatgcgtgatggaaggacagagttaacaacagatgatttacttcaagctgcacaaatagaagaaagaggaatgttagatagaaaagatcggagctctgagacatggcgacaagttgctataaacgaggctgctatggctgttgtggcagtgaactttcctgatctgaagaatatagaatttctgacaatcaaccctagagctggtagagaattgggttatgtccgggtaaagatggatcatatcaaatttaaggaaggcatgcttagccgacaatccctcttggatcacataactgttcagctagcacctcgggctgcagatgaactatggtacggtgaggatcagttaagtacgatatgggctgaaacatcggataatgcaaggtcagctgctagatctttggttcttggtggtctttctgagaagcatcatggcttgaataacttctgggtagctgatcgaattaacgatattgatatggaggcgttgcggatattgaacatgtgttacgagcgtgctaaagagattcttcaaaggaaccggacgctcatggacgaggtggtagagaaactggttcagaagaaaagtctttcgaaacaagaattcttcactcttgttgagctctatggctccattaaaccagtgccaccaagcatccttgaactcaggaaaatcaaacggctccagctcgaagagaccgtgatgaaactggacatgactaccgcaagaaacagttgataagatgatattgttttggagaagagagacagttcgttgcaaacgtagaga

SEQ ID NO: 873 - DNA, 2797 bp, Eutrema parvulum
ttatcgaattacgtcatggcttgtcgtttccctctgcattcattgccatactcgcaattcctttctccggagaaccgtcagagaatcctgagatttcccagaaattacccttcaatttcatgccaaaacaattcagctacgaatgatgctcacgatgacggtggcgataacgaaaaagccaaggctaagcaagtcaatcttctcgccatacccatcacactcacggtattctccggttctctggctcaaccgtcgcttgctgcggctgcgacgaaggtatccgagagaaagaaaagccagaagaaacctcaggaagctttgacacttgaacagctaaaagcttggtctaaagatctgcctgtagtatcgaaacgtataccttataccgacattttgagcttaaaggttgaaggtaagctcaagcacgtgataaagccttcaggtttaagtttgcgtcaaaaggcagagcctgtgttagttgttttggaggattctcaggtactaagaactgtgttgccttctttagagggtaataagaggttttgggaacaatgggatgagttagggatcgatgtagcatgtgttaatgcctttaatcctccggttaagaagcctcctgtcccgactccttatttaggtttcttatggaaagtgcctgcttatatgttaacatgggttaagccaaagagggagtcaaaacgtgctgctgagttgaagagaatgagggaggatttcaagaggcagaggaaggaagagattgagaggatgaaagaggaaagagagatgatggaaaagacaatgaaggcgcagaagaaacagcaggagaggaagaaaaggaaggcacttaggaaaaagaaatacgaagagtctttgcgtgaggcgaggaggaattatcgagatatggctgatatgtgggcaagattagctcaggatcctaatgtggctacagctcttggattggtgttcttttatatattctaccgtgtagtggttctcaactataggaagcaaaagaaggattacgaagacaggttgaagatcgagaaggcagaagcagatgagaggaagaaaatgagagagttagaaagggagatggagggcattgaggaagatgatgaggagattgaggaaggcacgggtgagaaaaatccatacctacagatggcaatgcagttcatgaagtcaggcgcacgtgtgagaagggcatcaaataagaggctacctgagtatcttgagaggggtgtggatgtgaaatttacagatgttgctgggcttgggaagattcgccttgaactcgaggagatcgttaagtttttcactcatggagagatgtaccgcaggagaggggtcaagattccaggtggtattcttttatgtgggcctcctggggtgggaaagactttactggcgaaagctgtagctggtgaagcaggagtgaatttcttctctatttctgcttctcagtttgttgagatatatgttggtgttggtgcctctcgtgtccgagcattgtaccaggaagctagagacaatgctccatctgtggtcttcatcgatgaattggatgctgttgggagggagcgtgggttaataaagggctctggaggacaagaaagggatgctacacttaatcagctccttgtttcgctggatggttttgaaggaagaggagaggtcattaccattgcttccacaaacagaccagacattctagatcctgcgcttgtgaggcctggaaggttcgaccgcaaaattttcattcctaaacctggtcttattgggcgaatggaaattctgcaggttcatgctcgtaagaagccgatggctgaagatttggactacatggcagttgctagcatgacagatggcatggttggagcagagcttgctaatattgttgaagtagcggcgataaatatgatgcgtgatggaaggacagagttaacaacagatgatttgcttcaagctgcacaaatagaagaaagaggaatgttagatagaaaagataggagctctgagacgtggcggcaggttgctataaatgaagctgctatggctgttgtggccgtgaactttcctgatttgaagaatatagaatttttgacaatcaatcctagagctggtagagaattgggttatgtccgagtgaagatggatcatatcaaatttaaggagggaatgcttagccgacaatccctcttggatcacatcactgttcaattagcaccccgggctgcagatgaactatggtacggtgaggatcagttaagtaccatatgggctgaaacttcggataacgcaaggtcagctgctagatcattggttcttggtggtctttctgagaagcatcatggcttgaataacttctgggtagctgatcgaattaatgacattgatctagaggcattgcggatattgaacatgtgttacgagcgtgctaaagagattcttcaaaggaaccggacgctcatggacgaggtggtagagaaactggttcagaagaagagtctttcgaaacaagaatttttcactcttgttgagctctacggctctataaaaccagttccaccaagcatccttgaactcaggaaaaccaaacggctccagctcgacgacaaggtgatgaaagtgaacacaatgaccgtgagaaatagttcataaagatgattgtgttttggacaagagagatgcaaaggtggagatttcacatcataacgcattacaataaatgagctccatcttttatgttttcctctgtaatcttagtgaactttagataattctttgagcttcaata

SEQ ID NO: 874 - DNA, 2668 bp, Arabidopsis lyrata
atggcttgtcgtttccctctacattcgtcaccaccttcccaattcctttcaccggaaaatcgtcagagattacccagaaattacccttcaatctcatgccaaaacaattcagctgatgttcatgatgatggtgatgagaacgaaaaagtcaagacaagccaagtcaatcttcttgcaatacccatcactctcactgtaatctccgcttctctagcccaaccgtcgtttgcggcggcgaaggtatcggaaagaaagagaactcagaagaaacctcaggaggctttgacaattgaacagcttaaagcttggtccaaagatttacctgtagtttcgaatcgtataccttatactgacattttgagcttaaaagctcaaggtaagctcaagcatgtgataaagcctcctaatttaagtttgaggcaaaaagcagagcctgtgttagtagttttggaggattctagagtactgaggactgtgttgccttctctagagggtaataagaggttttgggaagaatgggatgagttagggattgatggacaatgtgttaatgcttatactcctccggttaagagacctcctgtgccgtctccttatctagggtttttgtggaaagtgcctgcttatatgttaacatgggttaagccaaagaaggagtcgaaacgtgctgcggagttgaagaaaatgagggaggatttcaagaggcagaggaaggaggagattgagaggatgaaagaggaaagagcgatgatggaaaagactatgaaggcgcagaagaaacaacaggagaggaagaaaaggaaggctgttaggaagaagaaatatgaggagtctttgcgtgaggcgaggagaaattatcgagatatggcggatatgtgggcaagaatggctcaggatcctaatgtggctacagctcttggattggtgttcttttatatattttatcgtgtggtggtgctcaactataggaagcaaaagaaggattatgaagacaggttgaagattgagaaggcggaagcagatgagaggaagaaaatgagggagttagaaagggagatggagggaattgaggaagaggatgaggagcttgaggaagggacaggtgagaaaaatccatacttacagatggcgatgcagttcatgaagtcaggcgcacgtgtgagaagagcatcaaataagaggctacctgagtatcttgagagaggtgtggatgtgaaatttacagatgttgctggacttgggaagattcgtcttgaacttgaagaaatcgttaagttttttacgcatggagagatgtaccgcaggagaggggtcaagattccaggtggtattcttttatgtgggcctcctggggtcggaaaaactttactggcaaaagctgtagctggtgaagcaggagtcaatttcttctctatctctgcttcgcagtttgtggagatatatgttggtgttggtgcatctcgtgtccgagcattgtaccaagaagctagagagaatgctccatctgtggtcttcattgatgaattagatgctgttggaagggagcgtgggttaataaagggttctggaggacaagaaagggatgccactcttaatcagctccttgtttctttagatggttttgaaggaagaggagaggtcatcaccattgcttccacaaacagaccagacattctcgatcctgcgcttgtgaggcctggaaggttcgaccgcaaaatttttatccctaaacctggtcttattggacggatggaaattctgcaggttcatgctcgtaagaagccgatggctgaagatttagactatatggcagttgctagcatgacagatggcatggttggagcagagcttgctaatatcgttgagatcgcagcaattaatatgatgcgtgatggaagaacagagttaacaacagatgatttgcttcaagctgcacaaatagaagaaagaggaatgttagatagaaaagacaggagcttgaagatatggcgacaagttgctatcaatgaagctgctatggctgttgtagcagtgaactttcctgatcttaagaatatagaatttctgacaatcaaccctagagctggtagagaattgggttatgtccgggtgaagatggatcatatcaaatttaaggaaggcatgcttagccgacaatccatcttggatcacattactgttcagttagcacctcgtgctgcagatgaactatggtacggtgaggatcagttaagcacgatatgggctgaaacatcagataacgcaagatcagctgctcgatcattggttctaggtggtctttctgataagcatcatggcttgaataacttctgggtagctgatcgaataaacgatattgatctggaggcactgcggatattgaacatgtgttacgagcgtgctaaagagattcttggaagaaacaggacgctcatggacgaggtggtagagaaactggttcaaaagaaaagtctttcgaaacaagaattcttcactcttgttgagctctatggctccattaaaccaatgccaccgagcatccttgaactaaggaagatcaaacggcttgagctcgaagagacggtgctgaaattggacatgactaccgcaaaaaacagttcataagatcaaaacccattatagaggcaatgagcttgatcttttatct

SEQ ID NO: 875 - DNA, 1203 bp, Brassica rapa
ctaaccacggatacaccacttcatattgtatttctaatatagttgtcaaatgttttttgagaatcatataaatggatcttaacggctatatgtacatatactattaataatatgatctctatgaaacattattttgtcttgaacattttgtattgacttggccatctcattccaacaaagtcacaactcatcactccacacattatacttccatataaaccatccccttcccacctcgctataccaatcactcttcacagtttaactgaacaaactagtaatggctatcgcacgtctaactctagctcctctcctcctcatcgccgccgtgattctctcaacggagacatcagctcagccggcagcacccgctccaggccctgctggtcctataaacctcacggcaatcctcgaaaaaggcggtcaattcactaccttcatccatcttttgaaaatcactcaagttggggaacaagtgaacattcaagtcaacagttcatccgaaggcatgaccgtgttcgcgccaacggacaatgctttccaaaacctcaaggccggaactctaaacaagttgagcgcagacgaacaagtcaaactcattctctaccacgttagccctaaattctacactttggacgatctcctctccgtaagtaacccggttaggactcaagcttccggccgtgacaacggtgtttacggtcttaacttcaccggtgaagctaaccaagtcaatgtctcaacgggttacgtggagacacgtgtcagcaacgcgttgagatcacaacgtcctctcgcggtatatgttgtggacatggttttgttgcctggtgagatgttcggagagcacaagctttccccgattgctcctgccccgaaatctccgaccactggggtttccgatgatgacaccaagtctaactcaagtaaaaaggctgcagcgccggcagataagtcagcatctggtgagaggagagttggacttgggtttggttttggacttgttgtcttatgtttgaagtttctcttttgaatattgtgatcgttgccttgtatttgtttctgattattccacccggtttggattatgaaatttgttcatttatttccgtgaaatgaaatgagagattattaatttactacatataacattcgtctatagttgtcattagtaatgtactaatgtctaaatgtctaagtcaa

SEQ ID NO: 876 - DNA, 1049 bp, Brassica rapa
atactattaataatatgatctctatgaaacattattttgtcttgaacattttgtattgacttggccatctcattccaacaaagtcacaactcatcactccacacattatacttccatataaaccatccccttcccacctcgctataccaatcactcttcacagtttaactgaacaaactagtaatggctatcgcacgtctaactctagctcctctcctcctcatcgccgccgtgattctctcaacggagacatcagctcagccggcagcacccgctccaggccctgctggtcctataaacctcacggcaatcctcgaaaaaggcggtcaattcactaccttcatccatcttttgaaaatcactcaagttggggaacaagtgaacattcaagtcaacagttcatccgaaggcatgaccgtgttcgcgccaacggacaatgctttccaaaacctcaaggccggaactctaaacaagttgagcgcagacgaacaagtcaaactcattctctaccacgttagccctaaattctacactttggacgatctcctctccgtaagtaacccggttaggactcaagcttccggccgtgacaacggtgtttacggtcttaacttcaccggtgaagctaaccaagtcaatgtctcaacgggttacgtggagacacgtgtcagcaacgcgttgagatcacaacgtcctctcgcggtatatgttgtggacatggttttgttgcctggtgagatgttcggagagcacaagctttccccgattgctcctgccccgaaatctccgaccactggggtttccgatgatgacaccaagtctaactcaagtaaaaaggctgcagcgccggcagataagtcagcatctggtgagaggagagttggacttgggtttggttttggacttgttgtcttatgtttgaagtttctcttttgaatattgtgatcgttgccttgtatttgtttctgattattccacccggtttggattatgaaatttgttcatttatttccgtgaaatgaaatgagagattattaatttactaaaaa

SEQ ID NO: 877 - DNA, 849 bp, Brassica napus
accaatcactcttcagagattaagtaaacaaactagtaatggctatcacacgtctaactctagctcctctcctcctcatcgccgccgtgattctctcaactgagacatcagctcagccggcagcacccgctccaggccctgctggtcctatcaacctcacggcaatcctcgaaaaaggcggtcaattcactaccttcatccatcttttgaaaatcactcaagttggggaacaagtgaacattcaagtcaacagttcatccgaaggcatgaccgtgttcgcgccaacggacaatgctttccaaaacctcaaggccggaactctaaacaagttgagcgcagacgaacaggtcaaactcattctctaccacgtcagccctaaattctacactttggacgatctcctctccgtaagtaacccggttaggactcaagcttctggccgagacaacggtgtatacgggcttaacttcaccggtgaagctaaccaagtcaatgtctcaacgggttacgtggagacacgtgtcagcaatgcgttgagatcacaacgtcccctcgcggtatatgttgtggacatggttttgttgcctggtgagatgttcggagagcacaagctttccccgatcgctcctgccccgaaatctccgaccactggggtttccgatgatgacaccaagtctaactcaactaaaaaggctgcagcgccggcagataagtcagcatctggtgagaggagagctggactagggtttggttttggacttgttgtcttgagtttgaagtttctcttctgaattatattgtgttcgtttgccttgtatttgtttctgattattccacccggtttggatt

SEQ ID NO: 878 - DNA, 903 bp, Raphanus sativus
ggagactcttcagacatcaagtaaacaaactagcaatggctatcacccgtctaactctagctcctctcctcctcatcgccgcggtgcttctctcaacggagacatcagctcagccggcagcaccagctccaggccctgctggtcctatcaacctcacggcaatcctcgaaaaaggcggtcaattcactactttcatgcatcttttgaaaatcactcaaatcggtagccaagtggacactcaagtcaacagttcatccgaaggcatgaccgtgttcgctccaacggacaatgctttccaaaacctcaaagccggaactctaaacaagttgagcgcagacgaacaagtcaaactcattctctaccacgtcagccccaaattctacactttggacgatctcctctccgtgagtaacccggttaggactcaagcttccggccgtgacaacggtgtttacggacttaacttcaccggtgaagctaaccaagtcaatgtctcaaccggttacgtggagacacgtgtcagcaatgcgttgagatcacagcgtcctctcgcggtgtatgttgtcgacatggttttgttgcctggtgagatgttcggagagcacaagctttccccgatcgctcctgcccctaaatctccgaccactggggtttccgatgacaacaccaactccactaaaaaggctcctgcgtcggcagataagtcagcatctggtgagaggagagttggactagggtttggttttggacttgttatcttgtgtttgaagtttatcttctgaatataattgtgatcgttgcattgtatttgtttctgatgattctatccggtttgggttatgaaatttgttcattaaattccatgaaatgaaatgtgagattattgatctactacaaaaaaaa

SEQ ID NO: 879 - DNA, 1043 bp, Eutrema parvulum
tagacattattttgtttataaaagttttgtattgacttggccatctcaatccaacaaagtcacaactcatcactccgaacattttacttccatataaaccattctcctccgatctcgctttcccaatcactcttcacacgttaactaaacacattagtaatggctatcactcgtctaactctagctcctctcctcctcatcgccaccgtgcttctctcaactgagacatcggctcagccggcagcacctgctccgggccctgctggtcccatcaacctcacagcgatcctcgtcaaaggcggtcaattcactactttcatacatcttttggacatcactcaagtcggaagtcaagtgaacattcaagtcaacagttcatctgaaggcatgaccgtgttcgctccaacggataatgcttttcaaaaccttaaaccagggactctaaacaagttaagcgcagacgaacaagtcaaactcattctctaccacgttagtcccaaattctacactttagacgatctcctctccgtaagtaacccggttaggactcaagcttctggtcgagacaacggtgtttacgggcttaacttcaccggccaaactaaccaaatcaatgtttcaaccggttatgtggagactcgtgtcagcaatgcgttgagagtacaacgtcctctcgcagtatatgttgtcgacatggttttgttgcctggtgagatgttcggaaaacacaagctttctccgattgctcctgccccggaatctccgtccactggtgtctccgatgatgactccaagtccaactccactaaaaaggcggcagcctcgccggccgatacgtcagcctccggtgagaggagagttggactcgggtttggttttggacttgttgtcttgtgtttgaaatttctcttctgaattttatgattgttgctttgtttttatttctattgattttatcctacgtttgagatatgaaatatgaaaatttgttcattaaattccatgaaatgacatgcgagattattactttattacatatgatc

SEQ ID NO: 880 - DNA, 1067 bp, Eutrema halophilum
aataatctgatctctatagacattattctgtcttcaaacatttggtattgacttggccatctcattccaacaaagtcacaactcatcactctaatcattcacttgcatataaaacattcccatccgatatcgttttcccattcactcttcacacgttaactaaacaaaaccaaaccaaaaaaaaatggatatcactcgtctaactatagctcctctcctcatcatagccgcattgcttctcacaaccgagacatcggctcagccagcagcaccagctccgggccctgctggtcccatcaacctcacagcaatcctcgaaaaaggtggtcaattcactactttcatccatcttttgaacatcactcaagtcggtagccaagtcaacatccaagtcaatagctcatctgaaggcatgaccgtgttcgccccaacggacaacgcttttcaaaaccttaaacctggaactctaaacaagttaagcgcagacgaacaagtcaagctcatcctctaccacgttagccccaaattctacagtttggacgatctcctctccgtgagtaacccggttaggactcaagcttctggcagagacaacggtgtttacgggctcaacttcactggtcaagctaaccaagttaatgtatcaaccggttatgtggagacacgtgtcagcaatccgttgagacaacaacgtcctctcgcggtttatgtagtagacatggttttgttgccgggtgagatgttcggagagcacaagctttcgccggttgctcctgctccaaaatctccgtcctctggggtttccgatgactccaactccacgaaaaaggcggcagcctcgccggccgataagtcaggctcctgtgagaggaaagtcggtctagggtttgttcttgggcttgttttcttgtgtttaaaatttctcttctgaattttatgatcgatgccatgttttggtttctattgatttgatcgtacgtacggtttgaggtataaaacatgaaatttgttcatttaatatcaattccatttcatggaaatctgagactattgcatataattttcgt

SEQ ID NO: 881 - DNA, 1038 bp, Arabidopsis lyrata
caatatctctatagacattatttgtcaacaaacgttttgtattgactttgccatctcatcccaactagatacaactcatcatttcaaacattttaacttccatataaagcattcccttccgatctcacttttccaatcactcttcccactttaactaagcaaaccaataatggctaccactcgtctaactctagctcctctcctcctcattgccctcgtactactcgtaaccaaggccacggctcagccggcagcccccgctccaggccctgccggtcccatcaacctcaccgcgatcctcgaaaaaggtggtcaattcactactttcatccatcttctaaacatcactcaagtcggtagccaagtgaacattcaagttaatagttcatcggaaggtatgacagtgtttgcaccaacagacaatgcttttcaaaaccttaaacccggaaccctaaaccagttaaccccagacgagcaagttaaactcattctctaccacgttagccccaaattttacagtatggacgatctcctctccgtgagtaatccggttaggactcaagcttctggccgagacaacggtgtttacgggcttaacttcaccggtcaaacaaaccaaatcaatgtctctactggttatgtggaaacacgtgttagcaatgcgttgaggcaacaacgtcctctcgcagtttatgttgtcgacatggttttgttgccaggtgagatgttcggagagcacaagctttcgccgattgctcctgcacctaaatctaaatccggtggggtttccgatgactccggctccactaaaaaggcagcctcgccgtcggataagtcaggttccggtgagaagaaagtcgggctagggtttggtcttggacttgttgtcttgtgtttgaaatttctcttttgaaaatttaatatcaatgatttgttttgctttctattgattttatcctgtgatttgaggtataaatatgaaatttgttaattaagttccgtgaaataaaatgtgagatttgtacttattattctcgt

SEQ ID NO: 882 - DNA, 1035 bp, Arabidopsis thaliana
gatatatctctagtctagacattatttgtctacaaacgttttgtattgacttggccatctcattccaacaagatacaactcatcactccaaacattcaacttccatataaaccattcccttccgatctcactttccaaatcactcttcacactttaactaagcaaaccaataatggctaccactcgtctaactctagctcctctcctcctcatcgcagccgtactactcgcaaccaaggcaacggctcagccggcagcccccgctccagagcctgctggtcccatcaacctcactgcgatcctcgaaaaaggtggtcaattcactactttcatccatcttctaaacatcactcaagtcggtagtcaagtgaacattcaagtcaatagttcatccgaaggtatgacggtgttcgcaccaacagacaatgcttttcaaaaccttaaacccggaaccctaaaccagttaagccctgacgatcaagttaaactcattctctaccacgttagccccaaatattacagtatggatgatctcctctccgtgagtaacccggttaggactcaagcttctggccgagacaacggtgtttacgggcttaacttcaccggccaaacaaaccaaatcaatgtctctactggttatgtggagacacgtattagcaattcgttgaggcaacaacgtcctctcgcagtttatgttgtcgacatggttttgttgcccggtgagatgttcggagagcacaagctttcgccgattgctcctgcccctaaatctaaatccggtggggttaccgatgactccggctccactaagaaggcagcgtcaccgtcggataagtcaggctccggtgagaagaaagtcggactagggtttggtcttggacttattgtcttatgtttgaaatttctcttttgaaaatttaatagcaaagatttgttttgctttctattgattttatcctgcgatgtgaggtataaatatgaaatttgttgattaagttccgtgaaataaaatgtgagatttttaataacata

SEQ ID NO: 883 - DNA, 1106 bp, Eutrema parvulum
ttgtcggcaaacatttttcaaaatgacttattagccaatcccatctcattccaactaagccacaactcaccactaaacatttttctcatccatataaaccatttcactcccaacctcactttacaatttatctccacacataaactcaaacttcaaacgctatggcgaccattcatctaactttagctcctctcctcctactcgccgccatcttcctctccaccgaggtaaccgctcagcccgcagctcccgctcctggccctgccggtccggtcaacatcacggcgatcctcgaaaaaggcggccaatttgttacttttatccgtcttttaaacacaactcaaatcggaaaccaagtcaacatccaagtcaacagttcatcagaaggcatgaccgtgttcgcaccaacagacaacgcttttcaaaaccttaaacccggaacactaaacaagttaagcccggacgaccaagtcaaactcattctttaccatgttagccccaaattctacacattggatgatcttctctccgtaagtaacccggtcaggactcaagcttcagggcgagacggtggagcggtttatggacttaacttcaccggtcaagggaaccaagttaacgtatcaaccggtgtcattgagacacgtgttagtaatgcattaagacaagaacgtccacttgcggtttacgtggtggacatggtattgttgccggaagagatgtttggagaacgcaagatatcaccggtggcaccagctccgaaatcaaaatctcctggtgtctccgatgactcagacgacacctctaagaaagcggcagctccgtcggagaagtctggctccggtgagatgaaggctggattagggtttggccttggacttgttctgttatgtttgaaattcatcgttaattgagttggtttctatatatttgttttattgtgcgggttgtaataagaaatttctttattgagtgaatatgttgcatcatgcatggattgaaaactgaaataagtgattaatattttaaattgtgcgtatatgacgatataaatttagttgtgaatttggtctaaaagtcgaaagacaaaatcgataatacttttt

SEQ ID NO: 884 - DNA, 1118 bp, Brassica rapa
gaaggaaggacaatactgtaagaaagacagaaaaggccaaaggaagaagataaaagaagaaagaaaggagagaccacaccacacaaaatgtataagacagagagagagagaatcatttgaagttggtagtccaatggcggcagcaaaggcagggatactcccgtggcttatcccatcatcctcggcgacttcttctccgctgttttcagctgctgtcaagttgccaggggtatggcgggtgaaagggaggaaagcagagaaggatgtatctgtctctgtcgccttcaatccttccggcaatttcgacatctcagccttcgactctcacgacgatacagataaagtggaacctccgatgcctccaacgagcggcaggtacgaagtagtcatagacaacgactcaattcagcggcttgacttatctccctttcagaccgccaccggcattacctcaccttcctcagctgatccaagagagtatctggatcggagcatcggattcacgatcaattacaggagagaagacgcaggggatccgcgtgagctttcggagtatccggacataaggctgtggttcgtaaggctggatgccatgtacccttggcttcctctcctgcttgactggagagccggggagcttgctcgttacgccgccatgctggtccctcaccagatgagcttgaggatgggtgtggttttcaatcccgaggccttggagctgttcgtcatgagcaaagtgtttgtcgtttatccatggctcaaacgtcacgctgtccccaagccccggctcaagacctccgacatggccaggatgctcggcttcggtatcggcgaccagctcttcgacttgatcgaccaatacgatcttcaaacaaccaccgattctctttagggcccttgtttcctcccctttaattctgtgcttcatctctcagaaaaaaataataattatgtaagaaccattctctagattcaaatttaaaatctgtaaaagaacagagtaaaattcaactacctagacgttaacttgagctacaagaaacttcttggcggcagcgagtctctcaacaaccacatccttttaatgtatattaaactatctttcatggtacatggac

SEQ ID NO: 885 - DNA, 1222 bp, Raphanus sativus
  misc_feature (20)..(20): n is a, c, g, or t
  misc_feature (35)..(35): n is a, c, g, or t
  misc_feature (169)..(169): n is a, c, g, or t
  misc_feature (175)..(175): n is a, c, g, or t
  misc_feature (177)..(177): n is a, c, g, or t
  misc_feature (629)..(629): n is a, c, g, or t
ggataaagacgagagagagngagagagaatcatanttgaagttgagttaattaaccggttgtccaatggcggcagcaaagacaggcctcctactctcgtggcttatcccatcatcatcggcggcggctccgctgttttcagttgctgtgaagttgccagtggtgagagngagganancagagaaggatgtatctgtctctgtcgccttcaatccttctggcaatttcgatatctctgccttggactctcacgacgattcagataaagtggaacctccgatgcctccaacgagcggccgatacgaagtagtcatagataacgactctattcagcgccttgacttatctccttttcagactgccaccggcatcacctcaccttcctcagctgatccaagagagtatatggatcggagcatcggattcacgatcaattacaagagagaagacccaggggatccccgtgagctttccgagtatccggacataaggctttggttcgtcagactcgatgccatgtacccttggcttcctctcctccttgactggagagccggtgagcttgctcgttacgccgccatgcttgtccctcaccagatgagcttgagaatgggtgttgttttcaatccngaggctttggagctcttcgtcatgaccaaagtctttgtggtttatccttggctcaaacgtcacggtgtccccaagcctaggctcaagacctctgacatggctaggatgctcggcttcggtatcggcgaccagctcttcgacttgatcgatcatcataccgattctctttaggtctcttctttcctccagtttccttggtctgattctcaataatgtaagaaccattcccatgaatacttattattgatagcatagccagcagagattcaaatttaaatatttgaagaaaaaaaaaagaagactactttaaattatactacctagacgttaacttggttctcaagaaacatcttggccgcagccaagtctctcaagttcctcgggaagttgctctacactatgtgcgattgcagcacgatcgttttagtggactcttttcggtgctcatcatctaacctcatgagagcatttgggaccactcaccggctttgtttcttgattccactctcttatctttatgtaagattctacatctttatgctgtattgtaatccgacattatcctctacctacttaatgcacgtttgattcca

SEQ ID NO: 886 - DNA, 1092 bp, Brassica rapa
acacaaaatgtataagacagagagagagagaatcatttgaagttggtagtccaatggcggcagcaaaggcagggatactcccgtggcttatcccatcatcctcggcgacttcttctccgctgttttcagctgctgtcaagttgccaggggtatggcgggtgaaagggaggaaagcagagaaggatgtatctgtctctgtcgccttcaatccttccggcaatttcgacatctcagccttcgactctcacgacggtacagataaagtggaacctccgatgcctccaacgagcggcaggtacgaagtagtcatagacaacgactcaattcagcggcttgacttatctccctttcagaccgccaccggcattacctcaccttcctcaggtaatcaatcacatttttaaaaatgtttggaatgaagcattagatttttcttttgtgtgtatgtatatagctgatccaagagagtatctggatcggagcatcggattcacgatcaattacaggagagaagacgcaggggatccgcgtgagctttcggagtatccggacataaggctgtggttcgtaaggctggatgccatgtacccttggcttcctctcctgcttgactggagagccggggagcttgctcgttacgccgccatgctggtccctcaccagatgagcttgaggatgggtgtggttttcaatcccgaggccttggagctgttcgtcatgagcaaagtgtttgtcgtttatccatggctcaaacgtcacgctgtccccaagccccggctcaagacctccgacatggccaggatgctcggcttcggtatcggcgaccagctcttcgacttgatcgaccaatacgatcttcaaacaaccaccgattctctttagggcccttgtttcctcccctttaattctgtgcttcatctctcagaaaaaaataataattatgtaagaaccattctctagattcaaatttaaaatctgtaaaagaacagagtaaaattcaactacctagacgttaacttgagctacaagaaacttcttggcggcagcgagtctctcaacaaccacatccttttaatgtatattaaactatct

SEQ ID NO: 887 - DNA, 968 bp, Brassica rapa
aagaaagaaaggagagaccacaccacacaaaatgtataagacagagagagagagaatcatttgaagttggtagtccaatggcggcagcaaaggcagggatactcccgtggcttatcccatcatcctcggcgacttcttctccgctgttttcagctgctgtcaagttgccaggggtatggcgggtgaaagggaggaaagcagagaaggatgtatctgtctctgtcgccttcaatccttccggcaatttcgacatctcagccttcgactctcacgacgatacagataaagtggaacctccgatgcctccaacgagcggcaggtacgaagtagtcatagacaacgactcaattcagcggcttgacttatctccctttcagaccgccaccggcattacctcaccttcctcagctgatccaagagagtatctggatcggagcatcggattcacgatcaattacaggagagaagacgcaggggatccgcgtgagctttcggagtatccggacataaggctgtggttcgtaaggctggatgccatgtacccttggcttcctctcctgcttgactggagagccggggagcttgctcgttacgccgccatgctggtccctcaccagatgagcttgaggatgggtgtggttttcaatcccgaggccttggagctgttcgtcatgagcaaagtgtttgtcgtttatccatggctcaaacgtcacgctgtccccaagccccggctcaagacctccgacatggccaggatgctcggcttcggtatcggcgaccagctcttcgacttgatcgaccaatacgatcttcaaacaaccaccgattctctttagggcccttgtttcctcccctttaattctgtgcttcatctctcagaaaaaaataataattatgtaagaaccattctctagattcaatttaaaatctgtaaaagaacagagtaaattcactaccaaaaaaaaaaa

SEQ ID NO: 888 - DNA, 793 bp, Eutrema parvulum
tggtcgtctatggccggcgcagcaggaaaggcaggtcttgtcccgtggcttatcccatcttcgctgtgtccagttgttcagttggcggcgttggaaagtggccccggcgtgtggcgtgtgagaaggaggaaagcggaggatgtttctgtctccgtcgccttcaatccttctggcaatttcgatatctctgcctttgactctcacgacgattcagataaagtggaacctccgatgcctccgacgaccggccggtacgaggtagtgatagacaacgactcgattcggcgcctcgacttatccccgtttcagactgccaccggcataacctcacctgagggctgagccaagagggtatttggatcgaaccatcggattcagcatcaactacaggcgagaagaggcaggagatccgcgtgagctttcggagtaccccgacataaggctgtggttcgtgaggctcgatgccatgtacccttggctccctcttctgctcgactggcgagccggggagctcgctcgttacgccgccatgctggtccctcaccagatgagcttgaggatgggtgtcgttttcaatcccgaggccttggagctcttcgtcatgagtaaagtgtttgtcgtctatccatggctcaaacgacatggtgtccccaagcccaggctcaagaccacctacatggccaggatgctcggcttcggcgtcgccgatcacctcttcgacttgatcgatcatcaaacaacaccacctcccctctgaaacacctttttctctttaatgggctttttataaaaa

SEQ ID NO: 889 - DNA, 1579 bp, Eutrema halophilum
aacatgcaaacaataataaacatcactgagctccaagtatttcttctataaatgtagactctctctcacgactcattgagtaaagagcccacttgttgtagctagagtccaaaaaaaaagaagaagttctatctctttctgatttgcttgcttcaatatgggtcctctacctatatcttcgattagaattgggaaaatagaggatgttcaagaactgataaaatccaaaccaaacaaagttcctgagagattcataagagaagccaatgagagaggactcttggtttcacttaagactcaccctcatcaacatattcctgttattgatctttctaagctatcagaacctcatactcatgatgatcatctctttgagattcttaagctgtcacaagcttgtgaagactggggatttttccaggttataaatcatgggatcgaagtgaaggttgtggaagatatagagaaagtggccaaagagttcttcgagatgccattggaggagaagaagaagtatccaatggagccagggaccgtacaaggttacggtcaagctttcatcttctctgaagatcagaagcttgattggtgcaacatgtttgctcttggtgttcatcctccttctattcgcaacccaaaactatggccttctaaaccggcccggttcagtgaaaatcttgaaggttactcgaaagagataaggaaactatgcaagaaattgttaaagtacatagcaataagtctgggtctaaatgaagagagatttgaggaaatgtttggggaggcagtgcaagcagtgaggatgaactattaccctccatgttcaagtcctgaccttgtcttgggacttagcccacattctgatggaagtgctctcactgttcttcaacagagcaagaacagttgtgttggccttcagatcctcaaggacaacacttgggtccctgttctacctcttcccagtgcccttgtcatcaacattggtgataccattgaggtgctaactaatgggaagtataagagtgtggagcatagggcagtaacaaacagagaaagggagaggcttacaatagtgacattctatgcaccaaactatgaagttgaaatagagccaatgggtgagttagttgatgatgaaactaacccatgcaagtatagaagctacaatcatggtgactatagttatcactatgtctccaacaagctccaaggcaaaaagtcccttgattttgccaggattctgaattaactaatattattttcaccacccctatcactctccattaactagttaccacttaatttgctttcttttgactaaaaaaaatatatttgttgaactttttatgtttataatgtataggaatgttccccacctagggtacttagtgtcatgattcaattccccaatgtgaatacaacttgtaatatattatatgtgtgtgtgggtggttttgggtgtgcatgtttatatgttcatatgtttatatgtatgtcgagaaggaacaacaacaacaacaataaaaataagaagaaaaaaaacattttatccatgcttattatgttgattacatttgtg

SEQ ID NO: 890 - DNA, 1286 bp, Gossypium hirsutum
ataggttgctaaatgtttgtggagtctccatgttatcttccacaatccagtaagtggccctccttctccaattcaagataacccatccctcccttctttttcactaatccaaaaccctttttctttctccagtttcctcattcatttccagttctcaacacaaattttcatcacccatcaagcttttcatcaatggcttcccttcaacaagcttcaatctctcttcaacccaagcttctttcatcttctcaacaccccagatcccttccctctctcaacctctctttttcagccactttcccttccctcaaactctccaccactcgccctcttcatggcggtgccaaaatgtcagcctccgccgcttccagctacgccaccgctttagccgatgtagccaagtccaacaacacccttgatgccaccagctccgacgttgaaaaagtcgagacaatcttctccgacccacaagtcctcgaattcttcaccaaccccaccattgatgtcctcaaaaaacgtcaggttttggatgagattgttagctcctccgagcttcagccgcacacggcgaattttttgaacatcctggttgatgccaagaggattgatcttatcaaagaaatcgtgaaagagttcgagttggtttacaatcagctgacggatacagagctggcggtggtgagttcagtggtgaaattggagtctcaacatttggcacagattgctaaacaggtacagaagctgactggtgctaagaatgttaggattaaaactatgattgacccaagtttggtagctgggtttactatcaggtatgggagttcagggtctaaattgattgatatgagtgttaagaagcaattggaagagattgctgctcagcttgatttgggtgatattcaacttgctgtatgagttttgaattcttttttctttttttaagaattgggtttgaagctttttggttattattgtaattgaaatgaatacttttaatgttaattgtatgaaatttgtgtatgatgagattgtttgatatgggagaaactgatagtagtttgggatatttcattaggaagggctagggggaaagttgatattttgggctaaattcttgcatcagattcaaggattctaagcctaaatctaatgaatttaaagcattcaagaagtatgaagcattcatgaatgagtcctgaaacatgggtatcaattcatttactagagtgtgatggaactttgagatatcagtgagtttgatttatatatttagaaacatttagtag

SEQ ID NO: 891 - DNA, 2784 bp, Gossypium hirsutum
agaagctgcctctctctcccctcttagagaacaatcaaaagtccttgcttgtaataatctggctattgagaggcaggcaggtgtctcttatgcttgttagggattcagttttcttagttgtgaaagactctttttcactctggccgctgcaacgaagctaaaattttctcgcacctcaaagtgggtgtggggggacaacaaagagctgattctgctttgtgttttaaggagatcaagatcatcccatatctggagactgcgacgtgtttcagagggtctttcgcttgattatggctaatgtccgtgttcgctaaagtacccagaagttcgattgtaccttatctttcttttttaacggtagtagaattaggtgctttcctctggtttttgaaccttaatgattacagtagtttgaagctagatttctatgtaagacaaaaggtaggtctcgtgtggatgtattgctaatctgtatcaccacaatggttaggttttcctgcttcaatgctcatatcggaagtcagaaaccaaagataactgttcagccatctgttgaagcgatgcatacaactatagaagatttttctcaagttcaagcccctaaggagtcgactaaagctgcaaacatggagtcattctgtccagagacacaaacaactgctgagattcatgaaagtgtcgaacctgttacggtttcttcttctccttatcctagctggaaatcagaggacgtaaaagacagagtcattcttgatagcagttccagggtccttcagaatccgcattatcttaagaagtgtagatctcttggaagtggcctttgcctggaggacgagttcctggacaaaatgatacagatgatgagactgatcaaggattttcatctgattcccatgaccatgggttggctgaagatggcagaaagcatatagcagtgagccaaaatgcttcattctcagaatctgttcaagtaagctctaaccatgtctataacgaactggttttctctataggagactctttacttccagaaaaggatggccatgatatctctaatttacctttgccttgtgagcgtgccaatgcctctggtgatcagacacccaataacgcacctgtgattgtaaaatcatgttctatgccaaatattgttgcatcagcactcctttttggaggacattctcctccaaaatgtttggcacgccgtacaagatcctctgaggatgtacatgttctcagcatgagacaaaaggagatcttaattcatgatgttgatactgaggtgatgcgagaacaagaaagagatgatggcatgcataaaaatcataaaactaactttgaaagttcttatgagggatttgaatcttatagttgttccgcatcagcaaaagactggatagtgccagtttcagatgatgtaagcccaatgaaaatgctgcaagaagaattgcgggttctgaatcagaatgaattgactggcaaggattttaagattaagcgaattgaggattgggtaagtggtcttcaacatgtccgcccatcagaagactcagttgaattatcctatcccaatgatcaggtaaaagcggagcctgctgtctctaatgatttgactgctgcaaaggtggatgttaaggtaactcctggcatggaagctgcaaaaagatatatatcttctttgagtacctcagcaagcacagctcaactggcaaatcatggtttggttgttataccgtttctcagtgcatttgtcagcttgaaggtgcttaatctatctggaaatgcaatagcaaggattactgctggtgctcttcctcgaggacttcacatgttgaatctgtcaaggaataatatatccaccattgagggtttacgtgagcttactcgacttcgtgtgctgaatctgagctacaatcggatatttagaattggtcatggtttggcttcttgttcctctcttaaagagttatacttggctggaaacaagataagtgaggtagagggtctccatcgtctcttaaaattgactgttttggatctgcgtttcaacaaaatctctactgccaaatgtcttggccaacttgcagcaaactataattccttgcaagccattggcttggaaggtaaccctgcacagaagaatgttggagatgaaaatctgaagaagcatttgcaagggcttcttccaaatttggtttactttaaccggcaggctattaaagtcagcacagtgaaggatggtgcagaacgatcagttaggctaggcatcagtgcccatcaatttgatcgtggccttagatcagaacacagagctactaggaagaacagccatggtacttctattcaccggccatcctcttcatccactcgtggtcacaaaagccaagtggcttccccaatgcagtcaagaggcaggcatgggcgctatcctcctagtggagcgaaggcaacaaataatcgtcaaaatcatcatgtagatcttggtagcaaagttctcaactttaaatcagagctttctatgcgaaggacccaaagcgagggaactctggggcttctatgaagtagagttactttgatgagtggaatctggtttttgactatttcacattcgagttagttggttgtcgtaactgcaataaatgtcactcaaggtatttggtgtgactagacatttttagagtagattttgccaaaatgggaaggaagtcctcatacttgtactgttagtaagtttcttatttgtatgcggggaaatgtgtggaaaacaataatgttgcatctcat

SEQ ID NO: 892 - DNA, 3280 bp, Gossypium raimondii
cgtaaattgattttgaatggttaattaaatgtttcagatttatattaaggaaaaaaatcagggccgtagatttgggttataaaatcagtgccaaagcttagggttagcgttgaagcttaaccttacgccattcattcaaaggaaacgaataacaaaaaggaaaaaaacaaactgtatatggttttacaaattatatataaagtaataacagaaaccaacgtgcttgttatttattgtgttttttttctccattttctagtagaagctgcctctctctcccctcttagagaacaatcaaaagtccttgcttgtaataatctggctattgagaggcaggtgtctcttatgcttgttagggattcagttttcttagttgtgaaagactctttttcactctggccgctgcaacgaagctaaaattttctcgcacctcaaagtgggtgtggggggacaacaaagagctgattctgctttgtgttttaaggagatcaagatcatcccatatctggagactgcgacgtgtttcagagggtctttcgcttgattatggctaatgtccgtgttcgctaaagtacccagaagttcgattgtaccttatctttcttttttaacggtagtagaattaggtgctttcctctggttttggaaccttaatgattacagtagtttgaagctagatttctatgtaagacaaaaggtaggtctcgtgtggatgtattgctaatctgtatcaccacaatggttaggttttcctgcttcaatgctcatatcggaagtcagaaaccaaaggtaagtccaagatttgctattggttcttgacaacttaagttaaatttgggctgtatactttagtgtttcctgactcaagtatccacttggccatcagaaaactgttcagccatctgttgaagcgatgcatacaactatagaagatttttctcaagttcaagcccctaaggagtcgactaaagctgcaaacatggagtcattctgtccagagacacaaacaactgctgagattcatgaaagtgtcgaacctgttacggtttcttcttctccttatcctagctggaaatcagaggacgtaaaagacagagtcattcttgatagcagttccagggtccttcagaatccgcattatcttaagaagtgtagatctcttggaagtggcctttgcctggaaggacgagttcctggacaaaatgatacagatgatgagactgatcaaggattttcatctgattcccatgaccatgggttggttgaagatggcagaaagcatatagcagtgagccaaaatgcttcattctcagaatctgttcaagtaagctctaaccatgtctataacgaactggttttctctataggagactctttacttccagaaaaggatggccgtgatatctctaatttacctttgccttgtgagtgtgccaatgcctctggtgatcatacacccaataacgcacctgtgattgtaaaatcatgttctatgccaaatattgttgcatcagcactcctttttggaggacattctcctccaaaatgtttggcacgccgtacaagatcctctgaggatgtacatgttctcagcatgagacaaaaggagatcttaattcatgatgttgataccgaggtgatgcgagaacaagaaagagatgatggcatgcataaaaatcataaaactaactttgaaagttcttatgagggatttgaatcttatagttgttccgcatcagcaaaagactggatagtgccagtttcagatgatgtaagcccaatgaaaatgctgcaagaagaattgcgggttctgaatcagaatgaattgactggcaaggattttaagattaagcgaattgaggattgggtaagtggtcttcaacatgtccgcccatcagaagactcagttgaattatcctatcccaatgatcaggtaaaagcggagcctgctgtctctaatgatttgactgctgcaaaggtggatgttaaggtaactcctggcatggaagctgcaaaaagatatatatcttctttgagtacctcagcaagcacagctcaactggcaaatcatggtttggttgttataccgtttctcagtgcatttgtcagcttgaaggtgcttaatctatctggaaatgcaatagcaaggattactgctggtgctcttcctcgaggacttcacatgttgaatctgtcaaggaataatatatccaccattgagggtttacgtgagcttactcgacttcgtgtgctgaatctgagctacaatcggatatttagaattggtcatggtttggcttcttgttcctctcttaaagagttatacttggctggaaacaagataagtgaggtagagggtctccatcgtctcttaaaattgactgttttggatctgcgtttcaacaaaatctctactgccaaatgtcttggccaacttgcagcaaactataattccttgcaagccattggcttggaaggtaaccctgcacagaagaatgttggagatgaaaatctgaagaagcatttgcaagggcttcttccaaatttggtttactttaaccggcaggctattaaagtcagcacagtgaaggatggtgcagaacgatcagttaggctaggcatcagtgcccatcaatttgatcgtggccttagatcagaacacagagctactaggaagaacagccatggtacttctacttaccggccatcctcttcatccactcgtggtcacaaaagtcaagtggcttccccgatgcagtcaagaggcaggcatgggcgctatcctcctagtggagcaaaggcaacaaataatcgtcgaaatcatcatgtagatcttggtagcaaagttctcaactttaaatcagagctttctatgcgaaggacccaaagcgagggaactctggggcttctatgaagtagagttactttgatgagtggaatctggttttagactatttcacattcgagttaagttggttgtcgtaactgcaataaatgtcactcaaggtatttggtgtgactagacatttttagagtagattttgccaaaatgggatggaagttctcatacttgtactgttagtaagtttcttatttgtatgcgggaaaatgtgtggaacacaataatgttgcatctcatctcttacgttttgtaccctttttgcttgcataagttgctgctttctcacttgttggttgctggtaatagtgacacaacatacagatcggagccttcttactttcaccgctccaatgcgagacagaaattagaatatccttc

SEQ ID NO: 893 - DNA, 1413 bp, Cajanus cajan
gaagacattacttttccacacatgatcatggcttctattatttttggtaggagtgctttcctcacctttcttctcatctgtacctttctttctgtttccaccattaaagtgtgtgaggcacaagccaagcctcctacagcgaaggggctatcatataccttctatgataaaagctgtcctaagcttgaatctatcatcagaaaagaactcaaaaagatcttcaagaatgacattggtcaagctgctggcttgcttcgccttcacttccatgactgctttgttcagggttgcgatgggtcagttttattggatggatcagcaagtgggccaagtgagaaagatgcaccacccaacttgactttgagagctgaggcctttaaaatcatcgaggaccttcgtagtcttctggagaagagctgtggaagagtcgtctcctgttccgacatcactgccctcgccgcgcgtgatgctgttttcctctcaggaggaccagagtacgagattccattgggaagaagagatggattaacctttgccacaagaaacgatacactggcgaatcttccaccaccctcaagcaacgccactacgatcctagactcgttggctacaaaaaacctagaccccaccgacgtggtagccctctcaggtgggcacaccataggcatcagccactgcaactccttctccgacaggctattccccacccaggacccagttatggacaaaacattcgggaaaaacctaagactcacgtgccccaccaacaccaccgtcaacaccactgtcttggacattcgatcccccaacaccttcgacaacaagtactacgttgacctcatgaaccgccagggcctcttcaactccgaccaagacttgtacactgataagaggaccaaaggcattgtcacaagctttgccgtcaaccagagtctgttctatgagaagtttgtgtttgctatgctcaagatgggtcagcttagcgtgttgacgggaacacaaggggagattcgtgccaattgctccgttaggaacaccgataccaagtccttcttgaccactatcgtgggtgatgtcgtggaacagataatagaaatgtaaccgggtcgtatgtgtgtgtgcatattctgtgtgttgtggccatgaataatattggtaaacccttgcttcttgtttaatttcgagggttttcggaaggatgataattaaggaatcattgtctaatgttcctagctagacgttgtacttcactaataatggaaggagcttaattactgtcacagtttggactttggaaaaattaaaaagctagctgcttctgcttgtattctatataaatttttgttaaatatgtcagtgtaagtttaaaattataaacgtggtaaattaaataagttatagtacttgatctgg

SEQ ID NO: 894 - DNA, 1389 bp, Cajanus cajan
ttttccacacatgatcatggcttctattatttttggtaggagtgctttcctcacctttcttctcatctgtacctttctttctgtttccaccattaaagtgtgtgaggcacaagccaagcctcctacagcgaaggggctatcatataccttctatgataaaagctgtcctaagcttgaatctatcatcagaaaagaactcaaaaagatcttcaagaatgacattggtcaagctgctggcttgcttcgccttcacttccatgactgctttgttcagggttgcgatgggtcagttttattggatggatcagcaagtgggccaagtgagaaagatgcaccacccaacttgactttgagagctgaggcctttaaaatcatcgaggaccttcgtagtcttctggagaagagctgtggaagagtcgtctcctgttccgacatcactgccctcgccgcgcgtgatgctgttttcctctcaggaggaccagagtacgagattccattgggaagaagagatggattaacctttgccacaagaaacgatacactggcgaatcttccaccaccctcaagcaacgccactacgatcctagactcgttggctacaaaaaacctagaccccaccgacgtggtagccctctcaggtgggcacaccataggcatcagccactgcaactccttctccgacaggctattccccacccaggacccagttatggacaaaacattcgggaaaaacctaagactcacgtgccccaccaacaccaccgtcaacaccactgtcttggacattcgatcccccaacaccttcgacaacaagtactacgttgacctcatgaaccgccagggcctcttcaactccgaccaagacttgtacactgataagaggaccaaaggcattgtcacaagctttgccgtcaaccagagtctgttctatgagaagtttgtgtttgctatgctcaagatgggtcagcttagcgtgttgacgggaacacaaggggagattcgtgccaattgctccgttaggaacaccgataccaagtccttcttgaccactatcgtgggtgatgtcgtggaacagataatagaaatgtaaccgggtcgtatgtgtgtgtgcatattctgtgtgttgtggccatgaataatattggtaaacccttgcttcttgtttaatttcgagggttttcggaaggatgataattaaggaatcattgtctaatgttcctagctagacgttgtacttcactaataatggaaggagcttaattactgtcacagtttggactttggaaaaattaaaaagctagctgcttctgcttgtattctatataaattttgttaaatatgtcagtgtaagtttaaaattataaacgtggtaaattaaataagttatag

SEQ ID NO: 895 - DNA, 1286 bp, Trigonella foenum-graecum
cggttccgcagccacaatctctttttctcttcatcaccaccatgtccgcgatcgcacgtcttagagcgatcgcaccgtcgctaaaaaccctcaaatccattctccaccgtccattcggatccgccgctgcgttacaatacaactacgacgaagaagaagatgaaaagttcgagtataacacgccacgtggcatgcttgacacggaaggttcggcgccggagcgtggtgttcagtgggttatgattggtgaacctggagctaagagacacgtgttcgctgaaagactctcgaagcttctagaagttcctcacatttccatggcttcgcttcttcatcaagaacttaatcctcgttcttctctttatcagcagatagcgagtgccttggatcatggaaaaattgtacctgaggaaatcatttttgctctgttatcaaagaggttggaagatggatgtgatagaggtgaaactggattcattcttgatggaattcctcgaacaagaatgcaagctgaaattctcaatcacattgctcatgttgatctagtggtgaatttcaaaagcccgcaagaggatttaatgaaaaagctctaggacttcgaaaatttacttcgtgccaagaacatatttttaagaccagctcttggaccccaaccaagcaatcacatgatgaatatgtccagaaacgtgcagaagagtccaagatgttggaagattactaccggaagcagaagaagcttctgaattcgaagtagcaggtggacagggagaaacctggcagggacttcttgctgcactacatctccagcatattaatgctcttagatcttcacagaagttgactgcctgaataaaaggcatcaatcttccatgtggcacccatccatcactcctcggcattataccatatgtgaatatgagagagccagtataatttaatggaaattttgtgatagtatcccaattattggtgattttgattttgagaatgttagtttgttctgtagtgaagctgtctaagtaagaatcaaatttgtagtagtgaccgcgtgatgagtccttttttgtttcgattgtgttccattctttttcttttctagtttctagtaatttgtctggtcccagaaacaaaaagcaaaggttacgttacactagtttcaagtgcatgtgaggttcaaactttagggctttcacgtgttagtctcagactttgtttactacagccaattatgtttcaaatctgtaaccaattcagtggaaaaaccaagttttcttttcttctcttct

SEQ ID NO: 896 - DNA, 1302 bp, Cicer arietinum
agtcgtctacgtacctacccaccacctacccaactacttactctacaacaaagaacaaaaaaaaaaaaaaagacatcaccatagccaccatgtccgcgatcgcacgactaagagcgatcgcagcgtcgctaaaaacactcaaattcaatctcaaccgtccattcggatccgcagctgcggttcaatacgactacgatgatgacgaagaagaacaattcgaacatagcgcgccacgtggcatgctcaacacagaaggttcggcgccggagcgtggtgttcaatgggttatgatcggtgaacctggagttaagagacaccttttctctgagagactctcgaagcttctagaagttcctcacatttccatggcctcactccttcatcaagaacttaaccctcgttcttctctttatcagcagatagcgagtgcattggatcatggaaaacttgtaccagaggaaatcatttttgctttgttatcgaagagacttgaagatggatactatagaggtgaaactggattcattcttgatggaatccctcgatcaagaatccaagcagagattcttgatcacattgctcatgttgatctagtggtgaatttcaaatttccgcaagaggatttcatgaaaaagaaactaggacttcgaaaatttacttcttgtcaggaacatgtttttacgaccagctcttggaccccaaccaagcaatcgcaggatgaacatgtccacagtcgttcagaagagtccatgatgttggaagattactacaggaagcagaagaaacttctgaatttcgaagttgcgggtggacccggagaaacctggcagggtcttctgactgcactgcatctccagcatattaatgctcttaattcttcacagaagttgactgcttgaagaaagggcgtcaatcttccatgtggcacccatctaatccctcctcggcattatagtatatgtgaatatgagagctagtagaatttaaaagaaattttgtgagtgtcccaattattggtgatcttgtttttgaaaattttgagtcagtttgttaagtagtgcagttgtccaagtaagaatcaaatacaaaatgtatgagtatgacaacaaattcttgtagtgactctgagtctattttgttcaattgtgttccattctttttctcttttctagtttctagtaacttgtatgatcccagaatcaacaagcaaaggacacgttacattagctttaaagtttaaagcatgtgatgttcaaactttaggactttcatatgtttgtatcactcttttactgtagcccc

SEQ ID NO: 897 - DNA, 1381 bp, Cicer arietinum
actcaactccaaccactacttaaagtttcaacagtaactgaccaaacaataatggcttcagcttccaccattaccttgtcttccttcctctacacaaaaaccccaaacccagagaaatcatcctctttgaacagaagtacccttagtgttggatctcaacgaaagcagtgcgtgtccgtgtcagcatcagcaaaatcttcacctccaccctatgaccttaattctttcaaatttaatcccatcaaggagtcaattgtttcacgggagatgacacgtaggtacatgacagacatggtcacacatgctgacaccgatgttgtcatcgtaggtgctggttccgctggtctttcatgtgcttatgaactcagcaagaatccttccatcaaaatcgctatcatcgaacaatctgttagccctggtggtggggcctggcttggtggccaactcttttctgcgatggttgttcgtaagccagcacatttgttcttgaacgagattggagtcgagtatgacgagaaagacgactatgtggtgatcaagcatgctgctctcttcacttccaccatcatgggcaagatactagcaagaccaaacgtaaagcttttcaatgcagtggctgctgaggacttgattgtgaaaaatgatagagttgctggtgttgtcaccaattgggctttggtttcgatgaaccatgacactcaatcatgcatggatccaaatgttatggaggctaaagtggttgtgagctcttgtggccatgatggtccttttggagccactggtgtgaagaggctcaagagtattggcttgattgatagtgtgccgggaatgaaggccctcgacatgaacactgctgaggatgctattgttaggctcactagagaggttgtgcctggaatgattgttactggtatggaggttgctgagattgatggtgcaccaagaatgggtccaacatttggagcaatgatgatatcaggacaaaaggcagcccatttggttttgagatcgttgggacttcctaatgctgtggaccatgcaggagacatcaacacccaacctgagcttgtcctagctgctgctgattctgttgaaattgcagatgcttaatcaatgataccattactatatagtttaataatatcaaaattcccatggccagaaataataatttgttgtcaatagtaatgagttgatgatgggttggttgatgtgattctgtttgaggttttgttattaacatgaacgaattgatgcttttgccaactactcattttttctttctcctccaatatatatttatttattttaatgaagatggaatacaattaactattgtgaagggggatatagtttccctagtaaaatgcctaacaattag

SEQ ID NO: 898 - DNA, 1274 bp, Cicer arietinum
gcgggactcaactccaaccactacttaaagtttcaacagtaactgaccaaacaataatggcttcagcttccaccattaccttgtcttccttcctctacacaaaaaccccaaacccagagaaatcatcctctttgaacagaagtacccttagtgttggatctcaacgaaagcagtgcgtgtccgtgtcagcatcagcaaaatcttcacctccaccctatgaccttaattctttcaaatttaatcccatcaaggagtcaattgtttcacgggagatgacacgtaggtacatgacagacatggtcacacatgctgacaccgatgttgtcatcgtaggtgctggttccgctggtctttcatgtgcttatgaactcagcaagaatccttccatcaaaatcgctatcatcgaacaatctgttagccctggtggtggggcctggcttggtggccaactcttttctgcgatggttgttcgtaagccagcacatttgttcttgaacgagattggagtcgagtatgacgagaaagacgactatgtggtgatcaagcatgctgctctcttcacttccaccatcatgggcaagatactagcaagaccaaacgtaaagcttttcaatgcagtggctgctgaggacttgattgtgaaaaatgatagagttgctggtgttgtcaccaattgggctttggtttcgatgaaccatgacactcaatcatgcatggatccaaatgttatggaggctaaagtggttgtgagctcttgtggccatgatggtccttttggagccactggtgtgaagaggctcaagagtattggcttgattgatagtgtgccgggaatgaaggccctcgacatgaacactgctgaggatgctattgttaggctcactagagaggttgtgcctggaatgattgttactggtatggaggttgctgagattgatggtgcaccaagaatgggtccaacatttggagcaatgatgatatcaggacaaaaggcagcccatttggttttgagatcgttgggacttcctaatgctgtggaccatgcaggagacatcaacacccaacctgagcttgtcctagctgctgctgattctgttgaaattgcagatgcttaatcaatgataccattactatatagtttaataatatcaaaattcccatggccagaaataataatttgttgtcaatagtaatgagttgatgatgggttggttgatgtgattctgtttgaggttttgttattaacatgaacgaattgatgcttttgccaacga

SEQ ID NO: 899 - DNA, 1375 bp, Cajanus cajan
cactcccatccataaatatctcactccactccctccaaacccacttcaccacaccacacttcactcccaatatggcttccatcaccacctcttccttcctcttccaaaagccaaccccctccttcaatgtcacgcgcgccctgcgccctctccctcacgcgccgcgcgcctccatgtccgcggcggcgtcaccgccaccgccctacgacctggggtccttcaagttcgcccctatcaaggagtcgatggtggcacgcgagatgacccgcaggtacatgaccgacatggtcacccacgccgacaccgatgttgtcattgtcggcgctggctccgccggactctcctgcgcctacgaactctccaaaaacccctccgtcaaagttgctattgtcgagcagtccgtcagccccggcggcggcgcgtggctcgggggtcaactcttctctgccatggtagtgcgtaagcctgcaaatcttttccttgatgagctgggtcttgagtatgacgaacaagacaactatgtagtgatgaagcatgctgcattgttcacttccaccatcatgagcaagctcttggcgaggccaaacgtgaagcttttcaatgcagtggcagctgaggatttgattgtgaagaatggaagagttggtggggttgtgacgaattgggccttggtttccatgaaccatgacacccaatcatgcatggaccccaacgtgatggaggccaaagtggttgtgagctcttgtggccatgatgggccctttggggccactggggtgaagaggctcaagagcattgggctcattgacactgtccccggaatgaaggcccttgacatgaacaaggcagaggatgctattgtgagactcactagagaggttgtgcctggcatgattgttactggcatggaggttgctgagattgatggtgctcctagaatgggtccaacatttggagcaatgatgatatcagggcagaaagcagctcatctggctttgagagcattgggacttcccaattctttggattatgcaggaaatgttcatcctgagcttatcctagctgctgctgatcaatctgctgaaattgctgaggcttaattaatgttgcattagttgattgtagcaatggttgcaaccaaaaataatacttgtacttagggaattaaactttgaaggtaatggtaatgatggtgcatggagtgtagtggttgatctcttaatgtgactgtatgaggttctgttaataacatgaatggctttgccaactcctttaaattgtgtgatgctactctcctcaatgactaagtgtattagataccagatcaaaactatgttgaatagaaaaatgtgttttaatataaaaaaaaaaaaaa

SEQ ID NO: 900 - DNA, 1340 bp, Glycine max
actccactcaccactgaaactgaaacaaacatggcttcttccaccatcacctcctccttcctcacatcacacccttcatccctcttcaacaaatcatcatcttcatcattcccctccttccatgccacccccactctccgcccccacaggccacgcgcctccatgtccgcggcagcgccaccgccgccctacgacttcggctcgttccggttcgagccgattagggagtcgatcgtgtcgcgcgagatgacccgcaggtacatgaccgacatggtcacccacgccgacaccgacgtcgtcgtcgtcggcgcaggctccgcgggtctctcgtgcgcctacgagctctccaaaaacccctccgtcaatatcgccatagtcgagcagtccgtcagccccggcggcggcgcctggctcggcggccaactcttctctgccatggtagtgcgtaagcccgcacacctcttcctagacgagcttggtcttgagtatgacgaacaagacaactacgtggtgatcaagcacgctgcattgttcacttccaccatcatgagcaagctcttggccaggccaaacgtgaagctcttcaacgccgtggcggccgaggacttgattgtgaagaacgggagagttggtggggtggtgacaaactgggccttggtttcaatgaaccatgacactcaatcctgcatggaccccaatgtgatggaggctaaggtggtggtgagttcttgtggccatgatggaccctttggcgccactggggtgaagaggctcaagagcattgggttgattgatagtgtgccagggatgaaagcccttgacatgaacaaggcagaggatgccattgtgaagctcactagggaggttgtgcctggcatgattgttactgggatggaagttgctgagattgatggtgctccaaggatgggtccaacatttggagcaatgatgatttcagggcagaaagcagcccatctggctttgagatcattgggacttcccaatgctttggattctgtaggaaacgttcatcctgagcttgtcctagctgctgctgaatctgctgaaattgcagacgcttaattaatgttgcaacaaatttaagttaaaatatcagtgcttgcaactagaaataatacttgtagttagggaattaagctttgaaggtgttggtagtgatctattggggtggttgatgtgactctctacgaagtttgttaataatatgaaggtttgaaggtatgggtagggtaccatccacacctttgtctcaagttttatattttgttcaatttattttattttaaatttttaaaaaagacaatgaagtaattgatgcg

SEQ ID NO: 901 - DNA, 1363 bp, Euphorbia esula
  misc_feature (733)..(733): n is a, c, g, or t
  misc_feature (769)..(769): n is a, c, g, or t
cccatcttccttcttcttcttcttcatcttcttgttttctcgtcaactcaaattacttcctctccaatatccaatggcaagcatggctgccgctgctttcacagctctctccgccaagccacaaaagctgtctatcttcgattctccctctctccgcctccatccttcccctaaatcattctcagtgtccatgtcagcattttcttcgccctcatctccccaatacgatttgaacgctttcaaatttgaccctatcaaagagtctattgtgtcgcgtgagatgactcgccgatacatgaccgatatgatctcccatgctgatactgatgttgtcatcgtcggcgctggttctgccggcctttcctgcgcttatgagcttagcaagaatcctgatgttaaagttgctatcattgagcagtctgttagccctggtggtggcgcctggctcggtggccagcttttctccgccatggtggtgaggaaaccagcccacaggttcctggatgaattggaaattgagtatgacgaggcagaccactatgtggtgataaagcacgcagccctgttcacctcaacaatcatgagcaagcttcttgcccgtcccaatgtgaagcttttcaacgcggtagcagcagaggacttgatagtgaaggaaggaagagtaggcggtgtggtcacaaactgggcgcttgttgcaatgaaccacaacacacaatcctgtatggacccgaangtgatggaatccaaggttgtggttagttcttgtggncatgatggaccttttggggccactggtgtcaagaggctcaagagcattggcctgatcgacaccattcccgggatgaaagctcttgacatgaatactgctgaggatgccattgttaggcacaccagggaggttgttcctggcatgattgttactggcatggaagttgctgagattgatggtgctccaagaatggggccaacatttggagcaatgatgatatcagggcagaaggcagctcatctagcgctgagggcactaggcctccctaatgctttggatggaactttcgccatgcaccctgagctcgtcctagccgcagctgaatccgctgacatcgttgatgcctaaatcaatgctctgtctaagcagcaaatatcagatattattatggtaaaagtagactgtagaaattggtgtttgttttgggggaggaccttatggttgttgaattgagagctttcttaagttttgttaatagtgcttgtttgctatctcatagtttgttttgctattggaaagaataaaactattttctttcttatgtttagtttaattccttccttggccatttcctatccatttggaactccacag

SEQ ID NO: 902 - DNA, 1353 bp, Lotus japonicus
tcactcactccactgaaaccagagtaacacacactcaccttcaccgatcatggcttccaccaccaccaccaccttcacctcctcctcctcctcctcctcattcctccacaccaaaatcccaaccccatcctctctctcctccttcaacaaaccactcaccttccaatccatgaaaccttcactgaggaagctctgcatgtccatggctgcatcatctgcaccttcaccacctccaccctatgatctcggatccttcaaatttgcgccgatcaaggagtccattgtctcacgcgagatgacgcgcaggtacatgaccgacatggtcaccttcgctgataccgacgtcgtcatcgtcggtgccggttccgccgggctcacctgcgcctacgagctcagtaagaaccccaacgtccaggttgctatcattgagcaatctgttagccccggtggcggcgcgtggctcggtggccaactcttctctgccatggtagtgcgcaagccagcacatctgttcttgaatgagcttggagtggattatgatgagcaggacaactatgtggtgatcaagcatgctgctctcttcacttccacaatcatgagcaagctgctggctaggcctaatgtgaagcttttcaatgctgtggccgctgaggatttgattgtgaaaaatgggagagttggtggggttgtcaccaactgggctttggtttccatgaaccatgacacccaatcctgcatggatcctaatgtcatggaggccaaggtggtggtaagctcttgtggccatgatgggccttttggagccactggggtgaagaggcttaagagcattggtttgattgatagggtgcctggaatgaaggcccttgacatgaacactgctgaggatgctattgtcaggcttaccagggaggttgtgcctggaatgattgttactgggatggaagttgctgagattgatggtgctccaagaatgggtccaacatttggagctatgatgatatcagggcagaaggcagcacatttggccttgagatcactggggcttcccaatgctgtggataaaaataatgctgcagggaagatccacccagagcttgtcctagctgctgctactgaatctgctgaaattgcagatgcttaatcaatttagcatcaattaactttctgttgatagtgtcagtgcccgtagccagtaatgacaataagcttcttgttatggagaaagtggtacaataaccttcttgttagcgagaaagtggtgtgagaagtgatgatggaaaatggatgagttggtttatgtgaacagtgtatgctgtttttttgttaataacatgaatggatgtgtttgcc

SEQ ID NO: 903 - DNA, 1283 bp, Gossypium hirsutum
ggaacaccaaaaccttcttttgttttcttcttctaatcaatggcatcttccatagctacaactctcacttcctcttcaaagctttgcaggaacacttctctcttcgagtcttccttccatggggttccaattaaaccactttcttttcatttcaaaacaaagtcttccccgtgcaacgcatccatttccatgtctgcagcatcacctccaccctatgatctgaataatttcaggtttgaccccatcaaggagtccatcgtctcacgtgagatgacacgcaggtacatgatggacatgatcacctatgctgataccgatgtggtggtcgtcggtgccggctccgccgggctctcttgtgcctatgagcttagcaagaacccctccgtacagatagctattgtcgagcagtctgttagccccggaggtggtgcctggctcggtgggcagcttttctctgccatggtagtgcggaaaccagctcatcgcttcctcgacgaactcgccattgaatatgatgaacaagacgactatgttgtgatcaagcatgcagcccttttcacatccactatcatgagcaagcttctagcccgccccaacgtgaagctgttcaacgctgtggcggcggaggacttaatagtgaaggaagggagagttggtggtgttgtgacaaactgggccctggtgtcaatgaaccatgacacacagtcctgcatggaccctaatgtgatggaggccaaggtggtggtgagctcttgtggtcatgatgggccatttggagccaccggggtgaagaggttgaaaagcattgggatgattgatagtgtgccagggatgaaggcactggatatgaatacagctgaggatgctatagtgaggctgactagggaaattgtgcctgggatgattgtcaccgggatggaagttgctgagattgatggatccccaagaatggggccaacatttggagcaatgatgatatcagggcaaaaggcagcccatcttgccctgaaatcattaggattgcctaatgcaattgatggaacatatgtgggaagcattcacccggagctgatcttggccgctgcagattccgccgagaccgctgacgcttagttgcaagggtcatagttgctaaactgctatggagataggaggaattggaataatgtgcagtcattggtaggatttggaataatctcctgtaacttagtagcaaaaccttagcattttgtagcttgttgttcttctccttgcatgccttttaattgagttctgttctcttt

SEQ ID NO: 904 - DNA, 1432 bp, Gossypium raimondii
gtctcttcagttctttctactatctcacctctccagacttccgaggaacaccaaaaccttcttttgttttcttcttctaatcaatggcatcttccatagctacaactctcacttcctcttcaaagctttgcaggaacacttctctcttcgagtcttccttccatggggttccaattaaaccactttcttttcatttcaaaacaaagtcttccccgtgcaacgcatccatttccatgtctgcagcatcacctccaccctatgatctgaataatttcaggtttgaccccatcaaggagtccatcgtctcacgtgagatgacacgcaggtacatgatggacatgatcacctatgctgataccgatgtggtggtcgtcggtgccggctccgccgggctctcttgtgcctatgagcttagcaagaacccctccgtacagatagctattgtcgagcagtctgttagccccggaggtggtgcctggctcggtgggcagcttttctctgccatggtagtgcggaaaccagctcatcgcttcctcgacgaactcgccattgaatatgatgaacaagacgactatgttgtgatcaagcatgcagcccttttcacatccactatcatgagcaagcttctagcccgccccaacgtgaagctgttcaacgctgtggcggcggaggacttaatagtgaaggaagggagagttggtggtgttgtgacaaactgggccctggtgtcaatgaaccatgacacacagtcctgcatggaccctaatgtgatggaggccaaggtggtggtgagctcttgtggtcatgatgggccatttggagccaccggggtgaagaggttgaaaagcattgggatgattgatagtgtgccagggatgaaggcactggatatgaatacagctgaggatgctatagtgaggctgactagggaaattgtgcctgggatgattgtcaccgggatggaagttgctgagattgatggatccccaagaatggggccaacatttggagcaatgatgatatcagggcaaaaggcagcccatcttgccctgaaatcattaggattgcctaatgcaattgatggaacatatgtgggaagcattcacccggagctgatcttggccgctgcagattccgccgagaccgctgacgcttagttgcaagggtcatagttgctaaactgctatggagataggaggaattggaataatgtgcagtcattggtaggatttggaataatctcctgtaacttagtagcaaaaccttagcattttgtagcttgttgttcttctccttgcatgccttttaattgagttctgttctctttcttctttgtcttctatatacttgcaacttccacagttaagccaccattgttgcaataataccaattagtgcagagtttcacagaacaaccttgaagctaaacgaa

SEQ ID NO: 905 - DNA, 1388 bp, Gossypium hirsutum
atggggactatctcacctctccagacttccgaggaacaccaaaaccttcttttgttttcttcttctaatcaatggcatcttccatagctacaactctcacttcctcttcaaagctttgcaggaacacttctctcttcgagtcttccttccatggggttccaattaaaccactttcttttcatttcaaaacaaagtcttccccgtgcaacgcatccatttccatgtctgcagcatcacctccaccctatgatctgaataatttcaggtttgaccccatcaaggagtccatcgtctcacgtgagatgacacgcaggtacatgatggacatgatcacctatgctgataccgatgtggtggtcgtcggtgccggctccgctgggctctcttgtgcctatgagcttagcaagaacccctccgtacagatcgctattgtcgagcagtctgttagccccggaggtggtgcctggctcggtggacagcttttctctgccatggtagtgcggaaaccagctcatcgcttcctcgacgaactcgccattgaatatgatgaacaagacgactatgttgtgatcaagcatgcagcccttttcacatccacaatcatgagcaagcttctagcccgccccaacgtgaagctgttcaacgctgtggcggcggaggacttaatagtgaaggaagggagagttggtggtgttgtgacaaactgggccctggtgtcaatgaaccatgacacacagtcctgcatggaccctaatgtgatggaggccaaggtggtggtgagctcttgtggtcatgatgggccatttggagccaccggggtgaagaggttgaaaagcattgggatgattgatagtgtgccagggatgaaggcactggatatgaatacagctgaggatgctatagtgaggctgactagggaaattgtgcctgggatgattgtcaccgggatggaagttgctgagattgatggatccccaagaatggggccaacatttggagcaatgatgatatcagggcaaaaggcagcccatcttgccctgaaatcattaggattgcctaatgcaattgatggaacatatgtgggaagcattcacccggagctgatcttggccgctgcagattccgccgagaccgctgacgcttagttgcaagggtcatagttgctaaactgctatggagataggaggaattggaataatgtgcagtcattggtaggatttggaataatctcctgtaacttagtagcaaaaccttagcattttgtagcttgttgttcttctccttgcatgccttttaattgagttctgttctctttcttctttgtcttctatatacttgcaacttccacagttaagccaccattgttgcaataataccaattagtgcag

SEQ ID NO: 906 - DNA, 2044 bp, Eucalyptus grandis
atgacaacggaccatgacagcatgccatcatcaaacgaaaataagaacacgagaatcaagatacatggcacaacaaatgcacgtaaaggggaaaaaggaaaaagagaaaagaaattgaacatgggatgtaaacgaaaaggggagcgaatcgtcgtcttcctcgcatgcagtgctcatgactgggagagcgccacttggtgcaggaggcatgacagccccgttgcccattctggacccttcaattcctatcctctccgccctccacgtgttccccgatattttccgctccgcttccttatatactcgccccaccccatcaccacccttcgctctcatccggaaaaccctccagcgagatccccgcaaagcagcgtccaagaagctcctccaatggcggccgccaccatcacctcctccctctcctccaagcccaagctctccctctcctccttccatggcacccctctcgcccccgccgcccagtccctccgcctcccggccccccggtcgtccgcccactcctccggcatctccatgtccgccgccgccgccaacccgccgccctacgatctgaacgccttccgcttcgaccccatcaaggagtccatcgtctcacgcgagatgacccgccgctacatgatggacatgatcacctacgccgacaccgacgtcgtcgtcgtcggcgccggctcggccgggctctcctgcgcctacgagctcagcaagaaccccgacgtccaggtcgccatcatcgagcagtccgtcagccccggcggcggcgcctggctcggcggccagctcttctccgccatggtggtgaggaagccggcacaccgcttcctggacgagctcgagatcgagtacgacgagcaggacaactacgtggtgatcaagcacgcggcgctgttcacgtcgaccatcatgagcaagctcctggcgaggcccaacgtgaagctcttcaacgccgtggccgccgaggacctgatcgtcaagaacgaccgggtcggcggggtggtcaccaactgggccctcgtgtcgatgaaccacgacacccagtcgtgcatggacccgaacgtcatggaggccaaggtggtggtgagctcgtgcggccacgacgggccgttcggggccaccggggtgaagaggctgaggagcattgggatgatcgacagcgtgcccgggatgaaggccctcgacatgaacaccgccgaggacgccatcgtgcggctcaccagggagatcgtgcccgggatgatcgtgaccggcatggaggtggccgagatcgatgggtctccgagaatggggccgaccttcggagcgatgatgatatcggggcagaaggcggctcacctcgccttgaaggccttgggattgccgaacgcattggacggatcctacgtcgggagcatccaaccggagctcatcctcgccgcagccgactcggcggagatcgcggaagcttgagattaagccaaccgagatttgcttgtcttgagtagagagactgaaaaagagaaaagagaggtgtgctttggtgagatgagccagggtggggtgggggccttatatggcctgtaatagatggagtgcgtagttttgggcgttttgtcaataaggttggatttgtgtcaggtctctgtttttctttctttctctctttctctcgctttgcattttctgctgccgctgccgctgccgcttctgcttgtgcttgcatcaagaagctttgcctcctggatttggatgaatgggagtcgagtttcggagtcgatttgcttgtccggataatctttggagtattcactaaaatatctactagtggccgaagtcactgtcgaaatttctgctgcttgttatcaaaagtacttactgtcttttctgaaatatctctggatgataatttggaataaaaattgttatgagcgaggcaggaacaagtagaaatgtttttatgttggggttaaaacgttcctctccccaacaatatctgggaaatgcatcgatatttattttcgaatagaaaagtttcaagtactccctccaa

SEQ ID NO: 907 - DNA, 1375 bp, Gossypium hirsutum
gggatccgaggaacaccaaaaccttcttttgttttcttcttctaatcaatggcatcttccatagctacaactctcacttcctcttcaaagctttgcaggaacacttctctcttcgggtcttccttccatggggttccaattaaaccactttcttttcatttcaaaacaaagtcttccccgtgcaacgcatccatttccatgtctgcagcatcacctccaccctatgatctgaataatttcaggtttgaccccatcaaggagtccatcgtctcacgtgagatgacacgcaggtacatgatggacatgatcacctatgctgataccgatgtggtggtcgtcggtgccggctccgccgggctctcttgtgcctatgagcttagcaagaacccctccgtacagatagctattgtcgagcagtctgttagccccggaggtggtgcctggctcggtgggcagcttttctctgccatggtagtgcggaaaccagctcatcgcttcctcgacgaactcgccattgaatatgatgaacaagacgactatgttgtgatcaagcatgcagcccttttcacatccactatcatgagcaagcttctagcccgccccaacgtgaagctgttcaacgctgtggcggcggaggacttaatagtgaaggaagggagagttggtggtgttgtgacaaactgggccctggtgtcaatgaaccatgacactcagtcctgcatggaccctaatgtgatggaggccaaggtggtggtgagctcttgtggtcatgatgggccatttggagccaccggggtgaagaggttgaaaagcattgggatgattgatagtgtgccagggatgaaggcactggatatgaatacagctgaggatgctatagtgaggctgactagggaaattgtgcctgggatgattgtcaccgggatggaagttgctgagattgatggatccccaagaatggggccaacatttggagcaatgatgatatcagggcaaaaggcagcccatcttgccctgaaatcattaggattgcctaatgcaattgatggaacatatgtgggaagcattcagccggagctgattttggccgctgcagattccgccgagaccgctgacgcttagttgcaagggtcatagttgctaaactgctatggagataggaggaattggaataatgtgcagtcattggtaggatttggaataatctcctgtaacttagtagcaaaaccttagcattttgtagcttgttgtttttctccttgcatgccttttaattgagttctgttctctttcttctttgtcttctatatacttgcaacttccacagttaagccaccattgttgcaataataccaatgagtgcagagtttcccag

SEQ ID NO: 908 - DNA, 1335 bp, Gossypium hirsutum
gaacttcgcccgcgcctgcagcgtcgacactatgtggatccacaagaattgcggcacgaagggaacaccaaaaccttcttttgttttcttcttctaatcaatggcatcttccatggctacaactctcacttcctcttcaaagctttgcaggaacacttctctcttcgagtcttccttccatggggttccaattaagccactttcttttcatttcaaaacaaagtcttcccattgcaacgcatccatttccatgtctgcagcatcacctccaccctatgattttaataatttcaggtttgaccccatcaaggagtccatcgtctcacgtgagatgacacgcaggtacatgatggacatgatcatctatgctgataccgatgtggtggtcgtcggtgccggctccgctgggctctcttgtgcctatgagcttagcaagaacccctccgtacagatcgctattgtcgagcagtctgttagccccggaggtggtgcctggctcggtggacagcttttctctgccatggtagtgcggaaaccagctcatcgcttcctcgacgaactcgccattgaatatgatgaacaagacgactatgttgtgatcaagcatgcagcccttttcacatccacaatcatgagcaagcttctagcccgccccaacgtgaagctgttcaacgctgtggcggcggaagacttaatagtgaaggaagggagagttggtggtgttgtgacaaactgggctctagtgtcaatgaaccatgacacacagtcctgcatggaccctaatgtgatggaggccaaggtggtggtgagctcttgtggtcatgatgggccatttggagccaccggggtgaagaggttgaaaagcattgggatgattgatagtgtgccagggatgaaggcactggatatgaatacagctgaggatgctatagtgaggctgactagggaaattgtgcctgggatgattgtcaccgggatggaagttgctgagattgatggatccccaagaatggggccaacatttggagcaatgatgatatcagggcaaaaggcagcccatcttgccctgaaatcattaggattgcctaatgcaattgatggaacacatgtgggaaccattcacccggagctaatcttggccgttgcagattctgccgagaccgctgacgcttagttgtaagggtcatagttgctaaactgctatggagataggaggaattggaataatgtgcagtcattggtaggatttcgaataatctcctgtaacttagtagcaaaaccttagcattttgtagcttgtcttctccttgcgtgccttttaattgagtactgttt

SEQ ID NO: 909 - DNA, 1351 bp, Euphorbia peplus
atggcaaccatggctgccgccgctgctttcacttctctctcgtccgccacccctcaaaagcagtccctcttttccgtccgcctccaaaacccatcccccaaatcattttcagtctccatgtcagcattttcctcatcctcatcctcctctgcccagtacgatttgaacgctttcaagtttgaccccattaaagagtcaattgtgtcgcgtgagatgactcgccgatacatgaccgacatgatctcacatgccgatactgatgttgtcatcgtcggagctggttctgccggactttcttgcgcttatgagctcagcaagaaccctgatgttaaagttgctatcattgagcagtctgttagccctggtggcggcgcttggctcggtggccagcttttctccgccatggtggtgaggaaaccagcccacaggttccttgatgaactggaaatcgagtacgacgaggcagaccactacgtggttatcaagcacgctgccctgttcacctcaacaatcatgagcaagcttctcgcccgtcctaatgttaagcttttcaacgcggttgcagcagaggacttgatagtcaaggagggaagagttggtggtgtggtcaccaactgggcgcttgttgccatgaaccacaatacacaatcatgcatggaccctaatgtgatggaatccaaggttgtggtgagttcttgtgggcatgatggaccttttggcgccactggtgtcaagaggctcaagagcattggcatgattgactccattcccgggatgaaagctcttgacatgaatactgctgaagatgccattgttaggaacactagggaggttgttcctggcatgattgttactggcatggaagttgctgagattgatggtgctccaagaatggggccaacatttggagcaatgatgatatcagggcagaaggcagctcatctagccctgagggcactaggactgccaaatgctttggatggaacattagccatgcaccctgagctcgtcctagccgcagctgaatctgctgacatcgttgatgcctaaatgtctaagcagtatgcataatatatcagatattatggtaaaagtagactctagaagaccttgtggttgaattgagagctttttaagttttgtttatagtgcttgctgtctcaaagtttgctttgctattggaaacaagaaaactctttcttctgcatagttgtttaattcctttgttgttgtattgtcctatattgctctcttctttcagatgattgcagttgcagaggtcattaaatctttgttttcatcaatttggaactaaacaagcagtcaataaaaacatatctgatatttaatg

SEQ ID NO: 910 - DNA, 1294 bp, Arachis hypogaea
gccggggacaacacatcaaaaacttcactgaacacactccaaaatccaacaaaccatggcttccaccaccatctcctctccctccttcaccaaaaccgcaagcccttcttctctcctctcccataacaccgtgttccgcctgaacccccaacaacatgcacgcaaaaacttcaacctctccctccgcgcatccatgtcagcatcatcaccatcaccaccaccatacgatctccagtccttcaagttcgagccaatcagggagtcgatcgtgtcacgggagatgacccgtaggtacatgacagacatggtgacgcacgccgacaccgacgttgtgatcgtgggtgccggttctgccgggctgtcgtgcgcctacgagctcagcaagaacccgtcagtcaacatcgccatcattgaacagtctgtcagtcccggtggtggcgcttggctcggtggccaacttttctctgccatggtagtgcgtaagccggcacatctgttcctagacgagctcggcattgagtacgacgagcaagagaactacgtggtgatcaagcatgcagcgttgttcacttcaaccatcatgagcaagctcctcgcccgccccaacgtgaagctattcaacgctgtggcagccgaggacttgatagtaaagaacaacagggttggtggtgttgtgacaaactgggccttggtgtcaatgaaccatgacacacagtcatgcatggacccaaatgtaatggaggctaaggttgtggttagttcatgtgggcatgatgggccgtttggggccacaggggttaagagactcaagagcattgggatgattgatagtgttcctgggatgaaggcacttgatatgaatgctgctgaggatgctattgtcaaactcactcgggagattgttcctggaatgattgttactggcatggaagttgctgagattgatgctgctcctagaatgggtccaacatttggggcaatgatgatatctgggcagaaggcagcacatctggctttgagagcactgggactcccaaatgctatggactacgctgcaaacatcccccaccttgagcttgtccttgctgctgcacaatctcctcatgttgttgatgcttaaaatcaatattccattaagttggaattcacccgaaataagaaaaacaatttaaaattataataataaatctctgtttagctgtgttagtaagtaatgtcgtatgccggtggattgtgggttggtttatgtgagactcttataaagtttgttaatgacatgaatgtgtgttgccta

SEQ ID NO: 911 - DNA, 1421 bp, Valeriana officinalis
aacatctaaacctcgatcacttaattactctaagctagctaatatggcaacaatggccactactaccttcacctcttccctatcctccaaggccaattccctctatggagtccccctctcctcctcctccctctcccttcgcgtcaaatccacccctcaaaacctctcctccgtttccatgtccgcctctaacaccccctacgatctcaacgccttcgaattctcccccatcaaggagtccatcgttgctcgtgaaatgaccagacgctacatgactgacatgatcacttatgctgataccgacgtcgttattgtcggcgctggctccgctggtctctcatgcgcttatgaactcagtaaaaaccccgacgttcaggtagctatcattgaacaatctgttagccctggaggtggtgcgtggctcggaggtcaactcttttcagccatggttgtccgcaaaccagcacacctcttcctagacgagttaaacatcgactacgacgaagcagacaactacgtcgtgatcaagcacgcagccttgttcacatcaacaatcatgagcaaactgctagccaggccaaacgtgaagctcttcaacgctgtggctgctgaggatctgattgtcaaaggaggaagagtcggcggtgttgtcaccaactgggctctcgtttccatgaaccacgacacacagtcctgcatggaccctaacgtcatggaggctaaagtggtggtcagcagctgcggccatgatggtccgttcggtgccaccggagtcaagaggttgaggagcatcggaatgattgagagtgttcccggaatgaaggctttggacatgaacactgccgaagatgctattgtcaggcttacgagggaaattgtccccggaatgattgttaccggaatggaggttgccgagatcgatggatctccaagaatggggccgacattcggagctatgatgatttctggtcagaaggcggcacatctggccttgaaggcacttggattgcctaacgctttggacgggaactatgtcggaacagttcaaccggaactcatccttgcggcggctgacgctgcggagattgtcgacgcgtaattttagtctgtaaaaacgtatcgaaataaggagagcgatgttttgtgaatggatggatgaataagtagatccatatggacgtctgcgatgtttattattaagtgttgttttaggtcgttggtttctgcctccgtttgtttcactctgttagagaactaaacgaaccttggatgtggtaatacggtagcttttctcttgttcttattctgtatttgctatcttgaattgtttcatctcatgctatgtcgctggttgagaatgataagcttttcatattcagcactagtttggatttggaattaagaaactcgatctagctctt

SEQ ID NO: 912 - DNA, 1216 bp, Cajanus cajan
cgcgcgcctccatgtccgcggcggcgtcaccgccaccgccctacgacctggggtccttcaagttcgcccctatcaaggagtcgatggtggcacgcgagatgacccgcaggtacatgaccgacatggtcacccacgccgacaccgatgttgtcattgtcggcgctggctccgccggactctcctgcgcctacgaactctccaaaaacccctccgtcaaagttgctattgtcgagcagtccgtcagccccggcggcggcgcgtggctcggtggtcaactcttctctgccatggtagtgcgtaagcctgcaaatcttttccttgatgagctgggtcttgagtatgacgaacaagacaactatgtagtgatgaagcatgctgcattgttcacttccaccatcatgagcaagctcttggcgaggccaaacgtgaagcttttcaatgcagtggcagctgaggatttgattgtgaagaatggaagagttggtggggttgtgacgaattgggccttggtttccatgaaccatgacacccaatcatgcatggaccccaacgtgatggaggccaaagtggttgtgagctcttgtggccatgatgggccctttggggccactggggtgaagaggctcaagagcattgggctcattgacactgtccccggaatgaaggcccttgacatgaacaaggcagaggatgctattgtgagactcactagagaggttgtgcctggcatgattgttactggcatggaggttgctgagattgatggtgctcctagaatgggtccaacatttggagcaatgatgatatcagggcagaaagcagctcatctggctttgagagcattgggacttcccaattctttggattatgcaggaaatgttcatcctgagcttatcctagctgctgctgatcaatctgctgaaattgctgaggcttaattaatgttgcattagttgattgtagcaatggttgcaaccaaaaataatacttgtacttagggaattaaactttgaaggtaatggtaatgatggtgcatggagtgtagtggttgatctcttaatgtgactgtatgaggttctgttaataacatgaatggctttgccaactcctttaaattgtgtgatgctactctcctcaatgactaagtgtattagataccagatcaaaactatgttgaatagaaaaatgtgttttaatataaaaaaaaaaaaaagta

SEQ ID NO: 913 - DNA, 1426 bp, Populus trichocarpa
ctgcctctcttcacctctctatccccataaattctcgccatcttcttcactccgctgcactccatagctctaaacctcaacccacaaccaaacgcgctgtcgttcatcatggcaaccatggctacaactctcacttctctctcaacaaaatcccaaaaactctccccttttgacacctcctcttccttccatggcactcccatctcaaaaccaacacttcgtatgcagcccacaaaatcatcatcgtcaccaaacgtttccatctccatgtcatctccaccgtatgatctgaatgctttcaagtttgaacctatcaaagagtctatagtgtcaagagaaatgacaagaaggtacatgatggacatgataactcatgcagacactgatgttgttattgttggtgctggctctgccgggttatcttgtgcttatgagcttagcaagaacccttctgtcaaaattgccattgttgaacaatctgttagccctggtggtggtgcttggcttggtggtcagctcttctctgccatggttgtacgcaaaccagctcatctcttccttaatgagctcggtattgagtatgatgagcaagaagactatgtagtaatcaagcatgcagcccttttcacctccacaatcatgagcaaactccttgcccgtccaaatgttaagcttttcaatgctgtggctgcagaggacttgatagtgaaggaaggaagagtgggtggagtggtcactaattgggctcttgtgtcaatgaaccatgacacacaatcttgtatggaccctaatgtgatggaggccaaggtggttgtgagttcttgtggccatgatggaccatttggtgctactggggtcaagaggcttaagagcattggcatgattgatagtgtgccaggaatgaaggctcttgacatgaacgctgctgaagatgccattgtgaagcttactagggaagttgtgcctggaatgattgttactggcatggaagttgctgagattgatggctctccgagaatgggaccaacatttggggcaatgatgatatcagggcagaaggcagctcaccttgccttgaagtcactcgggatgcccaatgcactggatggaacatttgtgggaggcattcatccagagctgatcctggctgctgttgaatctgctgaaattgcagagacttgagtggtagcaaagcaatagactcaaatatgtcagataaataaaaggcagtagaaatgagttcgaggggtttcccagttgatgtggtcatggtaggttttagttaataatcttggtgtctgttcctttcgtttaagactctgttggcactcggcagttgaaataatttagttcatgctgctttcggaccttgttggctggcctatctgtcaattctctcggctgaatatagagggtttgatttgca

SEQ ID NO: 914 - DNA, 1454 bp, Actinidia deliciosa
  misc_feature (722)..(722): n is a, c, g, or t
  misc_feature (1053)..(1053): n is a, c, g, or t
  misc_feature (1101)..(1101): n is a, c, g, or t
  misc_feature (1154)..(1154): n is a, c, g, or t
  misc_feature (1222)..(1222): n is a, c, g, or t
  misc_feature (1234)..(1234): n is a, c, g, or t
  misc_feature (1276)..(1276): n is a, c, g, or t
  misc_feature (1285)..(1285): n is a, c, g, or t
  misc_feature (1355)..(1355): n is a, c, g, or t
attcaccccccaaaagccccacaatcctacgcactctctctccaatggcaacaatggccaccaccttcactccctctctctcctccaagtccaagccctccttcctggactcccgccagccatcatcatccttctgcggagccccgatctggtcctcatctcgcctccaacccctcaaatcctccatctcggtgtctgcagccgcccagtcgccggcttacgatctggggtcgttcaagttcgagccgatcaaggagtccatcgtgtctcgggagatgacacggcggtacatgacggacatgatcacctatgccgacaccgacgtcgttgtcgtcggcgccggatccgccggtctctcctgcgcttacgagctcagcaagaatccgtctgtacaggtggcaatcattgagcaatccgtgagccctggtggcggcgcgtggctgggcggccagctcttctccgccatggtggtccggaagccggcccacctcttcctggacgaactcgacatcgagtatgacgagcaggacaactacgtggtgatcaagcatgcggccctcttcacctccaccatcatgagcaagctgctggcccgccccaacgtgaagctctttaatgcggtggcagcggaggacctgatcgtgaaggggggccgggtgggcggtgtggtcactaactgggccctggtgtccatgaaccacgacacacagtcgtgtatggancccaatgtgatggaggctaaggtggtggtcagttcttgtgggcacgatggcccatttggggccaccggggttaagaggctgaaaagcattggcatgattgatagtgttccggggatgaaggcacttgatatgaatgcggctgaggatgcgattgtgaggctcaccagggagattgtgcccgggatgattgttactggcatggaagttgctgagattgatggatccccaagaatgggaccaacatttggggcgatgatgatatcggggcagaaggcagctcacctggcgctgaaggcacttggacttccaaacgcaatggacggaaattacntcggaagcatccaccccgagctaatcctagcttctgccgatgctgccnccgaaattgtggatgcttaagcgtagtaaaattccgtctaataaagaagagancgacgcaaagtagctccgggtatgtgatggaaaataagtgggatgggaaaatttcatgggttagattntgattaggcctngttttgtgaatgtttttggatgtggattgtttttcacatctnaattgctcngtttttctctcaagtgctgtgatgatctctttgtagtgaggagctgtgttatgtaagagaagatgggttnaaatgttgttcttgaaacgatggaaattgtctgttttggatgaacacaacgcatcagccacatgatatggacatgtttcttgttttaatctaaaaaaaa

SEQ ID NO: 915 - DNA, 1676 bp, Castanea mollissima
cacaaacacacacacacacacacaaacacaaacagatcctaaaacccggcctgtcgtttgttgatctcattgaaaatggcaaccatggcttccactctcacctccaagcctcaaaccctcgctttcttcgactcctcttctttccatggcacccctttggccccaccttcttctctccgtgtccatcaacccgccaaatcttccgtggccccacatgcaatctccatgtccgcctctcctccgccgtacgatcttaaagggttcaccttcgagcccatcaaggagtccatcgtctcacgcgagatgacacgtaggtacatgactgacatgatcaccttcgccgataccgatgtggtcgtggtgggtgctggctcagctggtctctcatgcgcttatgaactgagcaagaacccatccgtacaagtggctattatcgagcaatctgtgagccctggtggcggtgcatggctcggtggtcagctcttctctgctatggttgtacgcaaaccagctcatctcttccttgacgagcttgaaattgagtacgatgagcaagacaactatgttgtgatcaaacacgctgctctcttcacctcaaccatcatgagcaagctcttggctcgccccaatgtcaagctcttcaatgcggtggcagccgaggacttgattgtgaaggaaggaagagttggtggggtggtgaccaactgggccttggtgtccatgaaccacgacacacagtcatgcatggaccccaatgtcatggaggctaaggtggtagtgagctcatgtgggcacgacgggccatttggggccactggggtcaagaggctcaagagcattgggatgattgacagcgtacctggaatgaaggcactggacatgaacacagctgaggatgccattgtgaggcttactagggaaattgtgccagggatgattgttactgggatggaagtggctgagattgatggagctccaagaatgggacccacatttggtgccatgatgatctcagggcagaaagctgcccatttggccttgaaggcactgggacttccaaacgctctggatgaaggagccatccacccggaattgattctagctgccgcagattctgccgaaattgcagaagcctagaatcaaattttagagtttttaataataaaaaatatatatatgtgccggaataaaatatggttcataggaatgagtttgtggtgtggtgtagtgaggatgatgtttatatggtgggcttttcttcttttagtacttaatggtggctttggaacttttaatgctagcatttagcatttagcatttagctttatttacttcttgtatgcttctctctttggctagagacaaaagtgttattttctggatagtccctggctatcttctcctttttccttttcaatgatttggaccttcttcttcatgtgctagatggtccatgatttgtgctagaaatcatacagtctaggttttgcaggaacagtacacgtgatgagataatgttcattgactcattgtgtgtttaggtgtatgatacagtttgcttaatgtgttatagatgactccaaatcaatggttgagaaaaaaagcccaccatataaacatcatcctcactacaccacaccacaaactcattcctatgaaccatattttattccggc

SEQ ID NO: 916 - DNA, 1435 bp, Primula obconica
cctctacgtccattacggaccgaaagcatgtcgccactcctacacactctaaccttctctcttcctcacatcatctacaaacaagaaagtcggccgccgccgaccaaaccctaacctccgtccctctattaccaacctaaccccaaaacctcctcattttatggagtgccggtttcgtcatcatcccctgtggctcggctccagccgatcaaagccgcgccgggaaacctctcgatctcggcttctggtgcgccgtacgatctgaactcgttcaagtttgagcctatcaaggagtcgatcgtgtcccgcgagatgaccagacgttacatgacagacatgattacttacgccgatacggatgtcgtcgtcgtgggcgccggctctgctggactatcgtgcgcctatgagctcagcaagaaccccaatattcaggtggcaatcattgagcaatcggtgagccccggaggcggcgcctggctcggaggacagctcttctccgcgatggtggtccgtaagcccgcccacctcttccttgacgagctcaacatcgagtacgacgaaaaagacacctacgtggtgatcaagcacgccgccctcttcacatccaccatcatgagcaagctcctcgcccgccccaacgtcaagctcttcaacgccgttgctgccgaagacctcatcgtgaagggcaacagggtcgccggagttgtgaccaactgggcccttgtttcgatgaaccacgacacacagtcgtgcatggacccaaatgtgatggaggctaaggttgtcgtgagctcttgtggccacgatgggccttttggggcgactggtgtgaagaggttgaagagcattgggatgatcgacagtgtgcctgggatgaaggcgctcgacatgaacactgctgaggatgcgatcgtgaggctcaccagggagatcgtgcctggtatgattgttactgggatggaagttgctgagatcgatggttcccctagaatgggccccacatttggagctatgatgatttcgggacaaaaggcagctcatttggcattgaaggctttgggtgagcctaacgctcttgatggcacatttgtgggcagcattcaccctgagcttatcttagcagcagctgatggagccgagactgctgaggcctaagcctctttaattaggttggtttaataaaaagcaggagaccgaggaagaaaacagttgtgtaattaggacacatgttttgtgacttccagtttctgttttcccctttctcttttcatctttggaacttcgatttgagaatcaatggtagaatttggtctttttcaatcttaatgtttgctttctatctcgtaatctcctttgttttgtttcgaaataggtcatgagcgatgtttgggttagattggggtggtttcatactttcattgcatctctttgaagt

SEQ ID NO: 917 - DNA, 1592 bp, Platanus occidentalis
accctccaaacaattctctcagtcttcaatggcgaccatggccacagccctcacctcctctctctcaaagcccaaaattcctctcctggacaaccaatcctccttccatggcgtacccatctcatctcgcgcacaatccattcgatcctcttccccacaaaacctctcaatctccatgtcttcatctcccccatacgatctccgctccttccaattcgaacccatcaaggaatcgatcgtctctcgcgagatgagccgtcgatacatgatggacatgatcacccacgccgacacagatgttgtcatcgtcggtgccggctctgccggcctgtcctgcgcctatgagctcagcaagaacccatcaatccagattgcgattatcgagcaatccgtcagtcccggcggtggagcctggctcggcggccagctcttctcggccatggtcgtgcgcaagcctgcgcacaggttccttgacgagctcgacatcgagtatgatgaacaggacaactacgtcgtaatcaagcatgctgctctgttcacgtcgacgatcatgagcaagctcttggctaggccaaacgtgaaactgtttaacgcggtagcggccgaggatttgattgtgaaagaggggagggttgctggtgtggtgacgaattgggctttggtgtcgatgaaccacggcacacagtcgtgcatggatcctaatgtgatggaatcgaaagtcgtcgtcagttcttgtgggcacgacggtccgttcggtgccaccggagtgaagcggctcaagagcatcggcatggtcgatagcgtgccggggatgaaggcgcttgacatgaacaccgccgaggatgccattgttaggctcacgagggaggttgtgccagggatgatcgttactggaatggaagttgcagagatcgatggagccccaagaatgggtcctacattcggggcgatgatgatatcagggcagaaggcggctcacctggcattgaaggctttggggctgcccaacgccatggacggaaattacagtgacatgggaagcattcacccggagctcatcctcgcggcggcggagtccggcgatattgccgatgcttaaaatttagtggtaatgaaagaaagggaataaagagaagagaacaaagaagtccacttaggagtgatgggtcgtggggtggatggttgtagatgatggttgtttgttttcttttatgttcatcttgttaggggtatgtttgtgatgttggagccttttaaaagtagctgatatggggggttgctctgagtcttttcttttgttccattctctctatgtagatctcttttgcccccttctttctttatgaatctatcattgtagatagtaaagggaagatgggttttcaacaagaacagcggatttgtggctggtgtatgtggatcttttttggggctttaagacgtttcagtgttggttcttattaacaaatggtttgggttcgggttgacccataatagtcgtgtacccttaatttgacccactttgataatcaatagatgcgtcacattcggttaagtcatacaatcgtatatccgtatcgagatatgaaccc

SEQ ID NO: 918 - DNA, 1048 bp, Brassica juncea
ctctctccctctcttccaccaagcctcagcgccttttcgactcctatttccatggctcatccatctcctccgccgcacctgctccgtcggtctcaaaccgcgctccctctccgtccgcgccaccgctggctacgatctgaacgccttcacttttgaacccatcaaggagtccatcgtgtctcgcgagatgacgaggaggtacatgactgatatgatcacttacgccgagaccgacgtcgtcgtcgttggtgctggctccgctggactatcgtgtgcttacgagatcagcaagaaccctaacgttcaggtcgcaatcatcgagcaatctgtcagtcctggtggtggcgcgtggctcggtggtcagcttttctccgccatgattgtgcgcaaaccagctcacttgttccttgacgagattggtgtaccctacgatgagcaagacaactacgtcgtgatcaagcacgctgctctcttcacatccaccatcatgagcaagctcttggctcgtcccaacgtgaagctcttcaacgctgttgccgccgaggatttgatcgtgaaaggaaacagagtcggtggtgtggtgactaactgggctcttgtgtcgatgaaccacgacacacagtcttgcatggaccctaacgtcatggaggccaagattgtcgtaagctcctgtggtcacgatggtccttttggagccaccggtgtgaagaggttgaagagcattgggttgatcgatcatgttcctggaatgaaggctcttgacatgaacacagctgaagacgcgattgtgagattgactagggaggttgttcccggtatgatcgtgaccggtatggaagtcgcagagatcgatggcgcaccaagaatgggaccaacattcggagctatgatgatatcaggacagaaggcggcacatcttgctctgaaagctttgggacagcctaatgttttggatggatcctatgttggaaacctaagccctgagctggtcttagctgctgctgattcagctgaaaccgtagatgcttaaggacaaatgtttttttta

SEQ ID NO: 919 - DNA, 1271 bp, Fraxinus spp
gactctcagtcatcaatctagaaaaatcctctgtatttctcgggaaaacaaaaaaatggcgaccatgacttctactttggcctcaaaaactactttcctggatgccaaaaaatcctccttcaatggaataccaatttcttccccaatcagggtgcaacccatcaaatccacttcacagaacctttcgatttcggcctcctcgccgccttatgatctgaaatcctttgaatttcagccgattaaagagtcgattgtttcaagggaaatgactcgcaggtatatgatggacatgatcacctatgctgacactgatgtcgtgattgttggagctggctctgctggactctcatgtgcctacgagctcagcaagaacccatccgtacaggtggctataattgagcaatctgtgagtcctggtggcggcgcgtggctcggaggccagctattctctgctatggtggtccgcaagcctgcacatcatttccttgatgagctcgagattgagtatgatgaacaagacgactacgtggtcatcaagcatgctgcccttttcacttccacgatcatgagcaagctcttggctaggccaaacgtcaaacttttcaatgctgttgctgccgaggatttgattgtgaagggaggtcgtgttagtggcgttgtaacgaactgggctttggtgtccatgaaccatgacacacagtcgtgtatggacccgaatgtgatggaggctaaagtggtggtgagctcgtgcggacacgatggtccatttggcgccactggggttaagaggctcaagagcatcggcatgatagacaatgttccgggaatgaaggccttggacatgaacactgctgaagatgcaattgttaggctaactcgagagatcgtgcccggaatgatagttaccgggatggaggttgcagagattgatggggcaccgagaatgggtcctacctttggagcgatgatgatatcgggtcagaaggcggctcaccttgctttgagatccttggggctgcctaacgagttggacgggacgaatgtgggaaatgtccaacctgagctgatcttggctgctgctgatgatggaaatgagattgtggaagcttgaagagagtagttttgaagggtactaatgaagttgtagtaagtgaagggatgcgaataaaaagtattgttgtacatctcttgatgagagaggcttttagtgactgcttcagtgttttttactgttctctgtggtatgaactttggacagtatttaatactac

SEQ ID NO: 920 - DNA, 1288 bp, Scabiosa columbaria
atatatctcactcactctctcttcacttcatcacctcaccaccacaattcattaccaacaaatcctcacatctctcctttcactttcctaacaatggcaacaatggctaccctaacctcatctctctcatctgtttcttccaaaaccaattccttctatggagtccccgtcttctcacaaactcggctccgttccgtcaaatcaaacccccaaaacctatcaatatccatgtcggctacatctacgccttacgatctcagtgccttcgagttctctcctatcaaggagtccattgttgctcgtgaaatgacaaggagatacatgactgatatgatcacctttgccgacaccgacgttgtcatcgtcggcgctggttctgccggactctcgtgcgcttatgagctcagtaagaaccctgacgttcaggttgccatcattgaacaatctgttagccctggtggaggcgcgtggctcggtggtcaactcttctcagctatggttgtacgtaaaccagcacatcttttccttgatgagctagacatcgagtacgacgaaacagacaactacgttgtaatcaagcacgcagccttgttcacctcaacaatcatgagcaagttgttggccaggccaaatgtgaagctcttcaatgctgtggcggccgaggatctgatagtgaagggaggaagagtaggaggtgtggtgaccaactgggctttggtgtcaatgaaccacgatacacaatcgtgcatggaccccaacgtgatggaggctaaagtggtggtgagctcttgtgggcacgatggaccattcggtgccactggtgttaagaggctgagaagcattgggatgattgagagtgtaccggggatgaaggccttggacatgaacacggctgaggatgctattgtgaggctgacaagagagattgtgcctggtatgattgttaccggaatggaagttgctgagattgatggatctccaagaatggggcctacgttcggagctatgatgatatcaggacagaaggcagctcatctagcacttagggcacttggattgcctaatgctttggatggaaactatgtgggaagcgttcaaccagaactaatccttgcagctgctgatgctgctgcggatatagttgatgcttaaagcttagttagtaaatatgttaaataaggcgaaagaagagatgccgagtttggatgaataatttgatccattttggttatggttgtggtgtttattatggcaggatgggtttgtgtaggttgttttctcctttgtt

SEQ ID NO: 921 - DNA, 1989 bp, Trigonella foenum-graecum
cacctcactcacaaaaatggcggccgtaacttcctcatgttccaccgcgatctccgcctcttccaaaaccctagcgaagccagccaccacaagcttcgccgccgctaatctctcattttcaaagctacatcctcagtcagttaaggctcgccgatgtatcgctgtcggcggtgcacttggtgctcgtatggtgtcggctcctccggctactcttccggtttcgcttgatttcgaaacttccattttcaaaaaggaaagagttaacctcgccggacacgaagagtacatcgtgaaaggaggaagggatttgtttcatttgttgcccgatgcttttaaggggattaagcagattggtgttattggatggggttcacagggacctgctcaggcacagaatctacgggactcacttgctgaagcgaagtctgatattgttgttaagattggactcaggaaaggttctcgttcctttaatgaggctcgggaagctggatttactgaggagagtggaactcttggtgacatatgggaaacaatatcagccagtgatcttgtgttgttgttgatttctgactctgcacaggctgataattatgaaaaaatattttcccacatgaagccgaacagcatacttgggctgtcccatggttttcttcttgggcatttacagtcagttggacttgattttccaaaacacttcagtgtaattgccgtgtgcccgaaggggatgggtccatcagtgaggaggttgtatgtacaaggcaaagagataaatggggctggaattaattcaagttttgctgtccaccaggatgtggatggcagggctactgatgttgctttgggatggtctgttgctcttggttctcctttcacatttgccactacattagagcaggaatacaagagtgacatctttggagagagaggcattttacttggcgctgttcatggaatcgttgaatccttgtttaggaggtacactgaaaatggaatgagtgaagatttggcttataagaacaccgttgagtccataacaggagttatatctaaaaccatctcaactaagggcatgttggctgtatacaatgctttatctgaagatggaaagagggaatttgagaaagcatacagtgcttccttttatccctgcatggacattttgtatgagtgctatgaggatgtagccagtggtagtgagattcgcagtgttgttttggctggtcgtcgcttttacgagaaagagggtctgcctgcatttcccatgggtaaaattgatcagacccggatgtggaaggttggtgaactcgttcgctctacaaggccagcaggtgatctaggccctctatatccatttactgctggtgtctttgtggcactcatgatggcccagattgagatcttgaggaagaaaggacattcttactctgaaatcatcaatgagagtgtgattgagtcggttgattctttgaatccattcatgcatgctcggggtgtttctttcatggttgacaactgctcaaccacagcaaggttgggttcaaggaaatgggctcccagatttgattacatcctaactcagcaggctttggtggcagtggacaatggagctcctatcaaccaggacctaatcagcaacttcatgtcagacccagtgcacggagccattgaagtttgtgctcaattgagacccacattagacatttcagtgccagcagatgcagactttgtccgtcctgagttgcgtcagtctagtaactagaacatgagctaattattgcttttcttgagttgattccctttcagaaatcgctttgaattgcagctattgtgttaagtgagttttaaaatggttaagcgcctagtatggaagttttgtatgaccactttgtagtactaaggttgatttacgattgagtaatgttgcttgatgacatattagtaatgagagaataaattatgttcacaaatctttgggctgtcattgtt

SEQ ID NO: 922 - DNA, 1998 bp, Pisum sativum
ctcttcacttacaaaaatggcggccgttacttcctcatgctccaccgcgatctccgcttcttccaaaaccctagcgaagccagtcgccgcaagcttcgcccctactaatctctcattttcaaagctttctcctcagtcaatcagggctcgtagatccatcaccgtcggcagcgcactaggcgccaccaaggtgtcggctcctcccgccacacatcccgtttcgctcgattttgagacttctgtcttcaagaaggagagagttaacctcgccggccacgaagagtacatcgtgagaggaggaagagatttgtttcatttgttgcctgatgctttcaaggggattaagcagattggtgtcattggatggggttcacagggacctgcccaggcacagaatctacgtgactcgcttgttgaagcaaagtctgatattgtggttaaggttggacttaggaaaggttctagttcctttaacgaggcacgggaagctggatttagtgaggagaaaggaactctaggtgacatatgggaaactatatcaggcagtgatcttgtattgctgttaatttctgattctgcacaggcagataattatgagaaaatattctcccacttgaagccaaacagcatacttgggctgtcccacggttttcttcttgggcacttacagtcaattggacttgattttcccaaaaatttcagtgtaattgctgtgtgtccaaagggaatgggcccatctgtaaggaggctgtatgtacaaggcaaggagataaacggtgctggaattaattcaagttttggagtccaccaggatgtggatggcagggctactaatgttgctttggggtggtctgttgcccttggttctcctttcacatttgccactacattagagcaagaatacaagagtgacatttttggagagagaggaattttactgggtgctgttcatggaattgttgagtccttgtttagaaggtacactgaaaatggaatgagtgaggatttggcttataagaacaccgttgagtccataacaggagtaatatctaaaaccatctcaactcagggcatgttggctgtatacaatgctttatctgaagatggaaagaaggaatttgagaaagcatacagtgcttccttttatccctgcatggaaattttgtatgagtgctatgaggatgtagccagtggtagtgagattcgcagtgttgttttggctggtcgtcgattttatgaaaaagagggtctgcctgcatttcccatgggtaaaattgatcagacccgaatgtggaaggttggtgaacgcgttcgatctacaaggccggcaggtgatctaggccctctatatccatttactgctggtgtctttgtggcattgatgatggcccagattgaggtcttgaggaagaaggggcattcttactctgaaatcattaatgagagtgtgatcgagtctgttgattctttgaatccattcatgcatgctcgcggtgtttctttcatggttgacaactgctcaaccacagcaaggttgggttcaaggaaatgggctcccagatttgattacattctaactcagcaggccttggtggcagtggacagtggagctcccatcaaccaggacctgatcagcaacttcgtgtcagacccagtgcacggggccattcaagtttgcgctgagctaagacccacattagacatttcagtgccagcagatgcagactttgtccgtcctgagttgcgccagtctagtaactagaatgtgaacgaattatggctttttcaaagttttagtaactagcagctattgtgttaagtgagttttaaaatgtatggaagttttgtatgatcactttgtagtactaagtttgattttacgaatgagtaatgttgcttggtggtatattagaaatgagttcataaatgatgttcacaaatttttcggttgtcattgttacgttgaaataaattactgatgaggaaagttgccgtttc

SEQ ID NO: 923 - DNA, 2221 bp, Cajanus cajan
gaaaccaccctcattcactcactcactgaaccctttgtacctccaaacagccacttcacactccaacaatggcggctgcaacgtcctgttcttctgcgatttccgccgcctccgaaaccctacccaagcctccctccgccgccttctccgccaccagcctcgctctgccttcttcctcttccaagctcgctttcaaatccctaagactccgcccttgcgcctccgccctcggcgcccgcatggtgtcggcgccgccggtcaaggcccccgcgctcctcgacttcgacaccaacattttcaagaaggagaagattaacctcgccggacacgacgagtacatcgtgagaggtggcagggatttgtttcacttgttgcccgatgctttcaaggggatcaagcagattggggtcatcggttggggttctcagggacctgctcaggctcagaatctaagggactcgcttgctgaagccaagtctgatattgtggtcaagattggactcaggaaaggttctcgttcctttgctgaagctcgggcagctggattttctgaggagaatgggactctaggtgacatatatgaaactgtctccggcagtgatcttgtgttgctgttgatttctgattccgcacaggctgataattatgaaaagatattctcttacatgaagccaaacagcatacttgggctgtcccatgggtttcttcttgggcatttacagtcacaaggacttgattttccaaagaacattagtgtaattgctgtgtgccctaagggaatgggtccatctgtgaggaggctctatgtccaagggaaagaaataaatggtgctggaattaattcaagttttgcggtccaccaggatgtggatggcagggctactgatgttgctttggcatggtccgttgcccttggttctccattcacttttgccactacattagagcaggaatacaggagtgatatctttggggagagaggcattttacttggtgctgttcatggagttgtggaatccttgtttaggagattcactgaacatggaatgaatgaagatctggcctataagaatactgttgagtctataacaggaattatatctaaaaccatctcaactaagggcatgctagctgtatacaattctttatctgaagatgagaaaaaggaatttgagaaagcttatagtgcttcttattatccttgtatggagattttgtatgagtgctacgaggatgtagccagtggtagtgagattcgcagtgttgttctggctgggcgtcgcttttatgagaaagagggtctacctgcttttcccatgggtaatattgatcaaacccgcatgtggaaggttggtgagcgtgtccgatctacaagaccagcgggtgatcaaggcccattatatccttttactgctggcgtctttgtggcattgatgatggctcagattgagatcctgaggaagaagggtcattcgtactccgaaatcatcaatgagagcgtgatcgaggctgttgattctttgaatcctttcatgcatgcccgtggtgtttcattcatggttgataactgctcaaccacggctaggttaggttcgaggaaatgggctccacgatttgactacatcctaacccagcaggccttggtggctgtggacagtggaaaacctattaaccggtcattaatcagcaacttcctgtcagacccagtgcatgctgccattaaagtttgtgctgagctgagacctacggttgacatttctgtgtcggcagatgcagacttcgttcgtcccgagttgcgccagtccaacaattagaacatacagcaatcattttcagaactgaagttatcgtgatagtttgggtttttcagttttgcttttatgattgaatgctagtatgtaagttgtattaccattttgtagtttgtacccgtctgtttcctgccatcgaggaacgttgcttaatgtcctatttaaatgcaagttggtaaactatgtctagaggtgagccataaggttaagttcgcataatgtaagtgatgattaaataagtatttagttaagttgtttatttaaatgttccgtcaagtgaatgtttacagtcctagagagcatatggtgtttaatctaatgcatcaaaacagtttatatctaaaactattagagatgccgtagctgtggaggtttgggtagtatgtctaatgtttgaagttataacattg

SEQ ID NO: 924 - DNA, 2138 bp, Fragaria vesca
actttgccctcactctctcttcttccaggtcaaaaacataatggcggctgctacttcctctttctctccagccctcaccgctccaccttcctcatcctccgccgccgcctccaaaacctacccggctccctcctctctcggcttctcctccgccctctccaagtctctccaccctctcagggccagagccactcgcgctgctgctaatggctccgctctcggagctcgtatggtctcggtgccggcgattaagactcctctttcgcttgatttcgagacctctgttttcaagaaggagaagatcaacctcgctggtcacgatgagtatatcgtgagaggaggaagggacttattccatctgctgcctgatgcctttaaaggtatcaagcagattggtgttatcggttggggttctcagggacctgctcaagctcagaacttaagagattctcttgctgaagcgaagtctgatattgttgtcaagattgggcttaggaagggatcccgttcatttaatgaagctcgggcagttggtttcactgaggaaagtgggactttgggtgatatatgggaaacagtctcaagcagtgatcttgtgttgctgctaatttctgattctgcacaggcagataattatgagaaaatattttcgcacatgaaaccaaatagcatacttggtctttcccacggtttccttctggggcatttgcagtcagtgggacttgactttcccaagaacatcagtgtaattgctgtatgcccaaagggaatgggtccatcagtaaggagactttatgtccaaggcaaagaaataaatggtgcgggaattaattcaagttttgcagtccaccaggatgttgatgggagagccacagatgtggccctgggctggtccgttgcccttggttctcctttctcgtttgtcactacactagagcaggaatacaaaagtgacatctttggcgagagaggcatattacttggtgctgttcatggaattgtagaatcccttttcagaagatacactgacagtggaatgagtgaagattctgcttataaaaacactgttgaatgtgtaactggaatcgtgtcaaggaccatttcaaccaagggcatgttagaaatatacaactctttatctgaagcagacaagaaggaattcgaggctgcatacagtgcctcgtattatccctgcatggacatcctctatgaatgctatgaggatgtggcaagtggcagtgaaatccgcagtgtagtgttggctgggcgccgattttatgagaaggatggtcttcctgccttccctatggggaagattgatcagacgcgcatgtggaaagttggtgagcgtgtccgcgcgacacgccctgctggtgatctaggcccactacacccgtttacagctggtgtttttgtggccttgatgatggcacagattgaagtgttgaggaagaagggacactcttactcagagataatcaatgaaagtgtcattgagtcggtggattccttgaatccttttatgcatgctaggggagtatctttcatggtagataattgctcaacaacagcccggttgggatcaaggaaatgggctccaagatttgattatattctaactcagcaagcgttggttgccgtggacaacggtacacccatcaaccaggacctcattagcaatttcctgtcagatccagtgcatggagccattgaagtatgcgctcaacttagacccacagttgatatttcagtgcctgctgacgcagactttgtgcgaccagagttgcgctctagcaattagagcttgaagaacctagtaccttacctggcgtacaaaaatcctttttcgagaagtaacgtttgagtgctgtagctttacctagtttgttcgtgttaacttttctatcctatgtattttcatcgcattgcatgttatgtttcttatgaacaaatgaggtatggagttgaatgttgtattaagaatttctgtagcaagttacttgaataaagttggccttttttatgatgttcctggaatcagaaccagtaaacttaacatgttcttgcaatgtagcataatgagtgagatagacctctctcggcatctcaagtccaatatgtaaaccttactaaaatat

SEQ ID NO: 925 - DNA, 2071 bp, Lippia dulcis
ctactttcagtgccacttgacaaactccaaaagccacacctatggcggcgactgcgcctacctgcttctctaacaccgccacctcctccaaaaccctaactcaacaatccaaaacaccggctctctccgtcgggttcctttcatcccgttctcttaagccgctccgcgcggcggccgctgcttcccgaggtgcgtcagtttccggctctggtctttctgctcgcatggtctcagctccaacaataaagccccctgcctccctcgacttcgagacctccatcttcactaaggagaaagtcaacctcgctggtcacgatgagtacattgtgagaggaggaagaaatttgttcaagcttttgcctgacgcattcaagggcataaaacagattggagtgattgggtggggctcacagggtcctgctcaagctcagaatctaagggattctcttgctgaagtgaaatctgatattgtggtcaagattggcttgaggaagggttctaaatcttttgctgaggcccgtgctgctggttttacagaagaaagtgggaccctaggagacatatgggaaaccgtttccagcagtgatctagtaatgctcttaatatcagatgccgctcaggctgataactatgagaaaatcttctcccacatgaagcccaacagcatacttggactgtcccacggtttcctgttgggccatttgcaatccatgggtctcgattttcccaaaaacattagtgtgattgctgtgtgcccaaagggaatgggaccctcagtcaggaggttatatgtgcagggcaaagaaatcaatggtgctggtattaattcaagttttgctgtgcaccaggatgttgatggcagagctacagatgttgcccttggatggtctgttgcacttggttcgccctttacttttgctactactctggagcaggagtacaagagtgacatctttggagagagaggcattctacttggtgctgtccatggtgttgtggaatgtttgttcagaaggttcactgaaaaaggaatgagcgaggatcttgcttacaagaacacagtggagagcattactggaataatatctaggactatatcaacgaaggggatgctggctgtttacaactcgttagatgaacagggcaaaaaagactttgagactgcctacagctcgtcatattacccttgcatggatattctatatgagtgctacgaagatgtagctagtggcagtgagattaggagtgttgtattggctggtcgtcggtttcatgaaaaggatggactaccctctttccccatgggcaaaattgatcagacacggatgtggaaagtcggtgaacgagttagagcaacacgtccagcaggtgacttgggacctctctatcctttcactgctggtgtctttgtcgctctgatgatggcccagattgagatattgaggaaaaaaggccactcctactctgagatcataaacgagagtgtgatcgaggctgtggattcactcaacccattcatgcacgcccgaggggtctccttcatggttgacaattgttcaacaacagcacggttgggatcaagaaagtgggccccaagatttgactacgtccttacccaacaggcacttgttgcagttgacaatggcaccccagtcaatcgggatctgatcagcaacttcctttcagatccagtgcatggtgctattgacgtttgtgctcagttgagacctactgttgacatttctgtgactgcagatgcagatttcgttcgccccgagttgagacagtccgcaaactaaaggcatcttgtgcttttcttcccgtcgtttgagctgaggtttaaatattatgtcagtgagagccagccaattgtaggctgctgctactttgcttgagttttactagtcggattgtctgttatttatgttgttttgggacgatgtgactcgggttgttctggtgatgagattgctgtagtatcctgttgcatgttctgaaaattcgtgatggttgttgaaaaccatacagcacttcgttctatttcctacacataaattttaattgaaacata

SEQ ID NO: 926 - DNA, 2172 bp, Euonymus alatus
ataaaaaccctcgcaacactcccccaatttcgcatttgtttccacgtctgctgcgactgaaatggcggcggcgacctcttctatctcttctgcgatctctactggatcttcatcatccagatccaaagatttaaaagtcccagctactcctgctggcgtcagtttggggttcctcgcctcgagctctatggccttgaaacccctcaaagcaagtcgctgcattggaggctcggctctcggagcccgcatggtgtctgtaccgtcttctgtgaagcctttgacttcgctggacttcgagacatctgtttttaagaaagagaaggtcacccttgccggtcatgacgagtacattgtgaggggagggagagatttattccctttgctatcagatgcattcaagggaattaagcagattggagttattggttggggttcccagggacctgctcaagcccagaacttaagggattctcttgctgaggctaagtctgatgttgttgtgaagattggactaagaaaaggctctcattcatttgctgaagctcgtgctgttggttttaccgaagaaaatgggactttgggtgacatctgggaaactgtttctggcagtgatcttgtgttgctgttgatatctgatgctgcacaggctgataactatgaaaaaatattttcccacatgaagccgaatagcatacttgggctttcccatggatttcttcttggccatttacagtcaatgggactggatttcccaaaaaatattagtgttatcgctgtgtgtcccaagggaatgggtccatctgtgaggaggctttatgttcaaggcaaagagatcaatggtgcagaatcaatgccagttttggagtccaccaggacgtagatggtagagctacagatgttgccttggggtggtcagtggcccttggttctccttttacatttgcgactacactggagcaggagtacaagagtgacatcttcggggagaggggcattttacttggtgctgttcatggaattgtggagtcattatttagaagattcactgaacatggaatgagcgaagaaacggcttacaataatactgttgaatgcataacgggaaatatatcaaggaccatctcaactcagggcatgttagctgtctacaattccttgtcagaagaagggaagagggattttgagattgcgtacagtgcgtcatattatccactcatggacatcttgtacgagtgctatgaagatgtagcttgtggtagtgagatccgcagtgttgtactagctgggcgccgcttttatgaaaaggatggtcttccggctttcccaatggggaagatcgatcagacaagaatgtggaaagttggtgaacgtgttagatcagtacggcccgcaggtgatttggggccattgtaccccttcacggctggagtctatgtggcgctaatgatggcccagattgagatcttgagaaagaaaggccattcatattctgagatcatcaatgaaagtgtgattgagtcggtggactccttgaatccttttatgcatgctcgtgggctttcttttatggttgacaactgctcaacaacagcaagactgggatcgaggaagtgggctccacgttttgattacatccttacccaacaagccttggtggctgtggacaatggtacccctgtcaatggtgatctcattagcaacttcttatcagatcaggtgcatggagccattgaagtatgtgcccagttgagacctacagtggacatatcagttcctgctgatgctgattttgtgcgtccagagttgcgtcagtccagcagttaaaggtcattgaaaacctttagcctgggctaatcatatgatgcattcccgtgcaaggaggtagtttcttgaatgcagattgtagcttacaaaactattggtctagtttatccagttgtatttgtaacgtgacgtatgtcgtgtgtttttgctgtgcaagtaaacatgatggtgtggtgttggtcagtcgttgggtttcaaggcaattgatcatcagttttgggaaaccttgactacctaaattagtgtcttttgcttttaagctcctctagttcttttgtgatgtcagaaactgggaataaggttttgtaaccgtgaataatggcagtaatggacctaatggttgaagtg

SEQ ID NO: 927 - DNA, 2215 bp, Euonymus alatus
ttgtttctacgtcggctgcgactgaaatggcggcggcaacctcttctatctcttctgcgatctctactggatcttcatcatccagatccaaagatttaaaagtcccagctactcctggtggcgtcagtttggggttcctctcctcgagctctatggccttgaaacccctcaaagcaagtcgctgcattggaggctcggctctcggagcccgcatggtgtctgtaccgtcttctgtgaagcctttgacttcgctggacttcgagacatctgtttttaagaaagagaaggtcacccttgccggtcatgacgagtacattgtgaggggagggagagatttattccctttgctatcagatgcattcaagggaattaagcagattggagttattggttggggttcccagggacctgctcaagcccagaacttaagggattctcttgctgaggctaagtctgatgttgttgtgaagattggactaagaaaaggctctcattcagttgctgaagctcgtgctgttggttttactgaagaaaatggaactttgggtgacatatgggaaactgtttctggcagtgatcttgtgttgctgttgatatctgatgctgcacaggctgataactatgaaaaaatattttcccacatgaagccgaatagcatacttgggctttcccatggatttcttcttggccatttacagtcaatgggacttgatttcccaaaaaatattagtgttatcgctgtgtgtcccaagggaatgggtccatctgtgaggaggctttatgttcaaggcaaagagatcaatggtgcaggaatcaatgccagttttggagtccaccaggatgttgatggtagagctacagatgttgccttggggtggtcagtggcccttggttctccttttacatttgcgactacactggagcaggagtacaagagtgacatcttcggggagaggggcattttacttggtgctgttcatggaattgtggagtcattatttagaagattcactgaacatggaatgagcgaagaaacggcttacaataatactgttgaatgcataacgggaaatatatcaaggaccatctcaactcagggcatgttagctgtctacaattccttgtcagaagaagggaagagggattttgagattgcgtacagtgcatcatattatccactcatggacatcttgtacgagtgctatgaagatgtagcttgtggtagtgagatccgcagtgttgtactagctgggcgccgctttcatgaaaaggatggtcttccggctttcccaatggggaagatcgatcagacaagaatgtggaaagttggtgaacgtgtcagatcagtacggccagcaggtgatttggggccattgtatcccttcacggctggagtctatgtggcactaatgatggcccagattgagatcttgagaaagaaaggccattcatattctgagatcatcaatgaaagtgtgattgagtcggtggactcgttgaatccttttatgcatgctcgtgggctttcttttatggttgacaactgctcaacaacagcaagactgggatcgaggaagtgggctccacgttttgattacatccttacccaacaagccttggtggctgtggacaatggtacccctgtcaatggtgatctcattagcaacttcttatcagatcaggtgcatggagccattgaagtatgtgcccagttgagacctacagtggacatatcagttcccgctgatgctgattttgtgcgtccagagttgcgtcagtccagcagttaaaggtcattgaaaacctttagcctgggctaatcatatgatgcattcccgtgcgaggagatagtttcttgaatgcagattgtagcttacaaaactattggtctagtttatccagttgtatttgtaatgtgacgtatgtcgtgtgttttggctgtgcaagtaagcatgatggtgtggtgtgggtcagtcgttgggtttcaaggcaattgatcatcagttttgggaaaccatgactacctaaattagtgtcttttgcttttaggctcctctagttcgtttgtgatgtcagaaactgggaataaggttttgtaaccgtgaataatggcagtaatggacctaatggttgaagtgttttgatatctgtgattttctctctgcttttttatgtatcactttttgatgatgttaaagtatctttcagagcaaat

SEQ ID NO: 928 - DNA, 2105 bp, Tripterygium wilfordii
tgtcatatcttctgctgcgactgaaatggcggcggccacctcttctatctcttctgcaatctctactgctcgatcttcatcgtccaaatgcaaagccttaaaagccccagctactcctgctggcgtcagtttggggttcctcgcctcgagctccagggccctgaaacccttgagatcaagccgctgcgttggaggcggaaatggttcggctctcggagcccgcatggtgtctgcaccagcttccgtgaagccattgacttcactggacttcgagacatctgtatttaagaaagagaaggtcactcttgccggtaatgacgagtatattgtaaggggagggagggatttattccctttactgccagatgcattcaaggggattaagcagattggagttattggttggggttcccagggacctgctcaagcccagaacttaagggattctcttgctgaggctaagtccgatgttgttgtgaagattggactaagaaagggctcacgttcatttgctgaagcccgtgctgctggttttactgaagaaaatgggactttgggtgacatctgggacactatttctggcagtgatcttgtgttgctgttgatctctgattctgcacaggctgataactatgaaaaagtattttcccacatgaagccgaatagcatacttgggctttcccatgggtttcttcttgggcatttacagtcaatgggacttgatttcccaaaaaatattagcgttatcgctgtgtgtcccaagggaatgggtccatctgtgaggaggctttatgttcaaggcaaagagatcaatggtgcaggaattaatgccagttttgcagtccaccaggatgtagatggtagtgctacagatgttgccttggggtggtcagtggcccttggttctccttttacctttgcgactacactggagcaggagtacaagagtgacatctttggggagcggggcattttactcggtgctgttcatggaattgtggagtcattattcaggagattcactgaacatggaatgagtgaagaaacggcttacaagaatactgttgaatgcataacgggaaatatatcaaggaccatctcaactcagggcatgttagctgtctacaattccttgtcagaagaagggaagagggattttgagattgcgtacagtgcgtcatattatccactcatggacatcttgtacgagtgctatgaagatgtagcttctggtaatgagatccgcagtgttgtactagctgggcgccgcttttatgaaaaggatggtcttccagctttcccaatggggaatatcgatcagacaagaatgtggaaagttggtgaacgagtcagatcagtacggccagcaggtgatttggggccattgtacccattcacggctggagtctttgtggcgctaatgatggcccagattgagatcttgagaaagaagggccattcatattctgagatcatcaatgaaagtgtgatcgagtcagtggactctttgaatccttttatgcatgctcgtgggctttcttttatggttgacaactgctcaacaaccgcaagattgggatcgaggaagtgggctccacgtttcgattacatccttacccaacaagccttggtagctgtggacaatggtacctctgttaatggcgatctcattagcaacttcttatcagatcaggtgcatggagccattgaagtctgtgcccagttgagacctacagtggacatatcagttcccgctgatgctgattttgtgcgtccagagttgcgtcagtccagcggttaaaggtcatcaaaaaccattagcttctgcctaatcatatgatgcattcccatgggaggaggtagttttattgcatgcagattgtagcttacaaaactatgggtgcagtttatgcagtttatccagttatatttgtaacgtgatgaatttgtgtgtttttgttatgcaagtagacatgatgatgagggtcagtctttggtcagaaacttggaagaaggttttgtaaccatgaaataatggctgtaatggttgaagtgtttttcatctctgtgattttctcccttcgttttaaatgaagtttgaaaca

SEQ ID NO: 929 - DNA, 2114 bp, Orobanche aegyptiaca
cgcaaactcgagaagccacagcaaaatggcggccgctgcccccacctccttctccacctccacccacacccccatcgccaccccctcttccaaagccttgatacctcctaccagagcgccgacaatttccttaggcttcctgtcatcatcatctccttcccataaacctctccgtgctgccgccgcttcacgagctgcgtccggctctgctgtggcagctagaatggtggcggaccccgctatcaagaccccagagttcctggactttgacacatctgtgttcactaaagagaaaataaacctcgccggtcacgatgagtacattgtaagaggagggagggatttgtttaagttgttgccagatgcattcaagggtataaagcagattggagtcatcggttggggctcacagggacctgctcaagctcagaatataagggattcacttggtgaagtgaaatctgatattgttgtcaagattggtttgaggaagggttctagttcatttgctgaggcccgtgctgctggttttacggaagaaaatgggaccctaggagacatatgggagactgtttccagcagtgatttggtgctgctcttgatatcagatgccgctcaggctgataattacgagaaggtgttctcccacatgaaaccaaatagcatactaggactttcccatgggttcctgttgggtcatttgcagtcaatgggtcttaacttcccccagaacatcagtgtgatagctgtatgtcccaagggaatgggaccctcggttaggaggttatacgtgcaggggaaagaaatcaatggtgctggtattaatgctagttttgctgtccaccaggatgttgatggcagagctacagatgttgcccttggatggtcagttgctcttggttcaccttttactttcgctactacactggagcaggagtacaagagtgatatttttggggagcgaggcattttactcggcgctgtgcatggtgtcgtagagtccttgtttagaaggtacaccgaaaatggaatgagtgaggatcttgcttataagaacactgtggagagcattacaggaataatatctaagaccatatcaacaaagggcatgcttgctgtatataatgcattaagtgaaggtgacaaaaaagaatttgaggcagcatatagtgcttcatattatccatgcatggatatcctttacgagtgctatgaagatgtagctagtggcagtgagataaggagtgttgtcttggctggccgtcgcttttatgaaaaggagggattacctgcttttcccatgggcaaaattgatcagacacgtatgtggaaaattggtgagcgagttcgggcaacacgtccagctggcgacttgggacctctgtaccctttcactgcaggggtatttgtggcgttgatgatggcccagattgagattttgcgaaagaaaggccactcctactctgagataataaacgagagtgtgatcgagtctgtggattcattgaatcctttcatgcacgcccgaggcgtttcgttcatggtggataactgttcgacaacagcacgtttgggatcaaggaagtgggccccgagatttgattacattctgactcagcaggcactggttgccgtggacagtgcagccccaatcaatcgggaccttatcagcaacttcctctcagatcccattcacggtgctatccaagtatgtgcccagttgaggcccactgttgatatctcggtgcctgcggatgcagattttgtccgtcccgaactccgccaatctggcaattgatgatcttatttactcagttgttactgagatgttttgttatgcttgtagaattatggttatgtatttgcctttactggaaacgattgttctattaatcagtgtattgtcgtgtggacgtttatatgttccgcgacctatgagatatgatgattgtaatgtggatgactgcagcagttgattatcggccaaataaatgtgataatgcctgcataattttctctgtattgcgtagttcattttaacatttgagccttacagagtgcggaattaagctcagggcacaatggatctctaatttcaaaaatttgtattcgag

SEQ ID NO: 930 - DNA, 2073 bp, Citrus clementina
cgatccccaaagttaggattagtccatcgccatcgtccgaaaccctaaaaggagatactataaaagttcacttaacactcactgctcgatgagtcaaaaaaaacaaaatggtggcgggtactttaccatctagtccgtcgatccccaaatttagtccatcgccgtcgtccgaaaccctaaaaggagcattcaagcatctcaatctagcgtttttctcatccaccgcgaagtccttgagagctctcaaaactaccagaggcaggggctcagctctcggcgctcagatggcgtccgagacagctctcaagacacctttcttgctggattttgagacatccgtctttaagaaggacgcgatatcactggctaaccgcgatgagttcattgtgagaggaggaagggatttgtttaagttgctgccggacgcattcaacgggattaaccagattggggtgattggctggggttcccagggacctgcccaagctcagaatttgagggattcccttgctgaagctaaatctgatattgttgtcaaggttgggcttaggaagggctctcgttcttttgctgaagctcgtgctgctggttttactgaagagaatggaactttgggggatatatatgaaactatttcaggcagtgatcttgtgttattgttgatttctgatgctgctcaggcagataattatgagaagatattctcttgcatgaaaccaaacagcatccttggactttcccatgggtttcttcttgggcatttgcagtcaataggacttgatttcccaaagaatatcagtgtgattgctgtgtgtcccaagggaatgggtccatctgtgaggagactctatgttcaaggcaaagagattaatggtgctggaattaattccagttttgctgtccaccaggatgttgatggaagagctaccaatgtcgccctaggatggtcagttgcccttggttctcctttcacatttgccaccacattagagcaggagtacaagagtgacatctttggggagcgtggcattctacttggtgctgttcatggaattgtggaatccttgtttagaaggttcactgaaaatggaatgagtgaggatctggcttacaagaataccgtggagtgcataacaggaattatatcaaagatcatctcaactcagggtatgttggctgtctacaattccttctctggagaagacaaaaaggaattcgagaaagcttatagtgcctcatattatccgtgcatggaaatcttatatgagtgctatgaagatgtggccgctggcagtgagatccgcagtgttgtcttggctggacgtcggttttatgaaaaggaaggtctaccagctttccctatgggaaaaattgatcagactcgcatgtggaaagttggtgagcgagtccgatcaacacgtccagcaggtgacttaggcccattacacccattcacagcaggtgtctatgtggctctgatgatggcccagattgagatcctgaggaagaaagggcactcctattctgagatcatcaatgaaagtgtgattgagtcggtggattcattgaatccattcatgcatgctcgtggagtttcatttatggtcgacaactgctctacaacagcccgtttgggatcaaggaaatgggcccctcgttttgattacatcctgacacaacaagccttggtggcagtggacaatgatgcccccatcaatggggatctcatcagcaacttcctttctgatccagtccatggagccattgaagtctgtgctcagttgagaccaactgttgacatttcagtgccaccagatgcagattttgtgcgcccagagttgcgtcagggtagcaattgagtcctggtgaatccttaactttttgtttctagcccaaaaaataatttcccctagggatattgtagatagagactttgcttagtcgtgtgagttgctgcttatttatttagttttgctgggcgagtgttgtactatgtccggtttggttgaagaagacatgagaatatgctttctggtttttgaatttggtggaataatagtatgtttccgagga

SEQ ID NO: 931 - DNA, 2070 bp, Citrus sinensis
gccgaaaccctaaaaggagatactataaaagttcacttaacactcactgctagatgagtcaaaacaaaaaaaatggtggcgggtactttaccacttagcccgtcgatccccaaattgagtccatcgccgtcgtccgaaaccctaaaaggagcactcaagcatctcaatctagcgtttttctcatccaccgcgaagtccttgagagctctcaaaactaccagaggcaggggctcagctctcggcgctcggatggcgtccgagacagctctcaagacacctttcttgctggattttgagacatccgtctttaagaaggacgcgatatcactggctgaccgcgatgagttcattgtgagaggaggaagggatttgtttaagttgctgccggacgcattcaacgggattaaccagattggggtgattggctggggttcccagggacctgcccaagctcagaatttgagggattcccttgctgaagctaaatctgatattgttgtcaaggttgggcttaggaagggctctcgttcttttgctgaagctcgtgctgctggttttactgaagagaatggaactttgggggatatatatgaaactatttcaggcagtgatcttgtgttattgttgatttctgatgctgctcaggcagataattatgagaagatattctcttgcatgaaaccaaacagcatccttggactttcccatgggtttcttcttgggcatttgcagtcaatgggacttgatttcccaaagaatatcagtgtgattgctgtgtgtcccaagggaatgggtccatctgtgaggagactctatgttcaaggcaaagagattaatggtgctggaattaattccagttttgctgtccaccaggatgttgatggaagagctaccaatgtcgccctaggatggtcagttgcccttggttctcctttcacatttgccaccacattagagcaggagtacaagagtgacatctttggggagcgtggcattctacttggtgctgttcatggaattgtggaatccttgtttagaaggttcactgaaaatggaatgagtgaggatctggcttacaagaataccgtggagtgcataacaggaattatatcaaagatcatctcaactcagggtatgttggctgtctacaattccttctctggagaagacaaaaaggaattcgagaaagcttatagtgcctcatattatccgtgcatggaaatcttatatgagtgctatgaagatgtggccgctggcagtgagatccgcagtgttgtcttggctggacgtcggttttatgaaaaggaaggtctaccagctttccctatgggaaaaattgatcagactcgcatgtggaaagttggtgagcgagtccgatcaacacgtccagcaggtgacttaggcccattacacccattcacagcaggtgtctatgcggctctgatgatggcccagattgagatcctgaggaagaaagggcactcctattctgagatcatcaatgaaagtgtgattgagtcagtggattcattgaatccattcatgcatgctcgtggagtttcatttatggtggacaactgctctaccacagcccgtttgggatcaaggaaatgggcccctcgttttgattacatcctgacacaacaagccttggtggcagtggacaatgatgcccccatcaatggggatctcatcagcaacttcctttctgatccagtccatggagccattgaagtctgtgctcagttgagaccaactgttgacatttcagtgccaccagatgcagattttgtgcgcccagagttgcgtcagggtagcaattgagtcctggtgagtccttaatttttttgtttctagcccaaaaaataattccccctagggatattggaggtagagactttgcttagtcgtgtgagttgccgcttatttatttagtgtgctgggcgagtgttgcactatgtccggtttggttgaagaagacatgagaatatgcttctggtttttgaatttggtggaataatagtatgtttccgaggaatgtgctgacagaatacatcttgttttgatttt

SEQ ID NO: 932 - DNA, 2123 bp, Oryza sativa
tggaaataagacagcctactcaattgcgtcacccgtgtataaatccattcggatttgggcttaacctggtccgcaccaaccaaccactgctctcgccgcgccgtcctcttcatctgcacttgcactgcgccatggcggcctcgaccaccctcgccttatcccaccccaaaaccctagccgccgccgccgccgcggcccccaaggccccgacggcgccggccgccgtctccttcccggtctcacatgccgcctgcgcgccgctcgccgcccgacgccgcgcggtcaccgccatggtcgcggcgccgccggccgtcggggccgccatgccgtcgctcgacttcgacacatccgtcttcaacaaggagaaggtctccctcgccggccacgaggagtatatcgtgaggggtgggaggaacctgttcccgctgcttcccgaggcgttcaagggcatcaagcagatcggagtgattggatggggctctcaggggcctgcacaagcccagaacctgagggattcactagctgaagcgaagtctgacattgttgttaagattggtctccggaaaggctctaagtcatttgatgaagcacgtgctgctggctttactgaagagagtggaaccttgggtgatatttgggagactgtttctggcagcgacctcgtgttgctgttgatatcagacgctgcacaggcagacaactatgagaaaatcttctctcacatgaaaccaaacagtattcttggtttatcacatggatttttgcttggacatttgcaatctgctggccttgatttcccaaaaaatatcagcgtgattgctgtatgccccaagggaatgggtccatccgttcggaggttatacgtacaaggcaaagaaattaatggtgctggtatcaactctagttttgctgttcaccaggatgttgatggaagggcaactgatgttgctctaggatggtcagttgcgctgggatctcccttcacatttgctactaccttagaacaggagtacaagagcgatatctttggggagcgaggcattcttcttggagctgttcatggcatcgtggaggctctgtttaggagatacacagagcaaggaatggatgaagaaatggcatacaaaaacaccgtagagggcatcactggaattatctcgaaaactatctcaaagaagggaatgcttgaagtgtacaactccttgacagaggaggggaagaaggaattcaacaaggcctacagtgcatcattctatccttgcatggacatactctatgagtgctacgaagatgttgcctctggaagtgaaatccggagtgttgtgttggctggacggagattttacgagaaggaaggccttcctgctttccctatgggcaacatcgaccaaactcgtatgtggaaggttggtgaaaaggtgcggtcaacccgaccagaaaacgatcttggccccctgcatcccttcactgctggagtctacgttgcactgatgatggctcagatcgaggtccttagaaagaagggtcactcctactcagagatcatcaacgagagcgtcatcgagtccgtggactcactgaaccccttcatgcatgctcgtggagtggccttcatggttgacaactgctcaacgacggctcgtctgggatcaaggaaatgggcgccacgcttcgactacatcctgacccagcaagcattcgtgacagtggacaaggatgctcccatcaaccaggacctcatcagcaacttcatgtccgaccccgtccatggcgcaatcgaggtgtgcgctgagctgcggcccaccgtcgacatctccgtgcctgccaacgccgatttcgtgcgcccagagctccggcagtcatcgtagagtgagataagataatctcaagggagcttgcatcttgttacagtttgtccgagagtattgtatgtgtgtgcgtgactgtctgaacttgtgagcttgccatcaggtgacctggaactggcctgagcatctttttcccgaataaaatgaggcccggattctgaatacttagctttctcaataccatatactccacttctctggacagattcgtaataatagacaccacggtgtgtctagtcgagtactagactaggc

SEQ ID NO: 933 - DNA, 1964 bp, Oryza sativa
ggtccgcaccaaccaaccactgctctcgccgcgccgtcctcttcatctgcacttgcactgcgccatggcggcctcgaccaccctcgccttatcccaccccaaaaccctagccgccgccgccgccgcggcccccaaggccccgacggcgccggccgccgtctccttcccggtctcacatgccgcctgcgcgccgctcgccgcccgacgccgcgcggtcaccgccatggtcgcggcgccgccggccgtcggggccgccatgccgtcgctcgacttcgacacatccgtcttcaacaaggagaaggtctccctcgccggccacgaggagtatatcgtgaggggtgggaggaacctgttcccgctgcttcccgaggcgttcaagggcatcaagcagatcggagtgattggatggggctctcaggggcctgcacaagcccagaacctgagggattcactagctgaagcgaagtctgacattgttgttaagattggtctccggaaaggctctaagtcatttgatgaagcacgtgctgctggctttactgaagagagtggaaccttgggtgatatttgggagactgtttctggcagcgacctcgtgttgctgttgatatcagacgctgcacaggcagacaactatgagaaaatcttctctcacatgaaaccaaacagtattcttggtttatcacatggatttttgcttggacatttgcaatctgctggccttgatttcccaaaaaatatcagcgtgattgctgtatgccccaagggaatgggtccatccgttcggaggttatacgtacaaggcaaagaaattaatggtgctggtatcaactctagttttgctgttcaccaggatgttgatggaagggcaactgatgttgctctaggatggtcagttgcgctgggatctcccttcacatttgctactaccttagaacaggagtacaagagcgatatctttggggagcgaggcattcttcttggagctgttcatggcatcgtggaggctctgtttaggagatacacagagcaaggaatggatgaagaaatggcatacaaaaacaccgtagagggcatcactggaattatctcgaaaactatctcaaagaagggaatgcttgaagtgtacaactccttgacagaggaggggaagaaggaattcaacaaggcctacagtgcatcattctatccttgcatggacatactctatgagtgctacgaagatgttgcctctggaagtgaaatccggagtgttgtgttggctggacggagattttacgagaaggaaggccttcctgctttccctatgggcaacatcgaccaaactcgtatgtggaaggttggtgaaaaggtgcggtcaacccgaccagaaaacgatcttggccccctgcatcccttcactgctggagtctacgttgcactgatgatggctcagatcgaggtccttagaaagaagggtcactcctactcagagatcatcaacgagagcgtcatcgagtccgtggactcactgaaccccttcatgcatgctcgtggagtggccttcatggttgacaactgctcaacgacggctcgtctgggatcaaggaaatgggcgccacgcttcgactacatcctgacccagcaagcattcgtgacagtggacaaggatgctcccatcaaccaggacctcatcagcaacttcatgtccgaccccgtccatggcgcaatcgaggtgtgcgctgagctgcggcccaccgtcgacatctccgtgcctgccaacgccgatttcgtgcgcccagagctccggcagtcatcgtagagtgagataagataatctcaagggagcttgcatcttgttacagtttgtccgagagtattgtatgtgtgtgcgtgactgtctgaacttgtgagcttgccatcaggtgacctggaactggcctgagcatctttttcccgaataaaatgaggcccggattctgaat

SEQ ID NO: 934 - DNA, 2427 bp, Citrus clementina
acaattcagttccgatgctttacaaaattgattacgctctacatatacccctctgtctatagaagtttcaatacagcttagcaacaacttgtgacagaaaaataacagcaaaaataaaccaacaaatatagagccctaaataaatcaattccactacacgacatagtctttaaaccaccgagggagctttttttaatcgtgtgcttttctgtagttcattacaagctgcttcatcctcaacatgtgacatgatttccttcttgggctgctcataattggactcatgaatgggctactcttcttgtaaacattcaggttagtccaactgaatttggaaggttgtgtcagtctccgtgggtctctccacagctgccgttgtatcgtcttcgacggctgccatcaaattctgaaggtgagtaaaaaaaaaaaatggcggcggctactttaccatttagtcgcccgatccccaaatttagtccatcgccgtcgtccgaaaccctaaaagaagcactcaagcatctcaatctagcgtctttctcatccaccgcgaagtccttgagagctctcaaaactactacaggcaggggctcagctctcagcgcttggatggcgtccgagacagctctcaagacacctttcttgctggattttgagacatctgtctttaagaaggacatgatatccctggctgaccgcgatgagtacattgtgagaggaggaagggatttgtttaacttgctgccggacgcattcaacgggattaaccagattggggtgattggctggggttcccagggacctgcccaagctcagaatttgagggattcccttgctgaagctaaatctgatattgttgtcaaggttgggcttaggaagggctctcgttcttttgctgaagctcgtgctgctggttttactgaagagaatggaactttgggggatatatatgaaactatttcaggcagtgatcttgtgttattattgatttctgatgctgctcaggcggataattatgagaagatattctcttgcatgaaaccaaacagcatccttggactttcccatgggttccttcttgggcatttgcagtcaatgggacttgatttcccaaagaatatcggtgtgattgctgtgtgtcccaagggaatgggtccatctgtgaggagactctatgttcaaggcaaagagattaatggtgctggaattaattccagttttgctgtccaccaggatgttgatggaagagctaccaatgtcgccctaggatggtcagttgcccttggttctcctttcacatttgccaccacattagagcaggagtacaggagtgacatctttggggagcgtggcattctacttggtgctgttcatggaattgtggaatccttgtttagaaggttcactgaaaatggaatgaatgaggatctggcttacaagaataccgtggagtgcataacaggaattatatcaaagatcatctcaactcagggtatgttggctgtctacaattccttctctggagaagacaaaaaggaattcgagaaagcttatagtgcctcatattatccgtgcatggaaatcttatatgagtgctatgaagatgtggccgctggcagtgagatccgcagtgttgtcttggctggacgtcggttttatgaaaaggaaggtctaccagctttccctatgggaaaaattgatcagactcgcatgtggaaagttggtgagcgagtccgatcaacacgtccagcaggtgacttaggcccattacacccattcacagcaggtgtttatgcggctctgatgatggcccagattgagatcctgaggaagaaagggcactcctattctgagatcatcaatgaaagtgtgattgagtcagtggattcattgaatccattcatgcatgctcgtggagtttcatttatggtggacaactgctctaccacagcccgtttgggatcaaggaaatgggcccctcgttttgattacatcctgacacaacaagccttggtggcagtggacaatgatgcccccatcaatggggatctcatcagcaacttcctttctgatccagtccatggagccattgaagtctgtgctcagttgagaccaactgttgacatttcagtgccaccagatgcagattttgtgcgcccagagttgcgtcagggtagcaattgagtcctggtgagtccttaatttttttgtttctagcccaaaaaataattccccctagggatattggaggtagagactttgcttagtcgtgtgagttgccgcttatttatttagtgtgctgggcgagtgttgcactatgtccggttttgttgaagaagacatgagaatatgcttctggtttttgaatttggtggaataatagtatgtttccgaggaatgcgctgacagaatacatcttgttttgatttt

SEQ ID NO: 935 - DNA, 2426 bp, Citrus sinensis
acaattcagttccgatgctttacaaaattgattacgctctacatatacccctctgtctatagaagtttcaatacagcttagcaacaacttgtgacagaaaaataacagcaaaaataaaccaacaaatatagagccctaaataaatcaattccactacacgacatagtctttaaaccaccgagggagctttttttaatcgtgtgcttttctgtagttcattacaagctgcttcatcctcaacatgtgacatgatttccttcttgggctgctcataattggactcatgaatgggctactcttcttgtaaacattcaggttagtccaactgaatttggaaggttgtgtcagtctccgtgggtctctccacagctgccgttgtatcgtcttcgacggctgccatcaaattctgaaggtgagtaaaaaaaaaaatggcggcggctactttaccatttagtcgcccgatccccaaatttagtccatcgccgtcgtccgaaaccctaaaagaagcactcaagcatctcaatctagcgtctttctcatccaccgcgaagtccttgagagctctcaaaactactacaggcaggggctcagctctcagcgcttggatggcgtccgagacagctctcaagacacctttcttgctggattttgagacatctgtctttaagaaggacatgatatccctggctgaccgcgatgagtacattgtgagaggaggaagggatttgtttaacttgctgccggacgcattcaacgggattaaccagattggggtgattggctggggttcccagggacctgcccaagctcagaatttgagggattcccttgctgaagctaaatctgatattgttgtcaaggttgggcttaggaagggctctcgttcttttgctgaagctcgtgctgctggttttactgaagagaatggaactttgggggatatatatgaaactatttcaggcagtgatcttgtgttattattgatttctgatgctgctcaggcggataattatgagaagatattctcttgcatgaaaccaaacagcatccttggactttcccatgggttccttcttgggcatttgcagtcaatgggacttgatttcccaaagaatatcggtgtgattgctgtgtgtcccaagggaatgggtccatctgtgaggagactctatgttcaaggcaaagagattaatggtgctggaattaattccagttttgctgtccaccaggatgttgatggaagagctaccaatgtcgccctaggatggtcagttgcccttggttctcctttcacatttgccaccacattagagcaggagtacaggagtgacatctttggggagcgtggcattctacttggtgctgttcatggaattgtggaatccttgtttagaaggttcactgaaaatggaatgaatgaggatctggcttacaagaataccgtggagtgcataacaggaattatatcaaagatcatctcaactcagggtatgttggctgtctacaattccttctctggagaagacaaaaaggaattcgagaaagcttatagtgcctcatattatccgtgcatggaaatcttatatgagtgctatgaagatgtggccgctggcagtgagatccgcagtgttgtcttggctggacgtcggttttatgaaaaggaaggtctaccagctttccctatgggaaaaattgatcagactcgcatgtggaaagttggtgagcgagtccgatcaacacgtccagcaggtgacttaggcccattacacccattcacagcaggtgtttatgcggctctgatgatggcccagattgagatcctgaggaagaaagggcactcctattctgagatcatcaatgaaagtgtgattgagtcagtggattcattgaatccattcatgcatgctcgtggagtttcatttatggtggacaactgctctaccacagcccgtttgggatcaaggaaatgggcccctcgttttgattacatcctgacacaacaagccttggtggcagtggacaatgatgcccccatcaatggggatctcatcagcaacttcctttctgatccagtccatggagccattgaagtctgtgctcagttgagaccaactgttgacatttcagtgccaccagatgcagattttgtgcgcccagagttgcgtcagggtagcaattgagtcctggtgagtccttaatttttttgtttctagcccaaaaaataattccccctagggatattggaggtagagactttgcttagtcgtgtgagttgccgcttatttatttagtgtgctgggcgagtgttgcactatgtccggttttgttgaagaagacatgagaatatgcttctggtttttgaatttggtggaataatagtatgtttccgaggaatgcgctgacagaatacatcttgttttgatttt

SEQ ID NO: 936 - DNA, 2085 bp, Vaccinium corymbosum
ctgctgtgttcagtaccaatggctgctacctccttctctcccgccctggctccagctccttcttcatcaaaaacccttataccagcttccaaaacccttggaggtctcactctagggtttctctcttccaaaacagcctcgaagccactcaaagctcgagcctttcccctaaatgggtctggttcaagctccggttcagctcttcgagttcagatggtctctatgcccgcaattaaatcccccgacgatgatcgatttcgagacctctgtgttcaacaaagagaaaattactctcgcgggtcacgatgagtatattgtgagaggagggagggatttgttccctttgctaccggaagcgttcaagggtgttaagcaaattggagttattggctggggttcacagggccctgctcaagcacaaaatctgagggattctttgggagaggcaaaatcagacatcgtggtcaagattggtctcaggaagggttctcgttcctttgccgaggcacgggctgctggttttactgaagagaatggaaccctcggtgacatatgggagacaatatctggcagtgatctggtgctgctcttgatttctgatgcagcacaggctgataactatgagaaagtattctcacatatgaaaccaaacagcatttttggggctctcccatgggtttcttcttggccatttgcagtcactgggacttgatttccccaagaacatcagtgtgatagctgtatgtcccaagggaatgggtccgtctgttaggagactgtatgttcaagggaagcaaataaatggtgctggaatcaattcgagttttgcagtccaccaggatgttgatggtagagccactgatgttgcccttggatggtcagtcgcccttgggtctccgtttacatttgcgactacacttgagcaggaatacaagagtgacatatttggcgagagaggtattttattgggagcggtacacggaatcgttgagaccttgtttagaaggtttactgaaaatggaatcagtgaggatttagcttacaagaatactgttgagtgcattacgggggttatctcaagaaccatatcaactcagggtatgctggccttgtataactcgttgtctgaagatggcaaaaaggagtttgaggctgcatatagtgcttcttattatcccagtatggatatattgtacgagtgctatgaggatgtagccgccggtagcgagatcaggagtgttgtcttggctggtcgtcgcttttatgagaaggatggtttgccagctttcccaatgggtaaaattgatcagacacggatgtggaaagtaggtgaaagggttcgagcagtacgtccagaaggtgacttaggcccattgtatccctttactgctggtgtctatgtggcattgatgatggcccagattgaggttctgaggaagaaaggacattcctactctgagatcatcaatgaaagtgttattgaagctgtggactctttgaatcctttcatgcatgcccgtggagtatcattcatggttgataattgttccaccacagcaaggctagggtcaaggaagtgggccccgcgtttcgattacattctcacccagcaggccttggtggcagtggacaatggtgctcccattaacagagatctcgtcagcaacttcctgtctgatcctgtgcatggagcaatcgaggtatgtgctagcctgagacctactgtcgacatctctgtacccgctgatgccgactttgttcgcccagagttgcgcagcaactaagtgttgaagaagaacatatggctgagcccagctagtttccaaatgttgagagagaagtttctgtaataggagcaatttagttttgcctagtcctgatcccagtgtcatctacctctttgtatttgtgttttctgccgaattaagtacgacatcttgtgcacttgatatttgtattttgggtagtaatcttataataatgtgttggtgttgtttacaccaaatttggcacaaggtcctggacaggcctgggaggcttagatttaagatacaataggctggaattcgaaaaggcctagcgaag

SEQ ID NO: 937 - DNA, 1962 bp, Antirrhinum majus
  misc_feature (795)..(795): n is a, c, g, or t
  misc_feature (1500)..(1500): n is a, c, g, or t
  misc_feature (1540)..(1540): n is a, c, g, or t
atcgaattcggcacgagcgcacagctaaaagccacaccacaactcattcgatggcggcggcggcgcctacttccttctcgtccactatctcaaacaccacttccaaaaccctaaattcgcatcacgcaaaaaccctaattaatccactctcgttagggtttttatcatcctcatccccctcgctcaagccactccgagcagcggcgaatggctttcacaccgccgctaatgcatcgggatccgctctctccgctcgtatggtggccgcaaccgccgtcaaagctccggcgtttcaagatttcgacaccaatgtcttcaccaaggagaaaatcaacctctctggtcacgatgagtacattgtgaggggagggagaaatctgttcaagttgttgcccgacgcattcaagggtatcaagcagattggagtgattggttggggctcacagggacctgctcaagctcagaatttaagggattctcttgctgaaataaattctgatattgtggtgaagattggtttgaggaagggttctcgttcatttgctgaggcccgtgatgctgggtttacagaagaaaatgggaccttgggtgacatatgggaaactgtcgctggcagtgatttggtgctacttttgatatcagattcagctcaggctgataactatgagaaagtgttctcccacatgaaaccaaacagcatacttggactttcccatggatttctcttgggccatctgcagtcgataggtcttgactttcccaaaacattagtgtgattgccgtatgccccaaggnatgggaccttctgtcagaaggttatacgtgcaagggaaagagattaatggtgctggtataaatgcaagttttgcggtccaccaggatgttgatggtagagctacagatgtcgctcttggatggtcggttgcccttggttcaccttttacttttgccactacactggagcaggagtacaagagtgacatttttggggagcgaggcattctgctcggtgcggtgcatggtattgtggagtcattattcagaaggttcacagaaaatggaatgagtgaagatgatgcatacaagaacactgtggagagcattacgggaataatatctaagaccatatcaacaaagggtatgttggccgtctacaattctctaagtgaagagggcaaaagagacttcgaagctgcatatagtgcgtcatattatccatgcatggatattctatatgaatgctatgaagatgtcgccagcggaagtgagataaggagtgttgtcttggcggggcgtcgcttttatgaaaaagatggactacccgctttcccaatgggaaaaattgaccagacccggatgtggaaggttggtgagcgagttcgagcaactcgtccagcgggtgacttgggacctttgtatcctttcacagcaggtgtttttgttgcactgatgatggcccagattgaggttttgaggaagaaagggcattcgtactctganatcattaatgagagtgtaattgagtctgtggattcattanatccattcatgcacgcccgtggtgtctcttttatggtcgataactgctcaaccaccgctcgtttgggttcgagaaaatgggctccaagatcctgattatgtccttacccaacaagcacttgttgccgtggacaacaaaactccaatcaaccaagacctaattagcaacttcttgtctgattccatacacagtgcaattgcagtatgtgcccagttgagacctaccgttgacatctccgtgcctgttgatgccgactttgttcgtcctgagttgcgacaatcaggcaattgaagctatgatcatgtttcttgtttgctgagtttgaatggaacttagactttaatgtcttaagtgagctagatagcttgcttttgttgaacttgtttacattatgaattattccagttgtattagcggccgcg

SEQ ID NO: 938 - DNA, 2079 bp, Manihot esculenta
tatcacctcctacttcgccctatcccatcagctctaagcatttcttcagctcacagtcttctcaaactataaacaatggccgccgccgccgccaagttggcactctccgctccgtcactttcccctccatcatcatcgctcaagcccaatgcctcgcgatcctcgctaggatttgcatcctcatcttctccgtcgcttaaatctctggtttctcgtgtccataccagacaaattgcttcttcaagtggaagctcatcgctttctgttaaaatggtttccgttccttccatcgctcagacgtcgcttgatttcgacacctctgttttcaagaaagagaaagttactcttgctggtcacgatgagtatattgtgaggggagggagagacctgtttcccatgttgcctgatgctttcaaggggattaagcagattggagtaattggctggggatcccaggggccagcccaagctcaaaatttgagggattctcttgctgaagcaaaatctgacatcgtagtaaagattggactgaggaagggctcccgctcttttgctgaagctcgtgctgcagggttcactgaagagagtggaactcttggagacatatgggaaactattgctggcagtgatcttgtattgttattgatttctgatgcagcacaggcagataactatgaaaagattttctcccacatgaaaccaaacagcatcctcgggctttctcatggttttcttcttggacatttgcaatcctcggggcttcattttcctaagaacataagtgtcattgctgtttgccctaaggggatggggccttctgtacggagactctatgttcagggcaaagaaataaatggtgctggaattaattccagttttgctgtccaccaggatgttgatggtagagctacagatgttgccttaggctggtcagtggctttgggctctcctttcacatttgccaccacattggagcaggaatataggagtgatatttttggggagcgcggcatactacttggtgctgttcatggagtggttgaatgcttgttcagaaggtacactgaaaatggaatgaatgaagatttggcatacaagaatactgttgaatgcatcacaggaattatatcaaaaaccatctcaactaagggaatgttggccgtctacaactcgttgtcagaagagggaaaaagggattttgagactgcatatagtgcttcatactatccttgtatggatatcttatacgagtgttatgaagatgttgctagtggcagtgagattcgaagtgtggtgctggctggtcgtcgattctatgagaaggagggtcttccagcttttccaatgggtaagattgatcaaacacgaatgtggaaagtgggtgagcgtgttagagcaactaggccaaagggtgacttgggtcccttgtacccattcactgctggagtgtttgtggcactgatgatggctcagattgaggttttgaggaagaagggacattcatactcggaaatcatcaatgagagtgtgattgaagctgtggattccttgaatccattcatgcatgctcgaggtgtctcattcatggttgataactgttcaacaactgcgcgattaggatcaaggaaatgggcaccacgcttcgattacatccttactcaacaggcctttgttgcagtggatgcaggcgctccccttaatcaggaccttattagcaacttcctgtctgattctgttcatggggctattgaagtctgtgcccagttgagaccaactgttgacatttcagtgcctccagatgcagatttcgttcgcccagagttgcgccagtctggcaattagatgtgaagagatttagctttcccttgtgcactcacgaagactctgaattgggtagggattatctaagtgatcctttatcttcctgtctgaatagttcacctgagtaatgtttgctagcatactatgtgcccctttatttggacgcttgtttccttttattttgttagagttacgggaagtatttctctgttccattactagagagttaatgagaaatatatctatctttgttgctct

SEQ ID NO: 939 - DNA, 1933 bp, Tripterygium wilfordii
tccaaatccaaggccttaaaaggcccagccagtcttggtgccgtcagtttggggtcccttgcctcgagttccagggccttgaaaccactgagagcaagccgctgcattggagggggaaacggatcggctctcatggtgtctgtacctgcttccgtgaagccattgacttcgctggacttcgagacctctgtatttaagaaagagaaggtcaccctttccggtcatgacgagtacattgtgaggggagggagggatttattccctttgctgccagatgcattgaaggggattaagcagattggagttattggttggggttcccagggacctgctcaagcccagaacttaagggattctctcgctgaggctaagtccgaagttgttgtgaagattggactaagaaagggctctcgttcatttgctgaagctcgtgctgctggttttattgaagaaaatgggactttgggtgacatctgggaaactgtttctggcagtgatcttgtgttgctgttgatctctgatgctgcacaggctgataactatgaaaaaatattttcccacatgaagccgaatagcatacttgggctttctcatggatttcttcttgggcatttacagtcaataggactggatttcccgaagaatattagtgttatcgctgtgtgtcccaagggaatgggtccatctgtgaggaggctttacattcaaggcaaagagatcaatggtgcgggaatcaatgccagttttgctgtccaccaggatgtagatggtagagctacagatgttgccttggggtggtcggtggcccttggttctccttttacatttgcgactacactggagcaggagtacaagagtgacatctttggggagcggggcattttacttggtgctgttcatggaattgtggagtcattattcagaagattcactgaacatggaatgagtgaagaaacggcttacaagaacactgttgaatgcataacgggaaatatatcaaggaccatctcaactcagggcatgttggctgtttacaattccttgtcagaagaagggaagagggattttgagattgcgtacagtgcatcatattatccactcatggacatcttgtacgagtgctatgaagatgtagcttgtggtagtgagatccgcagtgttgtactagccgggcgccgcttttatgaaagggatggtcttccagcctttccaatggggaagatcgatcagacaagaatgtggaaagttggtgaacgagtcagatcagtacggccagcaggtgatctggggccattgcaccccttcacagctggagtctatgtggcgctaatgatggcccagattgagatcttaagaaagaaaggtcattcatattctgagatcatcaatgaaagtgtgatcgagtcggtggactctttgaatccttttatgcatgctcgtgggctttcttttatggtcgacaactgctcaacaacagcaagattgggatcgaggaaatgggctccacgcttcgattacatccttacccaacaagccatggtggctgtggacaatggtacccctgttaacggtgatctcattagcaacttcttatcagatcaggtgcatggagccattgaagtctgtgcccagttgagacctacagtggacatatcagttccccctgatgctgatttcgtgcgtcctgagttgcgtcaatccagcggttaaaggtcattaaaaacctttagcttgagctaatcatactatgctttaccatggagaatgtagttttcttgaatgccgtagcttacaaaactatgggtccagtttatccagttgtatttgtaacgtgacaaattgcgtgtcttttgctctgaagcccctctgtctttagttaagttggaaactgggaagtaaggttttgaaccatgaataatggcagtaatggtaa

SEQ ID NO: 940 - DNA, 2203 bp, Gossypium hirsutum
aaaacctaagtccagttcgaaaccgtctctcacaccagctttcgtctttcagcaatggccgccaccactacaaccacttcctttaaagccgcactcctttctacaccgtcgatatcttcatcgaccaaatcaaccgtcctcaaaacacgctttacatcatcatcgtcctcacggtattcgccgattccaaaatcactgatagctcatcatgtctctacaaagaccaacgccatcgtcgccaagatggggacagtcccttcgccagtttctgagacgacatcgcttgacttccatacctccgttttccagaaagaaaagatctctcttgctggtcacgaagagtacattgtgagaggaggacggcatttattccctttattggatgatgcttttaagggaatcaaacagattggtgttattggttggggttctcaggggccagctcaagcacagaatctgagggattctcttgcagaggcaaaatctgatgttgttgtgaagattgggttgaggaaaggctctcgctcctttgctgaagcccgtgctgcaggatttactgaagagaacggaactctgggggacatatgggaaactgttgctggaagtgatctcgtgttattgttgatctctgattctgcacaggcggataattatgaaaaggtcttctcccacatgaagccaaatagcatccttgggctttcccatggatttcttcttggccatttacaatcgttggggcttgattttcctaagaacatcagtgtaattgctgtctgcccgaagggaatgggaccttctgtgaggagactttatgttcagggaaaagagataaatggcgctggaattaatgctagttttgctgtccatcaggatgttgatggtagagctacagatgtggccttgggatggtcggttgcccttggttctccgtttacattcgccaccacattagagcaggaatacaaaagtgacatttttggggagagaggcatcttgctaggtgctgttcatggggttgttgaatgcttgtttagaaggtatgtggaggatggaatgagtgaagaattggcttacaaaaacaccgttgagtgcataacaggaattgtgtcaaagaccatttcaacaaagggtatgctagctgtatacaactcattgtccgaggaaggcaaaaagcgatttgaggtcgcttacagtgcctcatattatccttgcatggaaatcctatatgagtgttacgaagatgttgcaagtggaagcgagattcgcagtgttgttttggctgggcgtcggttttatgaaaaggagggtctacctgccttccctatgggtaaaattgatcagacacggatgtggaaagttggtgagcgtgtccgagcaactagagcgaaagatgatttaggtccactgtgccctttcacttctggggtttttgtggcgctaatgatggcacagatcgaggtcttgagaaagaagggccactcgtactcagaaatcatcaatgagagtttgattgaagctgttgattccttgaaccccttcatgcatgctcgaggagtttctttcatggttgataactgttccacaaccgcacgattgggatcaagaaaatgggctccacgttttgattacaaccttactcaacaagcattcgtagcagtggattcaggtgctcccatcaaccaggacctgataagcaacttcttatctgatcctgttcatgaagctatcgaagtctgtgcaaagctaagacctactgttgatatatcagtgcccccagatgcagattttgttcggcctgaattgcgccaatctagctagactggaagagaatattttctcatggacgaggctgttttgcagtaaatcttaatttagttttgctacatgtgaagaggaggataagtttttatggctgtcttagtttgtgtttggtttaagaggaggataagtttctatgacctgttagtttatgtttggtttaaaagaattatgtaaggtgaacttcttaagattcatgagttgcttatctgcaaatggtatggttggcctagcctgttcagtatttgattaattttatgaatttggtggctcagtaaaacttaatgccaaaatgcggtattggcagcctttgtgcgtaggtttagcaatacactgaataaaagaaaatcatgcttgtttgaaaaagaaaaaagtactgactgcg

SEQ ID NO: 941 - DNA, 1903 bp, Papaver somniferum
aacctcttcttattcgtgtttccaacaacaatgtctcatcatccgccgttggatcggctgttgcatcgaccatgagtgtttcagctcctaccaaacctttgactactcttgattttgaaacctctgtgtttaacaaggagaaggtcactcttgctggaaatgatgagtatattgttagaggaggaagggatttattccatttgttgcctgaagcattcaaaggaattaagcagattggtgttattggttggggttctcagggtcctgctcaagctcagaacttgagagactcacttgtagaagccaagtctgacattgtggtcaagattggtttgaggaagggatctgcttcttttgctgaagcacgttctgttggtttcactgaggagactggaactttgggtgatatatatgaaactgttgccgggagtgatcttgttttgttattgatttccgatgctgcacaggcagataattacgagaagatattctcccacatgaagcctaacagcattcttggactctcccatggatttcttctcggacatttgcagtcccagggggttgatttccccaaaaatatgagtgtgattgctgtctgccccaagggaatgggtccatcagtgagaagactctatgtccaaggaaaggagataaatggtgctggaattaatgctagttttgcagtccaccaggatgttgatggtagagcaacagatgttgccttaggatggtctgttgctcttggctctccttttacgtttgccactactcttgagtcagaatacaagagtgacatttttggagaaaggggtattttacttggagctgttcatggaatcgtcgaatccttgttcagaaggtacaccgaaaatggaatggccgaagaccttgcttacaagaacactgttgagtgcatcactggaattgtttcaaggaccatatccactgagggtatgttgtctgtgtacaactctctttcagagcaaggcaagaaggatttccatgcagcatacagtgcctcctattatccctgtatggacatcttgtatgagtgctatgaggatgtagcgagtgggaatgagatcaaaagtgttgtcttggctgggcgccgattttatgaaaaagaaggcctaccagcttttccaatgggaaagattgatcaaacaagaatgtggttggttggcgagaaagtccgagcaactcgaccagaaggtgacttgggtccactctatcctttcaccgctggagtttttgtggctttaatgatggctcagattgaggtattgagaaagaaggggcattcttactcggaaatcatcaatgaaagtgtgatcgaggcagtggattctttgaatcccttcatgcatgcacgtggagtttcattcatggttgataactgttccacaacagctcgattgggatcaaggaagtgggctccacgattcgattacattctcacccaacaggctttggtagcagtcgacaataacgcccccattaaccaggatcttgttagcaactttttgtctgaccctgtccatggggcaatcgaagtctgtgcccaattgagaccaactgttgacatatccgtgcccgtagatgcagattttgtcagggttgagcttcgtcagtcaagcaattagacttcgaaggagtcaaatcgaacatcaccaccatcctgtacatgtgttaatctgcctttcaagaaggctgggaaggcttcaatgttttagttgtctattcagagtggtgaggtataagttagtgaggtttgttgagagttgcagacgttagttccgtcttgttttccggtgaacggttctttcctttttgctagtagcatctaaataatactgcagttctatttattaatggacaactacttggtcgtaaaaaaaaa

SEQ ID NO: 942 - DNA, 2453 bp, Gossypium raimondii
ctcattttatttatttaatattttgttataccttataaaacatttatcatttttatttatttatcaagtttaaaaatattgtatcaaatattttttctatatttaatatttttatcatataaaatacttgtcatatttgtaacaaatagtgcagaaacaattttccatttaaattaaaatgaaaaagaaaaaaaacaccaacccatattatgcacttcgaaaaaaacaaaaacctcaccaaccatttcacccccttataaaaaagccaaagttggtgcttagcacataaacctaagtccagttcgaaaccgtctctcacaccagctttcgtctttcagcaatggccgccaccactacaaccacttcctttaaagccgcactcctttctacaccgtcgatatcttcatcgaccaaatcaaccgtcctcaaaacacgctttacatcatcatcgtcctcacggtattcgccgattccaaaatcactgatagctcatcatgtctctacaaggaccaacgccatcgtcgccaagatggggacagtcccttcgccagtgtctgagacgacatcgcttgacttccatacctccgttttccagaaagaaaagatctctcttgctggtcacgaagagtacattgtgagaggaggacggcatttgttccctttattggatgatgcttttaagggaatcaaacagattggtgttattggttggggttctcaggggccagctcaagcacagaatctgagggattctcttgtagaggcaaaatctgatattgttgtgaagattgggttgaggaaaggctctcgctcctttgctgaagcccgtgctgcaggatttactgaagagaacggaactctgggggacatatgggaaactgttgctggaagtgatctcgtgttattgttgatctctgattctgcacaggcggataattatgaaaaggtcttctcccacatgaagccaaatagcatccttgggctttcccatggatttcttcttggccatttacaatcgttggggcttgattttcctaagaacatcagtgtaattgctgtctgcccgaagggaatgggaccttctgtgaggagactttatgttcagggaaaagagataaatggcgctggaattaatgctagttttgctgtccatcaggatgttgatggtagagctacagatgtggccttgggatggtcggttgcccttggttctccttttacattcgccaccacattagagcaggaatacaaaagtgacatttttggggagagaggcatcttgctaggtgctgttcatggggttgttgaatgcttgtttagaaggtatgtggaggatggaatgagtgaagaattggcttacaaaaacaccgttgagtgcataacaggaattgtgtcaaagaccatttcaacaaagggtatgctagctgtatacaactcattgtccgaggaaggcaaaaagcgatttgaggtcgcttacagtgcctcatattatccttgcatggaaatcctatatgagtgttacgaagatgttgcaagtggaagcgagattcgcagtgttgttttggctgggcgtcggttttatgaaaaggagggcctacctgccttccctatgggtaaaattgatcagacacggatgtggaaagttggtgagcgtgtccgagcaactagagcgaaagatgatttaggtccactgtgccctttcacttctggggtttttgtggcgctaatgatggcacagatcgaggtcttgagaaagaagggccactcgtactcagaaatcatcaatgagagtttgattgaagctgttgattccttgaaccccttcatgcatgctcgaggagtttctttcatggttgataactgttccacaaccgcacgattgggatcaagaaaatgggctccacgttttgattacaaccttactcaacaagcattcgtagcagtggattcaggtgctcccatcaaccaggacctgataagcaacttcttatctgatcctgttcatgaagctatcgaagtctgtgcaaagctaagacctactgttgatatatcagtgcccccagatgcagattttgttcgtcctgaattgcgccaatatagttaagagtggaagagtattttctcatggacgaggctgttttgcagtaaaatcttaatttagttttgctacaagtgaagaggaggataagtttttatggctgtcttagtttgtgtttggtttaagaggaggataagtttctatgacctgttagtttatgtttatgtaaggcgaacttcttaaagattcatgagttgcttatctgcaaatggtatgcttggcctagcctgttcagtatttgattaattttatgaatttggtggctcagtaaaacttaatgccaaaatgcggtattggcagcctttgtgcgtaggtttagcaatacactgaataaaagaaaatcatgcttgtttga

SEQ ID NO: 943 - DNA, 2067 bp, Gossypium hirsutum
acataaacctaagtccagttcgaaaccgtctctcacaccagctttcgtctttcagcaatggccgccaccactacaaccacttcctttaaagccgcactcctttctacaccgtcgatatcttcatcgaccaaatcaaccgtcctcaaaacacgctttacatcatcatcgtcctcacgttattcgccgattccaaaatcactgatagctcatcatgtctctacaaggaccaacgccatcgtcgccaagatggggacagtcccttcggcagtgtctgagacgacatcgcttgacttccatacctccgttttccagaaagaaaagatctctcttgctgatcacgaagagtacattgtgagaggaggacggcatttgttccctttattggatgatgcttttaagggaatcaaacagattggtgttattggttggggttctcaggggccagctcaagcacagaatctgagggattctcttgtagaggcaaaatctgatattgttgtgaagattgggttgaggaaaggctctcgctcctttgctgaagcccgtgctgcaggatttactgaagagaacggaactctgggggacatatgggaaactgttgctggaagtgatctcgtgttattgttgatctctgattctgcacaggcggataattatgaaaaggtcttctcccacatgaagccaaatagcatccttgggctttcccatggatttcttcttggccatttacaatcgttggggcttgattttcctaagaacatcagtgtaattgctgtctgcccgaagggaatgggaccttctgtgaggagactttatgttcagggaaaagagataaatggcgctggaattaatgctagttttgctgtccatcaggatgttgatggtagagctacagatgtggccttgggatggtcggttgcccttggttctccttttacattcgccaccacattagagcaggaatacaaaagtgacatttttggggagagaggcatcttgctaggtgctgttcatggggttgttgaatgcttgtttagaaggtatgtggaggatggaatgagtgaagaattggcttacaaaaacaccgttgagtgcataacaggaattgtgtcaaagaccatttcaacaaagggtatgctagctgtatacaactcattgtccgaggaaggcaaaaagcgatttgaggtcgcttacagtgcctcatattatccttgcatggaaatcctatatgagtgttacgaagatgttgcaagtggaagcgagattcgcagtgttgttttggctgggcgtcggttttatgaaaaggagggcctacctgccttccctatgggtaaaattgatcagacacggatgtggaaagttggtgagcgtgtccgagcaactagagcgaaagatgatttaggtccactgtgccctttcacttctggggtttttgtggcgctaatgatggcacagatcgaggtcttgagaaagaagggccactcgtactcagaaatcatcaatgagagtttgattgaagctgttgattccttgaaccccttcatgcatgctcgaggagtttctttcatggttgataactgttccacaaccgcacgattgggatcaagaaaatgggctccacgttttgattacaaccttactcaacaagcattcgtagcagtggattcaggtgctcccatcaaccaggacctgataagcaacttcttatctgatcctgttcatgaatctatcgaagtctgtgcaaagctaagacctactgttgatatatcagtgcccccagatgcagattttgttcgtcctgaattgcgccaatatagttaagagtggaagagtgaatattttctcatggacgaggctgttttgcagtaaaatcttaatttagttttgctacaagtgaagaggaggataagtttttatggctgtcttagtttgtgtttggtttaagaggaggataagtttctatgactgttagtttatgtaaggcgaacttcttaaagattcatgagttgcttatctgcaaatggtatgcttggcctagcctgttcagtatttgattaattttatgaa

SEQ ID NO: 944 - DNA, 2124 bp, Nicotiana tabacum
  misc_feature (48)..(50): n is a, c, g, or t
  misc_feature (138)..(139): n is a, c, g, or t
  misc_feature (144)..(144): n is a, c, g, or t
  misc_feature (150)..(150): n is a, c, g, or t
  misc_feature (163)..(163): n is a, c, g, or t
  misc_feature (165)..(165): n is a, c, g, or t
  misc_feature (197)..(197): n is a, c, g, or t
  misc_feature (203)..(203): n is a, c, g, or t
  misc_feature (207)..(207): n is a, c, g, or t
  misc_feature (214)..(214): n is a, c, g, or t
  misc_feature (230)..(230): n is a, c, g, or t
  misc_feature (233)..(233): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (258)..(258): n is a, c, g, or t
  misc_feature (263)..(263): n is a, c, g, or t
  misc_feature (278)..(278): n is a, c, g, or t
  misc_feature (288)..(291): n is a, c, g, or t
  misc_feature (296)..(296): n is a, c, g, or t
  misc_feature (314)..(315): n is a, c, g, or t
  misc_feature (317)..(317): n is a, c, g, or t
  misc_feature (330)..(330): n is a, c, g, or t
  misc_feature (335)..(335): n is a, c, g, or t
  misc_feature (342)..(342): n is a, c, g, or t
  misc_feature (344)..(345): n is a, c, g, or t
  misc_feature (350)..(350): n is a, c, g, or t
  misc_feature (353)..(353): n is a, c, g, or t
  misc_feature (356)..(357): n is a, c, g, or t
  misc_feature (377)..(377): n is a, c, g, or t
  misc_feature (383)..(383): n is a, c, g, or t
  misc_feature (386)..(386): n is a, c, g, or t
  misc_feature (389)..(389): n is a, c, g, or t
  misc_feature (399)..(399): n is a, c, g, or t
  misc_feature (401)..(401): n is a, c, g, or t
  misc_feature (413)..(413): n is a, c, g, or t
  misc_feature (416)..(416): n is a, c, g, or t
  misc_feature (419)..(419): n is a, c, g, or t
  misc_feature (480)..(480): n is a, c, g, or t
  misc_feature (551)..(551): n is a, c, g, or t
  misc_feature (842)..(842): n is a, c, g, or t
  misc_feature (881)..(881): n is a, c, g, or t
  misc_feature (1188)..(1188): n is a, c, g, or t
  misc_feature (1220)..(1220): n is a, c, g, or t
  misc_feature (1238)..(1238): n is a, c, g, or t
  misc_feature (1243)..(1243): n is a, c, g, or t
cgctgcttctctaatcagaagatatatgcggcatatctgaaccctagnnntacaaaaatctaaacatctctctctctctctctcttttaacagacttcggcagctcacagagcagcaatggcggcggcggcggcggcnncggcnacttcnttctccatctccncntccacttctctccgtcatccaaatccctaaancctgcncttnccggtancttagggttcctttcntcntcgncnccntcgcttaagcctctcngagcnaaatctgccgtttcntgtaatggcnnnngctcnagctccggcgcggctctnnangctcgcatggtcnctgcncctgctncnntcaangcnccnntttctctcgattttgaaacntccgtnttnaanaaggagaaantnacccttgctggncangangagtacattgtgagaggagggagagatttgttcaagtatttgccggatgctttcaaaggantcaagcagattggagtcatcggctggggttctcagggacctgctcaagcccagaacttgagggattctctngctgaagcaaaatcagatatagtcgttaagattggtttaagaaagggttcaagctcctttgcagaggcccgtgcagctgggttttctgaagagaatgggacccttggtgacatatatgagaccatctctggcagtgatctcgtgctgcttttgatttctgatgctgctcaggctgataattatgagcaagtgttttctcacatgaagccaaatagcatacttgggctttcacatggattcctccttggccatttgcagtcaatgggccttgacttcccgaagaacattagngtgattgctgtatgtcccaagggaatgggtccttcagtnaggagattatatgttcaaggaaaagaaatcaatggtgctggaattaatgcaagttttgcagttcaccaggatattgatggaagggccacagatgttgctcttggatggtctgttgcccttggttctccctttacttttgctactactctagaacaggaatataaaagtgacatttttggagaacgaggtattttacttggtgctgtccatggagttgttgagtcacttttcagaaggttcactgagaatggaatgaacgatgagcttgcatacaagaatactgtagagtgcataacaggaattattncaaagaccatatcaacaaagggcatgttggcngtgtacaactcattgacngaggngggcaagaaggagtttgaggctgcatacagtgcttcatattacccctgcatggagatattgtatgagtgctatgaagatgtagctacaggtagtgagatcaggagtgttgtcttggctggccgtcgcttttatgaaaaggagggcttaccagctttcccaatggggaaaattgaccaaacaaggatgtggaaggttggtgagcgcgttcgagcaaaacgaccagctggtgatcttggtcctatgtatcctttcactgctggtgtcttcgtggcattgatgatggcccagattgagattctgaggaagaaaggccactcttactcagagatcataaatgaaagtgtcatcgagtctgtagattctctcaatccgtttatgcatgctcgtggagtgtcattcatggttgacaattgctctacaacagcgcgtttaggatccaggaagtgggcccctcgatttgattacattctcacccagcaagcacttgttgcggtggacaataatgctactatcaatggggatcttatcagcaacttcctatcagatccgatacacggagctattgaagtgtgtgctcaactgagacccaccgttgatatttctgtcacagcagatgctgattttgtccgccctgagctcaggcaataagggctttgtacgccaccttgcgagggagggagaattttgcgaaatagtaaggtggagacgttgtattagtgatgtgtgctgctatggaagcaagaatacttgctcaaatctcttagtttataagaatgttagcccttttggtttcttagttatgcgagcactagcactttcttttaaatgtagcctttgctgagtaactggataaataaatttgaaatttggggaacctttc

SEQ ID NO: 945 - DNA, 1934 bp, Vaccinium corymbosum
tcaccactgggcgccagttgaacggctctacaaccagcgtagccggtccaaccgccatcatctcttcatttcttaatcacctttattggtgcaaacaacccacttatttactaccaccacttgctaccgttctcgtcatccccactcctcaatctctttaccaccaccatctccattacaatcaacactttccccgacgatgatcgatttcgagacctctgtgttcaacaaagagaaaattactctcgcgggtcacgatgagtatattgtgagaggagggagggatttgttccctttgctaccggaagcgttcaagggtgttaagcaaattggagttattggctggggttcacagggccctgctcaagcacaaaatctgagggattctttgggagaggcaaaatcagacatcgtggtcaagattggtctcaggaagggttctcgttcctttgccgaggcacgggctgctggttttactgaagagaatggaaccctcggtgacatatgggagacaatatctggcagtgatctggtgcttctcttgatttctgatgcagcacaggctgataactacgagaaagtattctcacatatgaaaccaaacagcattttggggctctcccatgggtttcttcttggccatttgcagtcagtgggacttgatttccccaagaacatcagtgtgatagctgtatgtcccaagggaatgggtccgtctgttaggagactgtatgttcaagggaagcaaataaatggtgctggaatcaattcgagttttgcagtccaccaggatgttgatggtagagccactgatgttgcccttggatggtcagtcgcccttgggtccccgtttacatttgccactacacttgagcaggaatacaagagtgacatatttggcgagagaggtattttattgggagcggtacacggaattgttgagaccttgtttagaaggtttactgaaaatggaatgagtgaagatttggcttacaagaatactgttgagtgcattacgggggttatctcgagaaccatatcaactcagggtatgctggccttgtataactcgttgtctgaagatggcaaaaaggagtttgaggctgcatatagtgcttcttattatcccagtatggatatattgtacgagtgctatgaggatgtagccgccggtagcgagatcaggagtgttgtcttggctgggcgtcggttttatgagaaggatggtttgccagctttcccaatgggtaaaattgatcagacacggatgtggaaagtaggtgaaagggttcgagcagtacgtccagcaggtgacttaggcccattgtatccctttacagctggtgtctatgtggcattgatgatggcccagattgaggttctgaggaagaaaggacattcctactctgagatcatcaacgaaagtgttattgaagctgtggactctttgaatcctttcatgcatgcccgtggagtatcattcatggttgataattgttccaccacagcaaggctagggtcaaggaagtgggccccgcgtttcgattacgttctcacccagcaggccttggtggcagtggacaatggtgctccctttaacagagatctcatcagcaacttcctgtctgatcctgtgcatggagcaatcgaggtatgtgctagcctgagacctactgtcgacatctctgtacccgctgatgctgactttgttcgcccagagttgcgcagcaactaagtgtcgaaggagaacatatgtctgagcccagctagttcccaaatgtggagagagaagtttctgtaattggagcaattagttttgcctagtcctgatcccagtgtgatctacctctttgtatttgtgttttctgccgaattaagtaagacatctcgtgcacttgatatttatattttgggtagtaatcttataataatgt

SEQ ID NO: 946 - DNA, 1417 bp, Trigonella foenum-graecum
tttcatttcttcttcaactccaagcattttcccattcgccaatcgccaccttacccttatcttcttccgatggccaccgtcctccgaactcccactttccggccatcaccaccccttctgaccacctctgccacctcttccaatcatcccaaaacctcacgcgtttccatcgcatcctccaggagaaaaccttcaccacttaaataccaccggttcgcttcatttcggtccctcaggttcgtcaagttagtaccttttgcttttgacggagataccgaggcgccgcaagttcaagaatcaccagaggttcaggttctggactcttcagatggtgctgttggtgtggaggatagtacacgtgatgatgagttcagcgatgctggtgaaatacctgcttcacctctgatagtattacttcagtcatacaaagaagcattagctaataacgatgaagtcaaagttgctgagttggaatcatcattaaaatccattgatgatgagatagtaggtcttgaagggaaaatagcttccttatctgaagagttatcaattgaaaaagatcggaaactaaggattggtgcagactttgacaattatcgtaagagaactgatagagatcgcctctcactggtcacaaatgctcagggggaagttgtggagagtttgttgcctgtattggataattttgagagagctaaagctcagattaaggtggagacagagggagaggagaaaataaacaacagctatcagagcatatataagcagttcattgaaattcttaactcacttggagttgaacctgtggagacggttggaaaaccctttgatccaatgctacatgaagcaattatgcgtgaggattctgatgaatttgaagatggcatcatacttcaagaattcagaaagggttttaaactcggtgaccgcctcttacgtccatcaatggtgaaggtatcagctggtccaggacctgcaaagtcggaacaagaagtacaacaggaagaacaagtgacaaatgaaatttcccaggacagtaaagagactgatggcaacacagaaacagagtctgcttgaaaggacaaaactttgcctggattcagttttgtacaagtatatctatcagtttaatctccaggaacgtaattatgggtgttacaggtgctcaagaattattcctgctaagtttccttttaaggggaatttagtattatgagattttgaattatgattttagatttttatgcccttgcatggctatggtagagatgactaaattttctcaggtaccatgtttctgaaaggacccgagtgagttgcaattgatcaagtgcttggcacctggagttaggagaatcagtgtgtacttttaaattaagattatattataatctcataatttcttcatcacagcgca

SEQ ID NO: 947 - DNA, 1464 bp, Trifolium pratense
  misc_feature (945)..(945): n is a, c, g, or t
caaccttcaccttatctctctctccttcactcctcactctttcctccgatggccaccgtcctccaaactcccacattccggccatccctaaccctcctcaccaccaccaccgccgccacatcatccaatcaccccaaaacctctagggtttctatcacatcctccagaaggaaactatcgtcacttaaatccctccggttccattcaattccctccctccggttcgttaagttaataccttttgcttttgacggagataccgaggctcctcaagttcaagaacaacctgaagttcaggttctggattcttcagatggtgctgttgctgtggaggatagtacaggtgatgatgagttcagcgacgctgttgaaataccttcttcacctttgctagtattactgcagtcttacaaagaagcattagttaataatgatgaagtcaaagttgccgagttggaatcatcattaaaatccattgatgacgagatagcaggtctcgaagggaaaatagcttctttatccgaagaattatcaatagagaaagatcggaaactaaggattggtgcagactttgacaattatcggaagaggaccgatagagatcgcctttcgttggtcacaaatgctcagggggaagttgtggagagtttgttgcctgtattggataattttgagagagctaaagctcagattaaggtggaaacagagggagaggagaaaataaacaatagctatcagagcatatacaagcagttcattgaaattctaaactcactaggagttgagccagtggagacggttggaagcccctttgatccaatgctacatgaagcaattatgcgtgaggattctgatgagtttgaagaaggcatcatacttcaagaattcagaaaaggttttaaacttggtgaccgcctcttacgcccatcaatggtgaaggtatcngctggtccaggaccagcaaagccagaacaagcatcacaggaagaacaagtcacaaatgaaatttccgaggacggtaaagagattgatggtagcacagaaacagagtctgcttgaatggacaaaactctgcctggactcagttttgtacaagtacatcagtttaatctccaggaacaagaaattttcctgccaagtttccttcctcgagggaaattaatattatgagattttgaattattttttcagatatttatgtccttacatggctttggtagagatgactaaatattcagagataccatatttcttgaaggaccctgagtaagttgcaattgatcaagtgcttggaatctggagttaggagaatcagtgtgaacttttaaattaagattttattatactcataatttcttcatcgtattgaacatgtattctttggttaagctagaactagaagcaattctacgtgttgtacaccaatggtttttaagataatttctgaaagtttttcccctctgc

SEQ ID NO: 948 - DNA, 3270 bp, Glycine max
gtatacaagaaatcatagccagctaattccatttcaaccgacacgccactacccttccttctgatctctcaaatctatttccattccattccttcggtgagagcaaaatcacccttcttgaaacagattttagcaccaaacaaaaacactctatagagggtgaagattttttagaacagaataagaattaatatggcccttacaaaacaaataatgggttcttcattgctagagaggtccatgtttgttccttcttcttcttccccttcatcattttttaactcaactcggttcttagttcctttggagaacaagagagttgtgaggatgaagagagctgcaaagtttcctgtggcagctataagtgaggatttgatgaagggttcttcttcttctccttcatcatcttcatcctcttcttctgtgtctacagaaaaaccagtgaaattcaaagttagagctgtgatcacagtgaggaacaagatcaaagaggatttcaaagagaccattgtgaagcatattgatgctcttactgacaggattggaaggaatgttgtccttgaacttgttagcactgagattgatccaaagaccaaatctgcaaagaagagtaatgaagcagtgttgaaggattggtcaaagaagtccaatcttaaggcagagagagttaattacacggctgaattcatagttgactctagttttggggagccaggagctattactgtgacaaacaaacaccagaaagagttcttcttggaaagcataacaattgaaggatttgctagtggaccggttcatttcccctgcaattcatgggtacaatcaagaaaagatcttcctggaaagaggattttcttttccaataagccttatttacccggggatacacctgctggacttagattattgagggagaaagagctgagaaatcttagaggtgatggcaaaggagttagaaacttatctgacagaatatatgactatgatatatacaatgatttggggaatccagataaaggaattgaacttgccagaccaaatcttggaggatcagatatgtatccatacccaagacggtgtcgtactggccgcgaaccaagtgatacagatatgtacgcagagagtcgtgtggagaagccactgcctatgtatgtgccaagagatgaacgtttcgaggagtctaagcagaacacattcactgtgaagaggctcaaggcagtgctgcataacttgatcccaggtcttaaggctagcctttcttctagcaaccaagacttcaatgaattctctgatgtcgatggcctttacagtgaagggttgctcataaagttggggtggggcttgcaagatgacgtgttgaagaaaatcccatttgtcagcaagatccaagagtccagccagggacttcttaagtatgacacccctaagattatttccaaggacaaatttgcttggctgcgagatgatgaatttgcccgtcaagcaatagcaggagttaaccctgttaacattgagaggcttcaagttttcccaccagttagcaaactagacccagaaatttatggcccccaagagtctgctcttaaagaagaacatattttgaaccaactcaatggcatgaccgttcaagaggcaataaacgaaaacaagctgtttatgattgattatcatgatatatatctacctttcttagaagggatcaatgcccttgatggtaggaaatcatatgccacacgcaccatctttttcttgactccacgtagcactctcaagcctgtggctatagaacttagcctccctcacgctggacctaattcccgatcaaagcgcgtggttacacctcctgttgatgctactactaattggatgtggcagcttgccaaggcccatgtttgctccaatgatgctggggtgcaccaacttgttaaccattggctacgcacacatgccaacttggaaccatttatattggcggctcataggcaattaagtgctatgcatccaattttcaagttgttggacccccacatgaggtacaccttggagataaataccttggctagacagagtttgatccatgctgatggaatcattgaaaattgcttcactcctggtcgctatgccatggagattagttctgctgcttacaagaacttttggcgctttgacatggatagcctccctgcagatcttatccgcaggggaatggcagtagctgacccaacacaaccacatggcctaaaactcatattggaagactacccttatgcagctgatggaatactaatatggtctgcaatagaagactgggttcgaacctatgtgaaccattactaccctcactcaagccttatatgcaatgacaaagagctacaatcttggtactctgagtcaatcaatgtaggccatgcggatcttaggcacgaaaattggtggccaacattgaacaatagtgaggatcttgtgtccattctttccacattgatttggaatgcatctgcacaacatgctgctctcaactttggtcagtacccttatggtggctatgtgcctaatcgtccaccactgatgagaaggctaataccagaagagggtgatccagaatatgcaagtttcattgctgaccctcagaagtatttcctgaatgcattgccaagcttgcttcaggccacaaagttcatggctgtggttgacacactctctactcactcacctgatgaggagtacttgggtgagaggcaacaaccttccatttggtctggcgacgctgagattgtagaggcgttctacgatttctccgccaaggttcaacagatagagaaggtgattgatggcaggaaccttgataggactctaaggaaccgttgcggtgcaggggtgttgccttatgagttgcttgctcctagctctgaacctggtgttacatgcagaggggtgcctaatagtgtgtccacataactatactaaactaataaataagggagtcactcccacattttgataattaaacattaatatatatatatatatatatatatatatatatatatatatatatatatatggttggcttactagttactaccataccatggacagtgactctcagtgtatgcccattttgtacctagatttaataagttgttatagtatatattggtaacctagggctgtatagactgtgtatatgaaaatgagtttggtggtgttggaggatgtgtgactgtttataaagttattatcacaatttgtagttttcttttgcac

SEQ ID NO: 949 - DNA, 3178 bp, Glycine max
aaccgacacgccactacccttctctcacaaatctatttccattccattccctcagagagagcaagatcacccttctatagagagaaaacacacacacacacacacaaaacaaaactcttaaagagggtgaagattttttggaacagaataagagtatggcccttacaaaacaaatcttgggttcttcattgctagagaggtccatgtttgttccttcttcttccccttcatcacttctcaaccaaactcggttcttagttcctttggagaacaagagagttgtgagggtgaagagagctgcaaagtttcctgtggcagctataagtgaggatttgatgaagggttcttcttcttctccttcatcatcatcatcttcatcctcttcttcttcttcttcttctgtgtccacagaaaaaccagtgaaattcaaggttagagctgtgatcacagtgaggaacaagatcaaagaggatttcaaagagaccatcgtgaagcatattgatgctcttactgacaggattggaaggaatgttgtccttgaacttgttagcactgagattgatccaaagaccaaatctgcaaagaaaagtaatgaagcagtgctgaaggattggtcaaagaagtccaatcttaaggcagagagagttaattacacggctgaattcataattgactctagttttggggagccaggagctattactgtgacaaacaaacaccagaaagagttcttcttggatagcataaccattgaaggatttgcaagtggaccagttcatttcccctgcaattcatgggtacaatcaagaaaagatcttcctggaaagaggattttcttttccaataagccatatttacccggggatacacctgctgggcttagattattgagggagaaagagctgagaaatctcagaggtgatggcaaaggagttagaaacttatctgacagaatatatgactatgatatatacaatgatttgggaaatccagataaaggaattgaacttgccaggccaaatcttggaggatcagatatgtatccatacccaagacggtgtcgtactggccgcgaaccaagtgatacagatatgtacgcagagagtcgtgtggagaagccattgcctatgtatgtgccaagagatgaacgttttgaggagtctaagcagaacacattcactgtgaagaggctcaaggcagtgctgcataacttgatcccaggtcttaaggctagcctttcttctagcaaccaagacttcaatgaattctcagatgttgatggcctttacagtgaagggttgctcataaagttggggtgggggttgcaagatgacgtgttgaagaaaattccatttgtcagcaaaatccaagagtccagccagggtcttcttaagtatgacactcctaagatcatttccaaggacaaatttgcgtggttgcgagatgacgaatttgcccgccaagcaatagcaggagttaaccctgttaacattgagaagcttcaagttttcccaccagttagcaaactagacccagaaatttatggcccccaagagtctgctcttaaagaagaacatattttgaatcaactcaatggcatgactgtccaagaggcaataaacgaaaataagctgtttatgattgattatcatgatatatatctacctttcttagaagggatcaatgcccttgatggtaggaaatcatatgccacacgcaccatctttttcttgacaccacgtggcactctcaagcctgtggctatagaacttagcctccctcatgctggacctaattcccggtcaaagcgcgtggttacacctcctgttgatgctactactaattggatgtggcagcttgccaaggcccatgtttgctccaatgatgctggggtgcaccaacttgttaaccattggttacgtacacatgccaacttggaaccatttatattggcggctcataggcaattaagtgctatgcatccaattttcaagttgttggacccccacatgaggtacaccttggagatcaatgccttggctagacagagtttgatcaatgctgatggaatcattgaaaattgctttactcctggtcgctatgccatggagattagttctgctgcctacaagaacttttggcgctttgacatggatagcctccctgcagatctcatccgcaggggaatggccgtacctgacccaacacagccacatggtctaaagctcatattggaagactacccttatgcagctgatggaatactaatctggtctgcaatagaagactgggttcgaacctatgtgaaccattactaccctcactcaagccttatatgcaatgacaaagagttacaatcttggtactctgagtcaatcaatgtaggccatgctgatctcaggcatgaaagttggtggccaacattgaacaatagtgaggatcttgtgtccattctttccacattgatttggaatgcatctgcacaacatgctgctctcaactttggccagtacccttatggtggctatgtgcctaatcgtccaccactgatgagaaggttaataccagaagagggtgatccagaatatgcaagtttccatgctgaccctcagaagtattttctgaatgcattgcctagcttgctgcaagccacaaagttcatggctgtggttgacacactctccactcactcacctgatgaggagtacttgggggagaggcaacaaccttcaatttggtctggagacgccgagatcgtcgaggcgttctacgatttctccgccaaggttcgacagatagagaaggtcattgatagcaggaaccttgatcggactctaaggaaccgttgtggtgcaggggtgttgccatatgagttgcttgctcctagctctgaacctggcgttacatgcagaggggtgcccaatagtgtgtccacataactatactaaactaataaataagggagtcactcccacattttgatacgcattaatatatatgtaatggttggcttactatttactaccatggacagtgactctcagtggatgcccattttgtacctagatttaataagttgttatagtatatattggtaacctagggctgtatagactgtatatgaaaatgagtttggtggggttggaggatgtgtgactgtttataaagttattatcac

SEQ ID NO: 950 - DNA, 3198 bp, Phaseolus coccineus
gtataaaagaaatcatagccagctatttccatttcaaccgacacgccactacccttctctcacaagtctgtttcagttcttgcaaagagagcaaaatcacccttgtggagagagaacacacaccaacaagaaaaaaaactccaaagagggtgaagaattagaacaaacatgacccttacaaaacaaatcatgggttcttcattgctagagaggtccttgtttgttccctcttccccttcatcacttctcaaccaaactcgctttttagttcctttggagagcaagagagttgtgagggtgaggaaggctgcaaagtttcctgtggcagctataagtgaggatttggtgaagagctcttcttcttcttcttcaccatcatcttcttccacttcttctgtgtctgcagagaagccagtgaaattcaaggttagagctgtgatcacagtgaggaacaagatcaaagaagatttcaaagagaccattgtcaagcatattgatgctctaactgacaggattggaaggaatgttgtctttgaacttgttagcactgagattgatccaaagaccaaagctgcaaagaagagtaatgaagcagtgctgaaggattggtcaaagaaatccaatcttaaggtagagagagttaattacacagctgaattcatagttgactctaactttggagagccaggagctattactgtgacaaacaaacaccagaaagagttattcttggaaagcataaccattgaaggatttgccaatggaccagttcatttcccctgcaattcttgggtacaagcaagaaaagatcatcctggaaagaggatttttttttccaacaagccttatttacctggtgatacgcctgctgggcttagattattgagggagaaagagctgaaaaatctcagaggtgatggcaaaggagtgagaaacttatctgacagaatatatgattatgatatatacaatgatttgggaaatccagataaaggaattgaatatgccagacaaaatcttggaggatcagatatgtatccatacccaagaaggtgtcgtacaggccgtgaacccagcgacacagatatgtatgcagagagtcgtgtggagaagccactgcctatgtatgtgccaagagatgaacgttttgaggagtcgaagcagaacacatttactgtgaagaggctgaaggcagtgctgcataacttgatccctggtcttaaggctagtctttctgctagcaaccaagacttcaatgaattctcagatgtcgatggcctttacagtgaagggttgctcataaagttggggttgcaagatgacatgttgaaaaaaatcccttttgtcagcaagatccaagagtccagccagggacttcttaaatatgacacccctaagattatttccaaggacaaatttgcatggttgcgagatgacgaatttgcccgtcaagcaattgcaggagttaaccctgttagcattgagaagcttaaagtttttccaccagttagcaaactagaccctcaaatttatggcccccaagagtctgctctgaaagaagaacatattttgactcaactcaatggcatgacagtccaagaggcaataaatgaaaacaagctgtttattgttgactatcatgatatctaccttcctttcctagaagggatcaacgcacttgatggtaggaaatcatatgccacacgcaccatctttttctccacaccacgtggtactctcaagcctgtggccatagaactcagccttccttttgctggacctagttctagatcaaagcgtgtggttacacctcctgttgatgcaactactaactggatgtggatgcttgcaaaggcacatgtttgctccaatgatgctggggtgcaccaacttgttaaccactggttacgcacacatgcaaacttggaaccatttatattggcagctcataggcaattgagtgccatgcatccaatttacaagttattggatccccacatgaggtatactttggagatcaatgccttggctagacagagtttaatcaatgctgatggaatcatagaaaattgcttcactcctggtcgttatgccatggagattagctctgctgcttacaagaacttttggcgctttgacatggatagccttcctgcagatctcatacgcaggggaatggcagtacctgacccaacacaaccacatggtctaaagctcacattggaagactacccttatgcagctgatggaatacttatctggtccgccatagaagactgggttcgcacctatgtgaaccactattaccctcattcaagcctcatatgcaacgacaaagagctacaagcttggtactccgagtcaatcaatgtgggtcatgctgatcttaggcatgaaagttggtggcctacattgaacaatagtgaggatcttgtctccatcctttccatattgatttggaatgcatctgcacaacatgctgctcttaactttggccaatacccttatggtggctatgtgcctaatcgtccaccacttaccagaagattaatacctgaagagggtgatccagaatatgcaagtttccttgctgacccccaaaaatactatctgaatgcattgcctagcttgttgcaggccacaaagtttatggctgtggttgacacactctccactcactcacctgatgaggagtacttaggggacaggcaacaaccttcgatttggtctggtgatgctgagatcattgaggcgttttatgatttctctgcaaagattagacagatagagaaggtgattgatagcaggaaccttgataagactctaaggaaccgttgtggtgcaggggtgttgccttatgagttacttgctcctagctctgaatctggtgttacatgcagaggggtacctaatagtgtgtctacataaccatcctaaactagtaaataagggactcacttcccacattttgataagcatttatatatggttgccttactacttactacttagtaccaactactatggtcagtgactgaatggatgcccattttgtacctacatttaataaattgttgtagtatatatatattatattgtaacctaggactgtatagtctgtatatcaaaatgagttcggtggtgttggaggatgtgtcactgtctataaaattattatcaccatttctagacttctac

SEQ ID NO: 951 - DNA, 3477 bp, Cajanus cajan
aaagagggtgaggctgattcataacaagttatggcccttactaaacaaatcatgggttcttcattgctagagaggtccttctttgttccttctacctcttcatcttttcagctcaaccaaacccgcttcttagttcctttggacaaggaaaaagttttgagggtgaggaaggatgcaaagtttcctgtggcagctataagtgaggatttggtgaagggttcttcttcttctcctccttctccttcatctgcttcctctacttctcttgtgtcaactgagaagccagtgaaattcaaggtcagagctgtgatcacagtgaggaacaagatcaaagaggatttcaaagagaccattgtgaagcatattgatgccataactgacaggattggaagaaatgttgtccttgaacttgttagcactgagattgatccaaagaccaaagctgcaaagaagagcagtgaagctgttttgaaggattgggccaagaagtccaatgttaaggctgagagagttaattacactgctgaattcatagttgactctagttttggggaaccaggggctattactgtgacaaacaaacaccagaaagagttcttcttggaaagcataaccattgaaggatttgctagtggacctgttcatttcccctgcaactcatgggtacaagccagaaaagatcatccaggaaagaggattttcttttccaataagccttatttacccggagatacacctgctgggcttagattgttgagggagaaagagctgagaaatctcagaggtgatggcaaaggagttagaaagttatctgacagagtatatgactatgacatatacaatgatttgggaaatccagataaaggaattgatctagctagaccaaatcttggaggatcagatatgtatccttacccaagacggtgtcgtactggccgtgaaccatctgatacagatatgtatgctgagagtcgtgtggagaagccactgcctatgtatgtgccaagagatgaacgttttgaggagtctaagcagaacacattctctgtgaaaaggctgaaggcagtgttgcataacttgatcccaggtcttaaggctagtctttctgctaacaaccaagacttcaatgaattcaaagatgttgatggactttacagtgaagggttgctcataaagttggggttgcaagatgacatgttgaagaaaattccttttgtcagcaagatccaagaatctagccagggacttcttaagtatgacactcctaagattatttccaaggacaaatttgcgtggctgcgagatgacgaatttgcccgtcaaacaattgcaggagtgaaccctgtcaacattgagagccttaaagttttcccacctgttagcaaactagaccccgaaatttatggtccccctgagtctgctcttaaagaagaacacattttaagtcaactcaatggcatgactgtccaagaggcaatagacgaaaataagctgtttatcattgattatcatgatatttaccttcctttcctagaagggatcaatgcccttgatggtagaaaatcatatgcgacacgcaccatttttttctcgacaccccgtggcgctctcaagcctgtggctatagaacttagcttacctcctgctggacctagttcgcgttcaaagcgcgtggttacacctcctgttgatgcaactactaattggatgtggcagcttgccaaagcccatgtttgctccaatgatgccggggtacaccaacttgttaatcattggttacgcacacatgcctgcatggaaccatttatattggctgctcataggcaattgagtgctatgcatccaattttcaagctattggaccctcacatgaggtacacgttggagatcaatgccttggctagacagggtttgatcaatgctgatggaatcattgaaaattgcttcactcctggtcgctacgccatggagattagttctgctgcttacaaaaacatttggcgctttgacatggatagcctccctgcagatctcatccgcaggggaatggctgtacctgactcaacacagccacatggtctaaagctaatattggaagactacccctatgcagctgatggaatactaatttggtctgccatagaagactgggttcgtacctatgtgaaccattactaccctcactcaagcctgatatgcaatgacaaagagttacaatcatggtactctgagtcaatcaacgtaggccatgctgatcttaggcatgaaagttggtggcccacattgaacaacagtgaggatcttgtttccattctttccatcttgatttggaatgcatctgcacaacatgctgctcttaactttggtcagtacccttatgggggctatgtgccaaaccgtccaccactaatgaggaggctaatacctgaagagagtgatccagaatatgcaagtttccttgctgaccctcaaaagtattttctgaatgcattgcctagcttgttgcaagccacaaagtatatggctgtggttgacacactctccactcactcacctgatgaggagtacttgggggagaggcaacaaccttctatttggtctggtgatgctgagatcattgaggccttctatgatttctctgcaaagattaggcagatagagaaggtgattgatggcaggaaccttgacaggaatctaaggaaccgttgtggtgcaggggtgttgccttatgagttacttgctcctagctctgaacctggtgtcacatgcagaggggtacccaatagtgtgtccacataactatcctaaactagtaaataagggagttatttcccacattttgataagcattaatatatatggtaagcttactagttactactatatggacagtgactcagtggatgccattttgtacttagatttgataaattattatagtatatattggtaacctagggatgtatagactgtaagtatatcaaaatgagtttggtggggttggaggatgtgtgactgtttataaaattattatcaccaattgtagttttcttttgcactgttgtgtagttttctttgttgcaactatagcagattttattatgaaatgaagtttttaacttgaacgttatatggatttcaattgcttccaaagagatatagccaggagaataattaattcaaaatagtaaatacatttctggtgcagcatgggaatcctgtcgagagatgcaacttgggtttgtcgagctaaatcagtattgatgtgacttctactaagccatgaatcctcaagtaactgatgagtttctcaaggcgtcttcaatgggaagagtatccctggtttatgcctcttctattttcagaatcaaattaataataaaacaccatgtgtaataaagatgcacaaagtttgttttaagtgaatctaaacatgcaccgagttttatctctgaataaagtttgtttcgtgtatct

SEQ ID NO: 952 - DNA, 3078 bp, Cajanus cajan
ggggatgggttcttcattgctagagaggtccttctttgttccttctacctcttcatcttttcagctcaaccaaacccgcttcttagttcctttggacaaggaaaaagttttgagggtgaggaaggatgcaaagtttcctgtggcagctataagtgaggatttggtgaagggttcttcttcttctcctccttctccttcatctgcttcctctacttctcttgtgtcaactgagaagccagtgaaattcaaggtcagagctgtgatcacagtgaggaacaagatcaaagaggatttcaaagagaccattgtgaagcatattgatgccataactgacaggattggaagaaatgttgtccttgaacttgttagcactgagattgatccaaagaccaaagctgcaaagaagagcagtgaagctgttttgaaggattgggccaagaagtccaatgttaaggctgagagagttaattacactgctgaattcatagttgactctagttttggggaaccaggggctattactgtgacaaacaaacaccagaaagagttcttcttggaaagcataaccattgaaggatttgctagtggacctgttcatttcccctgcaactcatgggtacaagccagaaaagatcatccaggaaagaggattttcttttccaataagccttatttacccggagatacacctgctgggcttagattgttgagggagaaagagctgagaaatctcagaggtgatggcaaaggagttagaaagttatctgacagagtatatgactatgacatatacaatgatttgggaaatccagataaaggaattgatctagctagaccaaatcttggaggatcagatatgtatccttacccaagacggtgtcgtactggccgtgaaccatctgatacagatatgtatgctgagagtcgtgtggagaagccactgcctatgtatgtgccaagagatgaacgttttgaggagtctaagcagaacacattctctgtgaaaaggctgaaggcagtgttgcataacttgatcccaggtcttaaggctagtctttctgctaacaaccaagacttcaatgaattcaaagatgttgatggactttacagtgaagggttgctcataaagttggggttgcaagatgacatgttgaagaaaattccttttgtcagcaagatccaagaatctagccagggacttcttaagtatgacactcctaagattatttccaaggacaaatttgcgtggctgcgagatgacgaatttgcccgtcaaacaattgcaggagtgaaccctgtcaacattgagagccttaaagttttcccacctgttagcaaactagaccccgaaatttatggtccccctgagtctgctcttaaagaagaacacattttaagtcaactcaatggcatgactgtccaagaggcaatagacgaaaataagctgtttatcattgattatcatgatatttaccttcctttcctagaagggatcaatgcccttgatggtagaaaatcatatgcgacacgcaccatttttttctcgacaccccgtggcgctctcaagcctgtggctatagaacttagcttacctcctgctggacctagttcgcgttcaaagcgcgtggttacacctcctgttgatgcaactactaattggatgtggcagcttgccaaagcccatgtttgctccaatgatgccggggtacaccaacttgttaatcattggttacgcacacatgcctgcatggaaccatttatattggctgctcataggcaattgagtgctatgcatccaattttcaagctattggaccctcacatgaggtacacgttggagatcaatgccttggctagacagggtttgatcaatgctgatggaatcattgaaaattgcttcactcctggtcgctacgccatggagattagttctgctgcttacaaaaacatttggcgctttgacatggatagcctccctgcagatctcatccgcaggggaatggctgtacctgactcaacacagccacatggtctaaagctaatattggaagactacccctatgcagctgatggaatactaatttggtctgccatagaagactgggttcgtacctatgtgaaccattactaccctcactcaagcctgatatgcaatgacaaagagttacaatcatggtactctgagtcaatcaacgtaggccatgctgatcttaggcatgaaagttggtggcccacattgaacaacagtgaggatcttgtttccattctttccatcttgatttggaatgcatctgcacaacatgctgctcttaactttggtcagtacccttatgggggctatgtgccaaaccgtccaccactaatgaggaggctaatacctgaagagagtgatccagaatatgcaagtttccttgctgaccctcaaaagtattttctgaatgcattgcctagcttgttgcaagccacaaagtatatggctgtggttgacacactctccactcactcacctgatgaggagtacttgggggagaggcaacaaccttctatttggtctggtgatgctgagatcattgaggccttctatgatttctctgcaaagattaggcagatagagaaggtgattgatggcaggaaccttgacaggaatctaaggaaccgttgtggtgcaggggtgttgccttatgagttacttgctcctagctctgaacctggtgtcacatgcagaggggtacccaatagtgtgtccacataactatcctaaactagtaaataagggagttatttcccacattttgataagcattaatatatatggtaagcttactagttactactatatggacagtgactcagtggatgccattttgtacttagatttgataaattattatagtatatattggtaacctagggatgtatagactgtaagtatatcaaaatgagtttggtggggttggaggatgtgtgactgtttataaaattattatcaccaattgtagttttcttttgcactgttgtgtagttttctttgttgcaactatagcagattttattatgaaatgaagtttttaacttgaa

SEQ ID NO: 953 - DNA, 790 bp, Trigonella foenum-graecum
gtattgtctaaagtctaaacacctctacttccaattcccatagcaaagcaaaatcgaagaaatggcgtggcgctcaggatctctctcgcggtctatttactccgccgcaagatcaataccagctcgttcatctcttcaacattcttctacttcttccattcgttctcatcttcttcttcaccctcgccgcccccttctcactgtccctagaactttgggaattctcggttgcacgcagtcgttgatgccgttgcataacgctgacgccgccgctcgtctcacttctcacatttccgttgaattgcgcgcttgctgcgagttgtctcagggtacttgaattgattttacatttatcagcactggttgtgcctacatgtttggttggatctaaaaatgatggctaatgctgtgaagcacaaagcttgttggttcagatgttttacttgattgatctctctatcatcaaaactgttggtctatgtaaaattgagaagtgttttttgtattttatcatttttggcaaaattaaataagtatatctacccattcttctataaacaaacatttaggaaacttttcaagctaatcgaaggatatcgacttagttttgctttgtatcatcagataacaatgataagaaaaataatgttttccgagactaaggttgcattgaaattaagatgtatagatattgataattggtagtgtctcgtcatcgtacgagcaagttgcaaattgcaaattgcaatggttttgctcttgatacaattcaaatgtttaataactttgg

SEQ ID NO: 954 - DNA, 593 bp, Cicer arietinum
aacatggcgtggcgttgcggatctctctcgagatcgatattctccgcatcgagaacaataccaactcgttcctcaccatctcttcaacgttcttcttcgtctttacttcgctctcatcttctccaccctcgtcgcccccttgttactgtccctaggactttgggaattctcggttgcacgcagtcgttgatgccgctgcataacgctgacgccgccgctcgtctcacttctcacatttctgtcgagttgcgcgcttgctgtgaattgtctcagggtacttgataggattttacaatcagcactggttgtgcttacatgtatggttggacctaaatatgatggctaatgctgtgaagcaagaagcttgttgattcaattattgatctcttttatcaaagctgttggtctaggtgattttgagaagcatttttagtatttatcatttaagtctaaattaaataagtatatctatctattcttttataaacatttagaaaacatttcaagctaattgaaggatatcaactttgtttgttgtctttgtatcatcagataataatgacaatgcagtcctagctgagactaaggttaca

SEQ ID NO: 955 - DNA, 575 bp, Pisum sativum
acatcaaagaaatggcgtggcgaagcggatctctctcgaggtctattttctccgccgcgagaacaattccaactcgttcctctcttcaaaattcttctgcatcttcaattcgttctcatcttctccaccctcgtcgcccccatgccactctcccgaggagcttgggaattctcggttgcacgcagtcgttgatgccgctgtataacgcagacgctgccgctcgtctcacttctcacatttctgttgattttcgtgcttgctgcgaattgtctcagggtacttgaattgatttgacaattagcactagttgcgcctacatatatggttggatctaaaaggatggctaatgctgtgaagcacaaagcttgtcggttcatatcttttacttgattaatcccttttatcattttagttaaaattaaataagtatatctatctattcttctataaagatttaggaaacttttcaagctaattgaaggatattgtaatactttgctgtgctgtgtatcatcagacaataataacattgttcagagaccaaggttaaattgaaatttattgaatgtatagat

SEQ ID NO: 956 - DNA, 580 bp, Lotus japonicus
cctacttcttctgccttgtattccagtgatagcaaaagcaaagacatggcgttgcgctccggatctctctcaaggtcattgctctccgccgcgagaaccatacctcgccgttcctctatccctcgcccttccattcgctctcatcttctccaccctcgccgccccctcgttactgtccctagaactatggggattctagggtgcacgcagtcgctgttgccgctgcacagcgctgacgccgccgctcgtctcacttcccacatttccgtcgaattgcgcgcttgctgcgaattgtctcaaggtacttgaatggcctttacaatcagcaatcagcaccagttgtgcacacatgtttggttggttggttggacatagaaatgatggtggattctgtgaagcaggaagcctgctctcacttttcaaaactgtttttatggtcttgattgaggtttgggtagtgaatttgactagcatttcaattattctatactttttatcaaaattaaataagtatatccattcttctattattaggatttaagaaacttttgaacctaattgaaggtttatagactttgtt

SEQ ID NO: 957 - DNA, 894 bp, Trigonella foenum-graecum
tcccttaatcaaaaccctaaccctaatcccaaaatcaaattctctctcttccacaacaatggtgtgcatacgcaaagccaccgtaaacgacctactcgcgatgcaagcgtgcaacctcttctgcctccccgaaaattaccagatgaagtattatctctaccatatcctttcttggcctcagcttctttacgttgctgaagattacaatggccgaattgttgggtatgtgcttgcgaagatggaagaggagactaatgagtgtcatgggcatatcacttctcttgctgttttgaggactcataggaagttggggattgctactaagcttatgactgctgcgcagaatgctatggaacaggtgtttggtgctgagtatgtatcgctgcacgtcagaaagagcaaccgtgcagcctttaatttgtacacagagaccttggggtacaagattcatgatgtggaggccaagtattatgctgatggtgaggatgcttatgacatgaggaagcaactcaaggggaagacgatacatccgccacaacatcatcaccaccaccatcaccatggcggtggctgttgttctggggagaccaaggggaatgctaaaggctaaagcaacctgattgtgtgagcaattcccctcaccacccgaccccaccccaccccaattttttgcctgtttcttgaatgtctttgttgtgaaaacaattggaactttgttgattagtttgatgttgacaagatggtaatatttggtgttacttgttgtaggcttatttagtaatgttcactattttgtctctgctactgaatatctgtgtttgttaatttcttaaatttgactatgtgggatagtgggactagagatacttgagtatctatctttgttaaatgctt

SEQ ID NO: 958 - DNA, 1058 bp, Cicer arietinum
ttcggcacctctctctctaatcctctgtgtcggaactccgaaccctaaccctatcaacagcgaaatcaaacctagacaacaattcggaaccctaaccctatcaacagcgaaatcaaaactcgacaacaatggtgtgcataagaaaagcaacagtcaacgatctacttgcgatgcaggcttgcaatctattctgtctccctgagaattaccaaatgaagtattatctctatcacatcctctcttggcctcagcttctttatgtcgcggaagattacaacggccgtattgttggttacgttctcgccaaaatggaagaggaaactaatgagtgtcatggtcatattacttctctcgccgttcttcgtactcatcggaaacttggtctcgctaccaaacttatgacagccgcacaaaatgctatggaacaggtgtttggtgccgagtatgtctcgctgcacgttaggaagagcaaccgtgctgcttttaatttgtacacagagaccttggggtacaagattcatgatgtggaggccaagtattacgctgatggcgaggatgcttatgacatgaggaagcaactcaaggggaaacagattcatcaacatcagcatcatcaccaccaccaccatcatggcggtggttgttgttctggtgacatgaaagcggagaccaaggggaacgcaaaagccatttgattgtgagagaaatttttctccgtattgttttatctagtctattgaatgtctttgttgcgaaaacaattggagctttgttggctagtttggtattgacaagatcataattggtggttgaataatgttgtcacttgttgtaggcttatatagttatgtttactattttgtctctttacaatgtggatttttttattttaagaatgcacttgtttgcggttcatgtcatgattcttgattgggtatagttgcattcaaatatctctgtttatgtcacggggtattatttggacttgctatgatgattgttttgaagtttttaatcttagtttgttgagtagttcattatgtcatcttgtggctgta

SEQ ID NO: 959 - DNA, 563 bp, Pisum sativum
taagaaaagcaacggtcaacgacctcctcgcgatgcaagcttgcaatctcttctgtctccctgagaattaccagatgaagtattacctttaccacatcctctcttggccgcagcttctttacgtcgccgaagattacaacggccgcatcgtcggttacgtcctcgcgaagatggaagaggagactaatgagtgtcatggacatattacctctcttgcggttctgagaactcatcggaaacttggtattgctactaagcttatgaccgccgcacaaaacgccatggaacaggtgtttggtgctgagtacgtctcactgcacgtcaggaagagcaaccgcgcagcttttaacttgtacacggagaccttagggtacaagattcatgatgtggaggccaagtattatgctgatggggaggatgcttatgacatgaggaagcaactcaaggggaagcagttgcctcagcaccagcatcagcatcaccaccaccaccaccaccatggcggtggttgttgttccggggagaccaaggggaatgcaaaagccacctgattgtgagagcaa

SEQ ID NO: 960 - DNA, 679 bp, Cicer arietinum
ggggttcataattcggcacctctctctctaatcctctgtgtcggaactccgaaccctaaccctatcaacagcgaaatcaaacctagacaacaattcggaaccctaaccctatcaacagcgaaatcaaaactcgacaacaatggtgtgcataagaaaagcaacagtcaacgatctacttgcgatgcaggcttgcaatctattctgtctccctgagaattaccaaatgaagtattatctctatcacatcctctcttggcctcagcttctttatgtcgcggaagattacaacggccgtattgttggttacgttctcgccaaaatggaagaggaaactaatgagtgtcatggtcatattacttctctcgccgttcttcgtactcatcggaaacttggtctcgctaccaaacttatgacagcctcacaaaatgctatggaacaggtgtttggtgccgagtatgtctcgctgcacgttaggaagagcaaccgtgctgcttttaatttgtacacagagaccttggggtacaagattcatgatgtggaggccaagtattacgctgatggcgaggatgcttatgacatgaggaagcaactcaaggggaaacagattcatcaacatcagcatcatcaccaccaccaccatcatggcggtggttgttgttctggtgacatgaaagcggag

SEQ ID NO: 961 - DNA, 840 bp, Vigna unguiculata
tggagccctaattcagtcttaatcatcgctaggtagttcagggagtgagggaaaagggggaaaatggtgtgcataaggaaggcgacggtgaaggaccttctggcgatgcaggcttgcaacctgttctgcctcccggagaactaccagatgaagtactacctctaccacatcctctcctggcctcagcttctctacgtcgccgaagactacaacggtcgcatcgtcggctacgtcctcgccaagatggaggaagagaccaccgactgccacggccacatcacctccctcgccgtcctccgcacccaccgcaaacttggtctcgccaccaaactcatgaccgccgctcagaacgccatggaacaggtgtttggtgccgagtatgtgtccctgcacgtgcgcaagagcaaccgtgcggccttcaatttgtacaccgagaccttggggtacaagattcatgatgtggaggctaagtattatgcggatggagaagatgcttatgacatgaggaagcagcttaaagggaagcagcaccatcaccaccataatcaccaccaccaccacctccatcatgagcatggtggtgggtgttgttctggggaggtcaaggggaatgccaaagctacctgattgaatggttaacgagtcttttaaagaaatgatacttttagtttgaaatagtaggctgtggtccaatcgtgttgtgcaaacttgctgtagatttattgggctgtgttatttcacttttattagaattttttctttactggcttggtgaatatagatactctttcggcttcatgatgcttggattaataacaactttcggtgtctttgttgttt

SEQ ID NO: 962 - DNA, 806 bp, Glycine max
tcctacatagagagaggtgcgttgcgtgttggtgccgccctaatcgtgagaagaaaggaaaggcaaaagggaaagatggtgtgcataaggaaggcgacggtgaaggaccttctggcgatgcaggcgtgcaacctgttctgcctccctgagaactaccagatgaagtactacctctatcacatcctctcctggccccagctcctctacgtcgccgaagactacaacggccgcatcgtcggctacgtcctcgccaagatggaggaagagaccactgactgccacggccacatcacctccctcgccgtcctccgcacccaccgcaagctaggcctcgccactaagctcatgaccgccgcccagaacgccatggaacaggtgtttggtgccgagtacgtgtccctgcacgtgcgcaagagcaaccgcgcggccttcaatttgtacacggagactctagggtacaagattcatgatgtggaggccaagtattatgcggacggggaggatgcttacgacatgaggaagcagctcaaggggaagcagcaccaccatcatcaccatcaccaccaccaccgtcacgagcacggcggtggctgttgttccggggagcccaaggggaatgttgcaaaagccacctgattgaaataaattatgagacttttagtttgaaagaatagtaagctctggttgagttctgttgtgcaaacttgttgtagatttattgggccattttgtctcattagatatgaatttttgctttgctgtcttggtgaaatatagacactccttgggcttcatattgcttgaat

SEQ ID NO: 963 - DNA, 1157 bp, Glycine max
gagcacaatagagactagagaagagagaggtgttggtgccctaatcgtgagaagaaaggaaagggaaaagaggaaaatggtgtgcataaggaaggcgacggtgaaggaccttctggcgatgcaggcgtgcaacctgttctgcctccctgagaactaccagatgaagtactacctctatcacatcctctcctggccccagctcctctacgtcgccgaagactacaacggccgcatcgtcggctacgtcctcgccaagatggaggaagaaaccaccgactgccacggccacatcacctccctcgccgtcctccgcacccaccgcaagctcggcctcgccaccaagctcatgaccgcagcccagaacgccatggaacaggtgtttggtgccgagtacgtgtccctccacgtgcgcaagagcaaccgcgcggccttcaatttgtacacggagacccttggctacaagattcatgatgtggaggccaagtattatgcagatggggaggatgcttatgacatgaggaagcagctcaaggggaagcagcaccaccatcatcaccataatcaccatcaccatcaccaccaccaccacgagcacagtggtggctgttgttcaggggaggccaaggggaatcctgccaaagccacctgattgaaagaaactaggagacttttagcttggaaaaataaatagtaagctttggttgaattctgttgtgtaaacttgttgtaggtttattgggccgatttgtctcgttatatatgaatttttgctttgctgtattggttaatattggcactccttcaatgataacatgattgtcctttttgttttgttgctgtgaattatcacaacttgttatgtttgttgattacatttcacaacaacttggttggtggtgtgagcacactagttaattgcacgctctatagattagtgtgtggtgtgtggtgtggcatccagcttctactggagcttcatttgtgttgcaccacaatcccagcatagctgcagctttatgccaccattgtagcagcgtgttgagttgggcaattcatgccgctatttgtaattaattactccctttgtccctaattataagaccattttcagaaatttggttgtccattaataaaatcattctctaatttctagatgc

SEQ ID NO: 964 - DNA, 1297 bp, Phaseolus coccineus
ctaattgaatcgattcataggtagcgcagggagtgagagtgagagggagaagggggaaaatggtgtgcataaggaaggcgacggtgaaggaccttctggcgatgcaggcgtgcaacctcttctgcctccctgagaactaccagatgaagtactacctctaccacatcctctcctggcctcagctcctctacgtcgccgaagactacaacggtcgcatcgtcggctacgtcctcgccaagatggaggaggagaccaccgactgccacggccatatcacctccctcgccgtcctccgcacccaccgcaaactcggtctcgccaccaaactcatgaccgccgcccagaacgccatggaacaggtgtttggtgcggagtatgtgtccctgcacgtgcgcaagagcaaccgtgcggccttcaatttgtacaccgagaccttggggtaccagattcatgatgtggaggctaagtattatgcggacggagaagatgcttatgacatgaggaagcagcttaaagggaagcagcagcaccaccaacatcatcatcatcaccatcaccaccaccaccatcaccaccatgagcatgggggtgggtgttgttctggggatgtgaaggggaatgccaaagccacctgattgaagggttaacgagtgttggaaagaaacgagactttggcttgaaatagtaggctgtggttgaattgtgttgtgcaaacttcttgtagatttattgggctgtgttgtcttatttttgttagatttttttgctttgctggcttggtgagagtatagacactccttcggcttcatgatgcttgaattaataacaagattgttgcctttcggtgtctttgttgttttgtcatgggaatttattttattttcacttgaggactttctgtgtggagagtagttaattgcaggcactgttgaatggtgtcaagccgtgtggagcggcatctatcttctactggggcttcatttgtgttgcaccatggttctagcatagctgcacctgttgtggtcaccaccactgtcgaacagttttgctgggaaagaggtatcttttgtgccactttatcattttaaaattcggttcaagatctttgtgttttggttttcattgaattagtgttggagttttgaattaccttgcagtttattttatttgattgtactttatttttattgtttttctttacttccaagctagttctaagctttcagtgcttggacacaatttttggtggagaatacttgaattttgatagtgtcagtgtttaactttgatagcataa

SEQ ID NO: 965 - DNA, 1145 bp, Phaseolus coccineus
agggagtgagagggagaagggggaaaatggtgtgcataaggaaggcgacggtgaaggaccttctggcgatgcaggcgtgcaacctcttctgcctccctgagaactaccagatgaagtactacctctaccacatcctctcctggcctcagctcctctacgtcgccgaagactacaacggtcgcatcgtcggctacgtcctcgccaagatggaggaggagaccaccgactgccacggccatatcacctccctcgccgtcctccgcacccaccgcaaactcggtctcgccaccaaactcatgaccgccgcccagaacgccatggaacaggtgtttggtgcggagtatgtgtccctgcacgtgcgcaagagcaaccgtgcggccttcaatttgtacaccgagaccttggggtaccagattcatgatgtggaggctaagtattatgcggacggagaagatgcttatgacatgaggaagcagcttaaagggaagcagcaccaccaccaacatcatcatcatcaccatcaccaccaccaccatcaccaccatgagcatgggggtgggtgttgttctggggatgtcaaggggaatgccaaagccacctgattgaagggttaacgagtgttggaaagaaacgagactttggcttgaaatagtaggctgtggttgaattgtgttgtgcaaacttcttgtagatttattgggctgtgttgtcttatttttgttagatttttttgctttgctggcttggtgagtatagacactccttcggcttcatgatgcttgaattaataacaagattgttgcctttcggtgtctttgttgttttgtcatgggaatttattttattttcacttgaggactttctgtgtggagagtagttaattgcaggcactgttgaatggtgtcaagccgtgtggagcggcatctatcttctactggggcttcatttgtgttgcaccatggttctagcatagctgcacctgttgtggtcaccaccactgtcgaacagttttgctgggaaagaggtatcttttgtgccactgtatcattttaaaattcggttcaagatctttgtgttttggttttcattgaattagtgttggagttttgaattaccttgcagtttattttatttgattgtacttt

SEQ ID NO: 966 - DNA, 1224 bp, Vigna unguiculata
gagggaaaggggaaagaaaatggtgtgcataaggaaggcgacggtgaaggaccttctggcgatgcaggcgtgcaacctcttctgcctccctgagaactaccagatgaagtattacttctatcacatcctctcatggcctcagcttctctacgtcgccgaggactacaacggtcgcatcgtcggctacgtcctcgccaagatggaggaggaaaccaccgactgccacggccacatcacctccctcgccgtcctccgcacccaccgcaaactcggtctcgccaccaaactcatgaccgccgcacagaacgccatggagcaggtgtttggtgccgagtacgtgtccctgcacgtgcgcaagagcaaccgcgcggccttcaatttgtacacggagaccttggggtacaagattcatgatgtggaggctaagtattatgcggacggagaggatgcttatgacatgaggaagcagctcaaggggaagcagcagcatcagcagcaccatcatcaccaccatcaccatcaccaccaccaccatcacgaacatggaggcatgtgttgttccggagaggtcaaggggaatgccaaagccacttgattgaatggttaaaaagtagtggaacgaaatgagacttttggtttgaagtattaggctgtggttgaattgtgttgtgcaaacttgttgtagatttattgggctgtgttgcctcattttgatatcaattttttgtttgctgtcttggttttggcttcgtgatgcctgaatgaataacagggttgctgcgatttggtgtctttgttgttttttgtcacgggaattattttatttgcacttgaggacttgctgccagcagttttttcttgcaggcactatagattggtgtcgtgctatgtggagcggcattgatcttctactggagcttcatttgtgttgcaccatggtatcagcatagctgttgctgttgtggccactactgtctacagttttgctgggaaaaaggtttgttggatgttctactgctttcttcatagtagcggttatactttgtgttttatgccactgtagcttcatgttttgaagtggcgattcatgccactacttgtagttattcactaggtattacagaaaatgaggatgaatatttgcagtaccaagctacttattaatggagtgttacttccttgctgtggattaactgaaattgagtattttttcatttctgatgc

SEQ ID NO: 967 - DNA, 1223 bp, Vigna unguiculata
agggaaaggggaaagaaaatggtgtgcataaggaaggcgacggtgaaggaccttctggcgatgcaggcgtgcaacctcttctgcctccctgagaactaccagatgaagtattacttctatcacatcctctcatggcctcagcttctctacgtcgccgaggactacaacggtcgcatcgtcggctacgtcctcgccaagatggaggaggaaaccaccgactgccacggccacatcacctccctcgccgtcctccgcacccaccgcaaactcggtctcgccaccaaactcatgaccgccgcacagaacgccatggagcaggtgtttggtgccgagtacgtgtccctgcacgtgcgcaagagcaaccgcgcggccttcaatttgtacacggagaccttggggtacaagattcatgatgtggaggctaagtattatgcggacggagaggatgcttatgacatgaggaagcagctcaaggggaagcagcagcatcagcagcaccatcatcaccaccatcaccatcaccaccaccaccatcacgaacatggaggcatgtgttgttccggagaggtcaaggggaatgccaaagccacttgattgaatggttaaaaagtagtggaacgaaatgagacttttggtttgaagtattaggctgtggttgaattgtgttgtgcaaacttgttgtagatttattgggctgtgttgcctcattttgatatcaattttttgtttgctgtcttggttttggcttcgtgatgcctgaatgaataacagggttgctgcgatttggtgtctttgttgttttttgtcacgggaattattttatttgcacttgaggacttgctgccagcagttttttcttgcaggcactatagattggtgtcgtgctatgtggagcggcattgatcttctactggagcttcatttgtgttgcaccatggtatcagcatagctgttgctgttgtggccactactgtctacagttttgctgggaaaaaggtttgttggatgttctactgctttcttcatagtagcggttatactttgtgttttatgccactgtagcttcatgttttgaagtggcgattcatgccactacttgtagttattcactaggtattacagaaaatgaggatgaatatttgcagtaccaagctacttattaatggagtgttacttccttgctgtggattaactgaaattgagtattttttcatttctgatgc

SEQ ID NO: 968 - DNA, 953 bp, Cirsium arvense
aaatggtgtgcatacgaaaggcaacgattgatgatctgcttgcaatgcaagcctgcaatctcttctgcctccctgagaattaccaaatgaaatactacttttatcatattctttctatggccgcagctcctctacgtcgccgaagattatggcggcaagatcgttggatatgtgcttgccaagatggaagaagagagcactgagtgtcacggccatatcacttcacttgctgttctccgtacgcaccgtaagttagggcttgcaaccaagctcatggccgctgcacagaacgccatggaacaggtatttggtgctgaatatgtgtcattgcacgtgaggaagagtaacagggccgcattcaatttgtacaccgagaccctggggtacaagatccatgacatggaggccaagtattatgcagatggagaggatgcatatgatatgaggaaacaattaaaaggaaaacatcaacatcagcatcagcaccaccaccaccaccatggtggcggttgctgctctggagaggcaaaaaccgagtgatggagaaataagctgaagctgaatgaaggaatgatccatatctcagttatatgcattctctggaagcaatttgtgtgaaagaaacttgataccatttcatattattatgttttggcgttgattgcaatttacgcgattttgcagaattttaaataagtcttacctttttaatccgtttccagcagcaatacagattagcgatgaaaatgaaaggattaaaactaaatttattgttcacttgagtaccaatccgatataaaatgtgttattgctgatgttgtttataagagcatctccaacatagaaaaaccgtacttttttttttcttctattttagcaattctattggagatgctctaatttataatcgagtatgtggtttcgttaaagctaccacattttgaaaaaagata

SEQ ID NO: 969 - DNA, 949 bp, Helianthus annuus
caaaacaactattccaacagtatcgtttcttcccatatatcttccaaaccctagcccctctcttccaaacaaacctcaacaacaatggtgtgtatacgcaaagcaacaatggatgacctgcttgcgatgcaagcctgcaatctcttctgcctccctgaaaactaccagatgaaatactacttctaccacatcctctcctggccgcagctcctctacgttgcggaggattacggtggcaagatcgtcggttatgtcctcgctaagatggaagaagaaaccaccgagtgtcacggccacatcacctcccttgccgttctccgtactcaccggaagttagggcttgctaccaaactcatggtcgctgcacagaacgccatggaacaggtgtttggggcagaatatgtttcgcttcatgtgaggaagagtaacagggctgcatttaacttgtacaccgagacgctaggttataagatccatgacatggaggctaagtattatgcagacggagaagatgcatatgatatgcggaaagaattgaagggaaagccacagcaccagcaccagcaccaacaccaccatcatcaccaccatggtggtggttgctgctctggtgaggcgaaagctgaatgattgaggatattggtgtgtttcatttggcgcaagtaacctcaagccgaatgaaggaataactcaaatctggaactactctgtcatgcttaatatgggagcattttgtgtaaaagaaacaggagaagcttggaaattaatataaacactacgagtttctttaagtcttatgttaattgcaagttctattactttgcagaattttgtaatagttgacttttgacattttccaacattacagatttcagattgttacattcacctttaattatttgttaattgtgcttctatgagcttaactattgctttagtttgttgattc

SEQ ID NO: 970 - DNA, 1097 bp, Fagopyrum esculentum
gggtataccgtcggcgtcgtcttctgcagcatctgcaatctacatagcgtaaaaaccctaaccctaaattcctcaaatcgagtttgcaggaagagaacaatggtgtgcataaggaaggctacgatggatgatctgcttgctatgcaagcctgcaatctcctctgtctccctgagaactaccagatgaaatactatctctaccatatcctatcttggcctcaacttctctatgttgccgaggactacaacggtcgaatcgtcggttacgttctcgccaagatggaagaggagaccactgagtgccatggccacatcacctccctcgccgttgtaaggactcacaggaagttgggactggcaacgaagctgatgacagcagcacagaatgctatggagcaggtgtatggagctgaatatgtgtctttgcatgtgaggaagagcaacagggcggctttcaacttgtacacggggaccttgaattacaagattcatgatgtggaggctaagtactatgctgatggggaggatgcttatgatatgaggaaacagctgaaggggaagtctgttggtcatggtagtgcccatcaccaccaccatcatcatggtggtgggtgttgctcaggtggacacgccactgctaagtcagaggggaaggtaaaccacagcggaggaaaggctgaggccaagtcgggggttgctgagtaatgttctgcaggacttggtgctcgtctttagtgctcttaattttccagaaaaggtttgaagttcagctaaggctgccttttgtaggcattctcatattctatgtatcaaatatggtgatgtatgggagataaatgcatatacgttgatgttgttcctctgaacacggttgaagaatgctatgagattgtatttttggcctcacccatgttgtttaattgaacttcagtaatgaagattatgaaggtgattgtgtttccccatgtcacatgaccatgcttgtttgttttgaccgcttgtgaacttgcgtatttgttctactctaatgattgtttcttctttgaaggattgatggttggccatcataatgaatcacgttgaatttgatttaaaaa

SEQ ID NO: 971 - DNA, 1091 bp, Orobanche aegyptiaca
aatcccataaatcgaacgtaacaaaaaccctaacccttgaatccctctctaccccgattccaaccaatcaatttgaatagaagaatggtgtgcatcaggaaagcaacggtggatgacttgctggcgatgcaggagtgcaatctgttctgcctgcctgagaactaccagatgaaatactatttgtaccacattctctcgtggccgcagctcctctatgtcgccgaggattacaatggcaagattgtcggttatgttttggccaagatggaggaggaatccaatgagtgccacggacacatcacctcactcgccgttctcaggactcaccgcaactcggccttgccactaagctcatgactgctgctcaaaacgccatggaacaggtctatgaggctgaatatgtgtcactgcatgtcaggaaaagcaatagggctgcatttaatttgtacaccgagacattagggtacaagattcatgatgtggaggcaaaatattatgccgacggagaggatgcttatgatatgaggaagcaattgaagggtaagaagcaccataactaccaccatcatcaccaccatcatcatagtggtgggtgttgttctgcagatagatcagcagaggccaaaactgagtgatgataatgggtcagcatcctcttatgttattcatcttctttgttagcatggacttatcaatacacctgcagaacatgcatgttcaacatatttgcgcaccgtaagctattatttttcgttttttgctcaaaatgaaggctgaagttatgcagaatttgagatatttatgttaagcattgatgattaagtgatcatgcctttttttccttgagtcattctttatatggtttaatgcaccatagacatgggtatacttctattttcgtatcatttgggttgattggttggatatttgcagttcccgcgacagattataagtaaattaattattttcattggacatcttgaatgtagtagttgcctgtgattaacgttaatcctagcagaggattgattgggaatgtttggactaactctcaattttctgatttcaaatgcctgtctgtcattaatttt

SEQ ID NO: 972 - DNA, 831 bp, Ambrosia trifida
cgttttcatcgtatatcttccaaacccctagcccctcttccaaacaaacacaacaacacaatggtgtgcatacgcaaggcaacaatggacgacctgctagcgatgcaagcctgcaacctcttctgcctaccagaaaactaccagatgaagtactacttgtaccacatcctctcttggccccacctcctctacgtcgccgaggattacggcggcaagatcgtcggctacgtcctcgctaagatggaagaagagacgaccgagtgtcacggccacatcacctccctcgctgttctccgtactcatcgtaagttaggccttgctaccaaactcatgctcgctgctcagaacgccatggaacaggtgtttgaggcagaatatgtttcactccatgtgaggaagagtaacagggctgcatttaacttgtacaccgagacgctaggttataagatccatgacatggaggctaagtattatgcagacggagaagatgcatatgacatgaggaaagaattgaagggaaagccgcagcaccagcaccaacaccaccatcatcaccaccaccatggtggtggttgctgctctggtgaggcaaaggccgaatgattgaggatattggtgtgtttcatttggcgcaagtaacctctagccgactgaaggaataactcaaatctggaactactcggttatgcaatctgtggagtattttttgagtaaaagaacaggagataataaacactactagtttctttaagtctttattttaattgactaaactttcaatttagttttgactaagtaaatttttgtaaattagtttgactttttgactac

SEQ ID NO: 973 - DNA, 788 bp, Taraxacum officinale
cgggggacatagatgacagtgttcgttttctctgtatattccgtctcataagcaaaccctagcccctctcttccgaagaaacgccacagcttccaattcgaaaatggtgtgtatacgcaaggcgaccatagacgacctgcttgcgatgcaagcatgcaacctcttctgtcttcctgaaaactaccagatgaaatactatttctaccacattctctcctggccccagctcctctacgtcgccgaggattatggcggcaagatcgtcggttatgtgcttgctaagatggaagaagagaccaccgagtgtcacggacacatcacgtcactcgctgttctccgtacgcatcgtaagttagggcttgcaaccaaactcatggccgctgcacaaaacgccatggaacaggtttttggggctgagtacgtgtcactccatgtgaggaagagtaacagggcagcattcaatttgtacacagagacattagggtacaagattcatgacatggaggctaaatattatgcagatggagaagatgcgtatgatatgaggaaagagttgaagggaaaaactcaacatcagaatcaccaccaccaccaccaccaccaccatggtggtgggtgctgctccggggacgcaaaagctgagtgatggaggtacaatttattgcctgttttttcttctattaagtgatgtatggataaagtgttgaattgataaatgatgtctgtgcggattaagttatggtggtgttaagttcattaagtaaaaaaaatacagataccgagcgaaa

SEQ ID NO: 974 - DNA, 681 bp, Senecio madagascariensis
gaacaatggtgtgtatacgcaaagctacgattgacgacctactggcgatgcaagcttgcaatctgttctgcctacccgaaaactaccagatgaaatactacttttaccacatcctctcatggccgcagcttctttacgttgccgaggattacggcggcaagatcgtcggatatgtcctcgcaaagatggaagaagagactaccgagtgtcacggtcatattacgtcgcttgcggttcttcgtactcatcggaagttaggccttgctactaagctcatggccgctgcacaaaacgccatggaacaggtgtttggggccgagtacgtgtcactgcatgtaaggaagagtaacagggcagcattcaatttgtacaccgagactttgggatacaagatccacgacatggaggccaagtattatgcagatggagaagatgcatatgatatgaggaaagagttgaagggaaaacaactacatcatcaacatcaacatcaccaccaccaccatggtggcggttgctgctctggagaagcaaaagctgaatgatggaggtataattttagtcattggagaatgttgtcgttttctgtactgtcttttacccttccatttgtagcgtatgctttattatgatggaggtataattttagtcattggagaatgaggccaatttctggcttga

SEQ ID NO: 975 - DNA, 810 bp, Tragopogon dubius
attagtgttgttttgtctacaaatttaaaaccctagcccctctcttccgaagaaacgcagcttcagaatccaaattcggaaaaaatggtgtgcatacgcaaggcaaccatcgacgacctgctcgcgatgcaagcttgcaacctcttctgcctccctgaaaactatcaaatgaaatactacttctatcacattctctcttggccccagctcctttacgtcgccgaggattatggcggcaagatcgtcggttatgtgctcgctaaaatggaagaagagaccacggagtgtcacggacacatcacctccctcgccgttctccgtacgcaccgtaagttagggcttgcaaccaaactcatggccgctgcacagaacgccatggaacaggtatttggtgcggaatatgtgtcactgcacgtgaggaagagtaacagggcagcgtttaatttgtacacggagacattggggtacaagattcatgacatggaggctaagtattatgcagatggtgaggatgcatatgatatgaggaaacaattgaagggaaagactcaacaccaccaccaccaccaccaccaccatgctggcggttgctgctccggtgatgcaaaacctgagtgatggagggagaaataacctcaagccaaatgaaggggcatttggtgtgaaaatagtgataccatttccatttcatgatgtctcatgtttattgcaacttttgttattttgcataaattataagattaaggataaaattgaatgtggttggtgatctcttgctatttagctaaatgttgaaggttattttagaac

SEQ ID NO: 976 - DNA, 924 bp, Cajanus cajan
ataaggaagtaacagagcgtggtgagagccccaaatcagattgataccctaatcgcgatggtgtgcataaggaaggcgacggtgaaggaccttctggcgatgcaggcttgcaacctgttctgcctgccagagaactaccagatgaagtactacctctaccacatcctctcctggccccaactcctctacgtcgccgaagactacaacaaccgcatcgtcggctacgtcctcgccaagatggaggaggagacctccgactgccacggccacatcacctccctcgccgtcctccgcacccaccgcaagctcggcctcgccaccaagctcatgaccgccgcccagaacgccatggagcaggtctttggcgccgaatacgtctccctccacgtccgcaagagcaaccgcgccgccttcaacctctacaccgaaaccctcggctacaagattcacgacgtcgaggctaagtactacgccgacggggaggatgcttacgacatgaggaagcagctcaaggggaagcagcaccaccagcatcaccataaccatcaccatcaccaccaccaccaccaccatcatcaccaccacgaccacggcggcggctgttgctccggggaggccaaggggaatgccaagtccgcctgattgcttcttgtcctaataaatgtggattttagtttttgttagggttgattgcgttgtgcaagcttgttgtagatttatttggctgtgttcgctgttttgtctcttattatatggatttagacgctccgtgtgttttctggatgattgaatgaataacattttagtgtctgttgaggttttttttataggttttctgaatgatgttttatgtcactgtggcatgtcttgaattggttgatacatgctgctagtgtaactcgtctgttggactaaacttatttc

SEQ ID NO: 977 - DNA, 894 bp, Fagopyrum esculentum
accctaaattcctcagatcgaatttgcaggaagagaacaatggtgtgcataaggaaggctacgatggatgatctgcttgctatgcaagcctgcaatcttctctgtctccctgagaactaccagatgaaatactatctctaccatatcctatcttggcctcaacttctctatgttgccgaggactacaacggtcgaatcgtcggttacgttctcgccaagatggaagaggagaccactgagtgccatggccacatcacctccctcgccgttgttaggactcacaggaagttgggactggcaacgaagctgatgacagcagcacagaatgctatggagcaggtgtatggagctgaatatgtatctttgcacgtgaggaagagcaacagggcggctttcaacttgtacacagggaccttgaattacaagattcatgatgtggaggctaagtattatgctgatggggaggatgcttatgatatgagaaagcagctgaaggggaagtctgttggtcatgctagtgcccatcaccaccaccaccatggtggtgggtgttgctcaggtggacacgctactgctaagccagaggggaaggtaaaccacagcggagggaaggctgaggccaagacggggactgctgagtaatgttctggacttggtgctcctctttagtgctcttgattttcccgaaaaggtttgaagttctgctaaggttgccttttgtaggcattctcattctcatattctatgtatcaaatatggtgatgtatgggcgaaaaacgcatatacattgatgttgttcctctgaacacggttaaagaatgctatgagattgtatttttggccttacccatgttgtttcatggaacttcagtaatgaagattatgaaggtgatt

SEQ ID NO: 978 - DNA, 672 bp, Flaveria ramosissima
cagagaaccacaacacatctttacaacacaatccaacttcatcaatggtgtgcatacgcaaagcaacaatcgatgaccttcttgcgatgcaagcctgcaacctcttctgtctccctgaaaactaccaaatgaaatactacttctaccacatcctctcatggccgcagctcctctacgtcgccgaggactacggtggcaagatcgtcggatacgtgctcgcgaagatggaagaagagaccactgagtgtcacggccacatcacgtcgctcgctgttcttcgtactcaccgtaagctagggcttgcgaccaagctcatgatcgctgcacaaaacgccatggaacaggtgtatggggcggaatatgtttcgctacatgtgaggaagagtaacagggctgcattcaatctgtacaccgagacacttggttacaagatccacgacttggaggccaagtactatgcagatggagaggatgcatatgatatgaggaaacgattgaagggaaaaccacagcaccagcaacaacaccaccatcaccgccaccaccaccacggtggtggttgctgctctggcgaggcaaaagccgaatgatttgagttgtaggatactggtgttcttcattccgtacaagtggcctcaagccgaatgaagaaataactcaaatccggaacta

SEQ ID NO: 979 - DNA, 766 bp, Carthamus tinctorius
ggcggggttccaaatcaaccctagcccctctcttccgaagaagctttcacaaacgaaatcgaaaatggtgtgcatacgaaaggcaaccattgacgacctgcttgcgatgcaagcctgcaatctcttctgcctccctgagaattaccagatgaagtactacttctaccatatcctttcatggccgcagctcctctacgtcgccgaggattatggcggcaagatcgtcggatatgtgctcgccaagatggaggaagagagcaccgagtgccatggccatatcacgtcccttgccgttctccgtacgcatcgtaagctagggcttgctaccaagctcatggccgctgcacagaacgccatggaacaggtgtttggtgcggagtatgtgtcacttcacgtgagtaagagtaacagggcagcattcaatttgtacacggagacactggggtacaagatccacggcatggaggccaagtattatgcagatggagaggatgcatacgatatgaggaagcaattaaagggaaaacatcaacatcagcatcagcaccatcaccaccaccaccatcatggcggtggttgctgctctggagaggcaaaaaccgagtgatggaggtacgatcttaagtcattgaagaaatatcgtcgtttcttatactctttgcacttccgtttgtatcctcctatgcttcatttatgaggccaatttgtgatttgagatgatagaatttttgtttgttgatcatgtcattgagttactatctaagca

SEQ ID NO: 980 - DNA, 903 bp, Lippia dulcis
aaaccctaatcttttgcccaccgaaagattaagcaaccatggtgtgcatcaggaaggcgacggtggacgacttgttggcgatgcaggcctgcaatttgttctgcctgccggagaattatcagatgaagtactatttctaccatattctttcatggccgcagctcctctacgttgccgaggattacaacggcaagatcgtcggatatgttttggccaagatggaggaggaaaccaccgagtgccacggccacatcacctctctcgccgtgctcagactcaccggaagctcggctcgccaccaaactcatgactgctgctacaaaatgccatggaacaggtgtatgcagcagaatatgtgtcactgcatgttaggaaaagcaatagagctgcctttaatttatacacccagacattagggtacaagattcatgatgtggaggccaaatattatgccgatggggaagacgcttacgatatgaggaagcaattgaagggaagaagcaacaccaccatcatcaccaccaccaccatcaccaccatggtggtggatgttgttctgctgatgcgaaagctgatgagaagcctggatcagcagagccaaaacagagtgattgttgtagtttcaatcaacagtcagggattttgttgtgttcgcctatccagttggaatttgaaaacgtcagcacacaccccttgtttacttaattttttatatgttttggtagtttttttatgtatgaaaaatgtactgagagaaacaattttgggtggggtaagaatgggggcaatggaagctcaaataattaaacatgtgctatttattgtatttgccatctttatttgtgcttttgctgaaatgttttttgtcatgagattgaaatctttatattcttttaaaaagaa

SEQ ID NO: 981 - DNA, 832 bp, Centaurea maculosa
  misc_feature (803)..(803): n is a, c, g, or t
gcgggggctctccaaaaccaaccctagcccctctcttctcgaagaaaagcttcacagaatcgaaatcgaaaatggtgtgcatacgaaaggcaaccattgacgacctgcttgcaatgcaagcctgcaatctcttctgcctccctgagaattaccagatgaagtactacttctaccatatcctttcatggccgcagcttctctacgtcgccgaggattatggcggcaagatcgtcggatacgtgctcgcaaagatggaggaagagagcaccgagtgccatggccatatcacgtctcttgccgttcttcgtacgcatcggaagttagggcttgctaccaagctcatggccgctgcacagaacgccatggaacaggtgtttggtgcggagtatgtgtcacttcacgtgaggaagagtaacagggcggcattcaatttgtacacagagacactggggtataagatccacgacatggaggccaagtattatgcggatggagaggatgcatacgatatgaggaaacaattgaagggaaaacatcaacatcagcatcagcatcagcatcagcaccaccatcaccaccatcatggtggcggttgctgctccggggaggcaaaagccgagtgatggaggtacgatcttaagtcattgaagaaatattgtcgtttcttatactcatttgcacttccgtttgtatccctccctcctgtgcttcatttatgaggtcaatttgtgatttgtgatgatagaatgttttgttttgttggtcatcattgagctactatctaagcatttcttgtattttgnatgattaaacaaaagtttgcattcggata

SEQ ID NO: 982 - DNA, 879 bp, Helianthus annuus
ggggcttccaaaccctagcccctctcttccaaacaaacctcaacaacaatggtgtgtatacgcaaagcaacaatggatgacctgcttgcgatgcaagcctgcaatctcttctgcctccctgaaaactaccagatgaaatactacttctaccacatcctctcctggccgcagctcctctacgttgcggaggattacggtggcaagatcgtcggttatgtcctcgctaagatggaagaagaaaccaccgagtgtcacggccacatcacctccctcgccgttctccgtactcaccggaagttagggcttgctaccaaactcatggtcgctgcacagaacgccatggaacaggtgtttggggcagaatatgtttcgcttcatgtgaggaagagtaacagggctgcatttaacttgtacaccgagacgctaggttataagatccatgacatggaggctaagtattatgcagacggagaagatgcatatgatatgcggaaagaattgaagggaaagccacagcaccagcaccagcaccagcaccaacaccaccatcatcaccaccatggtggtggttgctgctctggtgaggcgaaagctgaatgattgaggatattggtgtgtttcatttggcgcaagtaacctcaagccgaatgaaggaataactcaaatctggaactactctgtcatgcttattatgggagcattttgtgtaaaagaaacaggagaagcttggaaattaatataaacactacgagtttctttaagtcttatgttaattgcaagttctattactttgcagaattttgtaatagttgacttttgacattttccaacataacagatttcagattgttacattcacctttaattattattcacctt

SEQ ID NO: 983 - DNA, 1225 bp, Phaseolus coccineus
gggggagtgaaagagaagtgttggttagggaaaggggaaaatggtgtgcataaggaaggcgacggtgaaggaccttctggcgatgcaggcgtgcaacctcttctgcctccctgagaactaccagatgaagtactatttctatcacatcctctcatggcctcagcttctccatgtcgccgaagactacaacggtcgcatcgtcggctacgtcctcgccaagatggaggaggagaccaccgactgccacggccacatcacctccctcgccgtcctccgcacccaccgcaaactcggtctcgccaccaaactcatgaccgcctcccagaacgccatggaacaggtttttggtgccgagtacgtgtccctgcacgtgcgcaagagcaaccgcgctgcctacaatttgtacaccgagaccttggggtacaagattcatgatgtggaagctaagtattatgcggacggagaggatgcttatgacatgaggaagcagctcaaggggaagcagccgcagcaacagcagcaccatcatcaccatcaccaccaccaccaccatcacgaacatggaggcatgtgttgttccggggggaatgccaaagccacctgattgaatggttaacaggtcgcggaaagaaatgagacttttagtttcgaaatagtaggctttggttgaattgtgttgtgcaaacttgttgtagatttattgggctgtgttgcctcatttagatataaatttttgctttgctgtcttggtttcggcttcgcgatgcttgaatgaataacaggattgttgcgttttggtgtctttgttgtttttttgtcatgggaatttattttattttcacttgaggacttgctgtgagcagggttgttaattgcaggcactatagattggtgtcgtgctatgtggagcggtatcgatcttctactggactccctttgtgttgcaccatggtgccagcatagctgtagctgttgtggccactactgtctatagttttgctgggaaaaaaaggtttgttggttgttctactgctttcttcatagtagctgttgttactttatcttttatgccactgtagctgcatgttttgaattggcgattcgtgctactgcttgtagttaatcactagggatgagagaaaatgaggatgaatatttgcggtaccaaactacctattaatggactttggattaactgagattgagtttttttcatttctgatgc

SEQ ID NO: 984 - DNA, 785 bp, Phaseolus coccineus
agggaaaggggaaaatggtgtgcataaggaaggcgacggtgaaggaccttctggcgatgcaggcgtgcaacctgttctgcctccctgagaactaccagatgaagtactatttctatcacatcctctcatggcctcagcttctccatgtcgccgaagactacaacggtcgcatcgtcggctacgtcctcgccaagatggaggaggagaccaccgactgccacggccacatcacctccctcgccgtcctccgcacccaccgcaaactcggtctcgccaccaaactcatgaccgcctcccagaacgccatggaacaggtttttggtgccgagtacgtgtccctgcacgtgcgcaagagcaaccgcgcggcctacaatttgtacaccgagaccttggggtacaagattcatgatgtggaagctaagtattatgcggacggagaggatgcttatgacatgaggaagcagctcaaggggaagcagccgcagcaacagcagcaccatcatcaccatcaccaccaccaccaccatcacgaacatggaggcatgtgttgttccggggggaatgccaaagccacctgattgaatggttaacaggtcgtggaaagaaatgagacttttagtttcgaaatagtaggctgtggttgaattgtgctgtgcaaacttgttgtagatttattgggctgtgttgcctcatttagatataaatttttgctttgctgtcttggtttcggcttcgcgatgcttgaatgaataacaggattgttgcgttttggtgaaaaaaaaaaa

SEQ ID NO: 985 - DNA, 818 bp, Helianthus annuus
gccttaaacaatttcacgttctaaaaacatctactttccacgttaagtgtctttcgcccaaaccaaaccctaacctttcttatcttctcaactgcaactccataatctccgaaattcaacaatggtgtgcatccgcaaggcaacaatggacgacctgctggcaatgcaggcctgcaacctcttctgcctccctgaaaactaccaaatgaagtactatttctaccatatcctctcatggccgcaccttctctacgttgcggaggattacggcggcaaaatcgtcggttacgtgcttgccaagatggaggaggagaccactgaatgtcacggccatattacttcactcgccgttctccgtacgcaccggaagttaggccttgctactaagctcatgaccgctgcgcaaaatgcaatggaacaggtgtttggtgcggagtacgtgtcattgcatgtgaggaagagcaaccgtgcagcattcaatctgtacacggagacactaggatacaagatccatgacatagaggcaaagtattacgctgacggggaggatgcatatgatatgcggaagcagttgaagggaaagcatcaacatcagcaccaacaccaacaccaacaccatcatcaccaccaccatcatggtgggggttgttgctccggagatgccaaagccgaatgaagatttatactttatttcagtgtcagttgttttgtatacttggtgttgaggcacacaggttacccatattagggtgataactttatgataatatggtatgcttgttctgtttttgtctaataaaaggctatgcatattgaca

SEQ ID NO: 986 - DNA, 876 bp, Helianthus annuus
taagtgtctttcgcccaaaccaaaccctaacccctcttatcttctcaactgcaacaccataatctccgaaattcaacaatggtgtgcatccgcaaggcaacaatggacgacctgctggcaatgcaggcctgcaacctcttctgcctccctgaaaactaccaaatgaagtactatttctaccatatcctctcatggccgcaccttctctacgttgcggaggattacggcggcaaaatcgtcggttacgtgcttgccaagatggaggaggagaccactgagtgtcacggccatattacttcactcgccgttctccgtacgcaccggaagttaggccttgctactaagctcatgaccgctgcgcaaaatgcaatggaacaggtgtttggtgcggagtacgtgtcactgcatgtgaggaagagtaaccgtgcagcattcaatctgtacacggagacactaggatacaagatccatgacatagaggcaaagtattacgctgacggggaggatgcatatgatatgcggaagcagttgaagggaaagcatcaacatcagcaccaacatcaacaccaacaccatcatcatcaccaccatcacggtgggggttgttgctccggagatgccaaagccgaatgaagatttatactttatttcagtgtcagttgttttgtatacttggtgttgaggcacacaggttacccatattagggtgataactttatgataatatggtatgcttgttctgtttttgtctaataaaaggctatgaatattgacatttttgctgggtgcttcattgatatttgaatggtgttgagcatgtgaaaggggaccgaagtactaatattttatctgtgcttgtttacatctaaatcagtt

SEQ ID NO: 987 - DNA, 833 bp, Cynara scolymus
cgggatgacccagttttttctccaaatcaggcaaaccctagccccctttttccctgaagaagcttgagaatcgaaattgaaaatggtgtgcatacgaaaggcaacgattgacgatctgcttgcaatgcaagcctgcaatctcttctgcctcccggagaattaccaaatgaaatactacttctatcatattctttcttggccgcagctcctttacgtcgccgaagattatggcggcaagatcgttggatatgtgctcgccaagatggaagaagagagcactgagtgtcacggccacatcacatctcttgctgttctccgtacgcaccgtaagttagggcttgcaaccaagctcatggctgctgcacagaacgccatggaacaggtgtttggtgcggagtatgtgtcactgcacgtgaggaagagtaacagggcagcattcaatttgtacaccgagacactggggtacaagatccacgacatggaggccaagtattatgcggatggagaggatgcatatgatatgaggaaacaattaaagggaaaacatcaacatcagcatcagcatcagcatcaacaccagcaccaccaccaccaccatggtggcggttgctgctctggagaggcgaaaactgagtgatgaaggtaaaatctaagtcattgaagaaatattgtcgtttcttatactcattttgcattcccaattcgtgactttagacaagagaatgtttgttttcgttgatcatcattgagctaatcttagtatttgttgtttttggaatgattaaagcaaagtttgcattctcatattagtgataaagtaactctgtgattgg

SEQ ID NO: 988 - DNA, 909 bp, Flaveria ramosissima
agtttactcttatatatatcgcaaatctaatttcctctccaaatctatccccctttcgtccaaaccaaatccctaactcctcatcttcttccagcaaaccctaatcaaacaaaaaatggtgtgcatacgcaaggcgacaatggacgacctgctggcaatgcaggcgtgcaacctcttctgcctccctgaaaactaccagatgaagtactacttctaccacatcctctcatggccccatctcctctacgtcgccgaagactacggtggcaagatcgtcggctacgtcctcgccaagatggaggaggagaccaccgagtgtcacggccacatcacctccctcgccgtcctccgtacccaccgtaagctcggcctcgccactaagctcatgaccgctgcacaaaatgccatggaacaggtgtttggtgctgagtatgtatcattgcacgtgaggaagagtaaccgtgcagctttcaatttgtataccgagaccttaggatacaagatccacgacatagaggcaaaatactacgcagatggagaagatgcatatgatatgaggaagcagctgaaggggaagcatcaagatcagcaccaacatcatcaccaacatcatcaccatcaccaccaccatggtggtggttgttgctctggtgatgcaaaagcagaatgaagaaggtatgcttttagacctgaaaagaaggtcatcataacttataaatcatcgcagtgtccccttttttaatatggttggtatttgaggcaaacaattacccttgatttgggtgataactttatgatatgcatcttattggtagtgttggccgtcaggtgatgtatgtttgttctatttttttgttcaataaactcatgaatattgttgttttttgctgagtgtttcaatccaaggtt

SEQ ID NO: 989 - DNA, 1082 bp, Vitis vinifera
tccttgaaagcccaatcccaaatccaagcccaagcccaatcacagtgccaacacagtatagctaattgcagattacaaaagccgaagccatttccgaagcttctcttcctcagcttctcaaaccctagccctaaccctcgaaatcctaggattcagtccaccaacgatcaacaatggtttgcatacgcaaagcgactatcgacgacctccttgcaatgcaagcttgcaatctcctctgcctcccagagaactaccagatgaagtactacctctaccacatcctctcgtggccacagctcctctacgtcgccgaagattacaacggccgcatcgtcggctacgtgctcgctaagatggaggaggaaagctccgagtgccacggccacatcacctcccttgccgtgctccggacgcaccgcaaactcggcttggccaccaagcttatgactgccgcgcaaaacgccatggagcaggtgttcggggccgagtacgtctcgctacatgtgcggaagagtaatagggcagcgttcaatttgtatacggagaccctgggctataagattcatgatgtggaggcgaaatattatgcggatggtgaggatgcgtatgatatgaggaagcagcttaaaggaaagcaagttggccaccaccatcatcatcatcatcaccatcaccaccatcacggaggtggatgttgcggtggagaaccgaagctcgtggagacgaagggggaggcaaaggctgaggcgaaagcagagtgattttggaggtaaattgagtgctgtagtcattggggatgtggtttgggaactatatgtcatttactcataaaacagattaagaattcatggatatggattgataaacatgtttgtacaatggtatgtgccccttttttatgttgtttaaattggatccttgtggctaaatattcttatttatgatcaagtagaattcgttttcgtttggcgttttgtgatggctttttattggggatctgtttttatcaatagtatgagttctgtagttttacgcatggaatataagaaaatatttgctcgggtgcaagtatgagaaaatgg

SEQ ID NO: 990 - DNA, 608 bp, Lotus japonicus
cgtttacacatacccgagagcaaaatcgaatccctatcgtgccggaaccctaaccgtgaaatcgaagcagcagcggcggcggcgacatggtgtgcataaggaaagcgacggtgaacgacctcctggcgatgcaggcttgcaacctgttctgcctaccggagaattaccagatgaagtactacctctatcacatcctctcctggcctcagcttctctacgtcgccgaggactacaacggccgcatcgtcggttacgtcctcgctaagatggaggaagagactaacgagtgccacggccacatcacctccctcgccgtcctccgtacccaccgcaaactcgggctcgccaccaagctcatgaccgccgcccaaaacgccatggaacaggtgtttggtgctgagtatgtctcgctgcatgttaggaagagcaaccgtgcggcgtttaacttgtacacggagacattggggtacaagattcatgatgtggaggctaagtattatgcggatggggaggatgcttacgacatgaggaagcagcttaaggggaagcagttgcatcagcatcaacatccacatcctcatcaccatcatcatcaccaccatcatcac

SEQ ID NO: 991 - DNA, 896 bp, Helianthus annuus
agcgggggccttaaacaatttcacgttctaaaaaaatctactttccacgttaagtgtctttcgcccaaaccaaaccctaacctttcttatcttctcaactgcaactccataatctccgaaattcaacaatggtgtgcatccgcaaggcaacaatggacgacctgctggcaatgcaggcctgcaacctcttctgcctccctgaaaactaccaaatgaagtactatttctaccatatcctctcatggccgcaccttctctacgttgcggaggattacggcggcaaaatcgtcggttacgtgcttgccaagatggaggaggagaccaccgagtgtcacggccatattacttcactcgccgttctccgtacgcaccggaagttaggccttgctactaagctcatgaccgctgcgcaaaatgcaatggaacaggtgtttggtgcggagtacgtgtcactgcatgtgaggaagagtaaccgtgcagcattcaatctgtacacggagacactaggatacaagatccatgacatagaggcaaagtattacgctgacggggaggatgcatatgatatgcggaagcagttgaagggaaagcatcaacatcagcaccaacaccaacaccaacaccatcatcaccaccaccatcatggtgggggttgttgctccggagatgccaaagccgaatgaagatttatactttatttcagtgtcagttgttttgtatacttggtgttgaggcacacaggttacccatattagggtgataactttatgataatatggtatgcttgttctgtttttgtctaataaaagcctatgcatattgacatttttgctgggtgcttcattgatatttgaatggtgttgagcatgcgaaaggggaccgaagtactaatattt

SEQ ID NO: 992 - DNA, 618 bp, Cleome gynandra
agctagcccgcacaacaaccccgaaaccctaatctcaaacctcagagaagtaaacgaccggcgacagatggtgtgcatacggcgagctacagtggacgatctcctggcgatgcaagcatgcaatctcatgtgtctgccggagaattaccagatgaagtattacctgtaccacatcctctcatggcctcagctcttgtacgtcgccgaggactacaatggccggatcgtcggctatgtcttggcaaagatggaggaagagagtaacgagtgccatggccatatcacttcgctcgccgtgcttcgtacccataggaagctcggtctcgccaccaagctcatgaccgccgctcaggccgccatggaacaggtttatgaagcagagtatgtctcgctgcacgtgaggagaagtaacagagctgcattcaatctgtacacacagactttggggtacaagattcatgatatagaagcaaagtattatgcagatggtgaggatgcctatgacatgcgcaaacagcttaaggggaagcaaagccaccaacatgggcatcaccaccaccatcaccatggcggtggatgttgttcgggtgatgtcaaagctgcagacactaatcaagc

SEQ ID NO: 993 - DNA, 667 bp, Ambrosia trifida
acaacaatggtgtgcatacgcaaggcaacaatggacgacctactagcaatgcaagcctgcaacctcttctgcctgccagaaaactaccaaatgaagtattatttctaccactatcctatcatggccacaccttctctacgtcgctgaagactacataaaaagatcgtcggttatgtccttgccaagatggaggaagagaccaccgagtgccacggccatatcacctccctcgccgttctccgtacccatcggaagctcggcctcgccactaagctcatgaccgctgctcaaaacgccatggaacaggtgtttggtgccgagtatgtgtcactgcatgtgaggaagagtaaccgtgcagcattcaatctgtacacggagacactaggatacaagatccatgacatagaggcaaaatattatgctgatggagaggatgcatatgatatgaggaagcagttgaaggaaaaaccgcagcatcaacaccaacaccaacaccatcatcaccaccaccatcatggagggggttgctgctccggagatgccaaagccgaatgaagaaggtataatatagatatactttattgcaatatcacttgttttgtatacttggtattgaggcacacaggttacccatgattagggtactaactttatgataacgtggtat

SEQ ID NO: 994 - DNA, 1103 bp, Sesamum indicum
aaaaaaaaataattagaccacaaagctcacaaactagttccccgtccttccccaaatccctaaatccaagaccaaaaccctaattcctaaccgtaatttcttttgctcctgtcaggaaacgcgtcagttgagtgaagatggtgtgcataaggaaagcaacggtggatgacttgctggcgatgcaggcctgcaatttgttctgcctgccggagaactaccagatgaaatactacttataccacattctctcatggccgcagctcctctacgtggcggaggattacaacggcaagattgtgggctacgtcttggccaaaatggaggaggagactacggagtgccacggccacatcacctcgctcgccgtcctcaggacacaccgcaagctcggcctggccactaagctcatgactgctgctcaaaatgcaatggaacaggtatatgctgcagaatatgtgtcattgcatgtcaggaagagcaatagggcagcgtttaatttgtacactgagacactaggctacaagatccatgatgtggaggccaaatattatgcggatggggaggatgcttatgatatgaggaagcaactcaagggtaggaagcatcaccaccaccaccaccaccaccaccatcatggtggtggatgctgttccgccgaaacgaaggcagatgaaaagcctggatcaactgaggccaaaactgagtgatcagaactcattcaggggtcagagttttgttattaatgctgtatgtgagtatcgaatcctctctacactttgcttgatttaataaaaattgcgctgaaagagccctttgtttattaatttattttgtcagtggaagctcaaataattgtgatacatacacatgctttaacacatggcacattttgggtctctatgtgatggcgcaggcttctttagtggtagtcatgcatttggagtttattctttactatttggagcctgaacaattggtttgggcatgcctatttgtttaggtttctcctacagggtattcatggtgtaacttagaaagcttttaaatattcgtcaatttctctctatcttctcgggtatcattgcatatttgaatgtggcagc

SEQ ID NO: 995 - DNA, 877 bp, Artemisia annua
aataaataaagaattgggcgaaaaagttttgttataaatcagatccacccatttattcgaaacttaaccaccaaatccctaataataaccctcttttctcctcctcttgacaagagaaaatcaagaagaaaagatggtgtgcatcaggaaagcaacgatggacgacctcctagcaatgcaagcgtgcaacttgttctgtctccctgaaaactaccagatgaaatactatttttatcatatcctatcatggcctcatcttctgtatgttgcagatgattatggtggtaagattgttggttatgttttagctaagatggaagaagaaactacagagtgtcatggtcatatcacttctcttgctgttttaaggactcataggaagttgggtcttgctactaaactcatgactgctgctcagaatgctatggaacaggtttttggtgctgagtatgtgtcactacatgtgagaaagagcaaccgtgcagcattcaatctgtatactgtgacacttggatacaagatcaatgacatagaggcaaaatattatgctgatggagaggatgcatatgatatgaggaagcagttgaagggaaagcctcagcatcagcatcaccaccaccaccaccatcacgctggtggttgctgttctggagacgcaaaagctcattgaaaagagtaagatttagttatgaaagatgattttcatcattgcttgttcgttttattgtagtgcaacttgttatgtatacttcgtctttgagacaaacaggtctatcagtattcggatgtttaactttttgataatgcgcatctcattggttgtgttttgtggtgcctatgtttgttctatttctgttcaataaaaagcagaatgtac

SEQ ID NO: 996 - DNA, 767 bp, Petunia hybrida
cacaggaggtgtagaagagttgagtgagagcaccatcaaatcagagaaccctaaccctagacttttcctttttcttagcgcgatggtgtgcatacgcaaagccacaatagatgatttgcttgcaatgcaagcttgcaatttgctatgcctacctgaaaactaccaaatgaaatactatttctaccacatactttcttggccacagcttctttacgttgctgaagattacaatggtaaaattgttgggtatgtgttagcaaaaatggaagaagaaacctctgagtgtcatggacatatcacttcccttgctgttcttagaactcatcgcaaattgggtattgctactaagctcatgactgctgctcaaaacgccatgggagaggtgtttggagcagagtatgtgtctctgcatgtgaggaagagcaacagagctgcatttaagttgtacacggagacattacagtacaagattcacgacatggaagctaagtactatgctgatggggaagatgcttatgacatgaggaagcaactaaaaggcaagaagcaccatcaacatgcccaccaccaccaccatgctggtggatgttgttctggggaggcaaaggttggagcaacatagagctgcagaaaggaaaaaagagtgattgtggatgtaacttttgccaaggattggtatctctgcttattgggcgttcaagacctgttgctattgtaagcttttaatgagagtgaaatgtgtcttgagaagttgaacttatactatt

SEQ ID NO: 997 - DNA, 552 bp, Flaveria ramosissima
atggtgtgcatacgcaaagcaacaatcgatgacctccttgcgatgcaagcctgcaacctcttctgcctccctgaaaactaccaaatgaaatactacttctaccacatcctctcttggccgcagctcctctacgtcgccgaggattacggtggcaagatcgtcggatacgtgctcgctaagatggaagaagagaccactgagtgtcacggccacatcacgtccctcgctgttctccggactcaccgtaagttagggcttgcaaccaagctcatgcttgctgcacaaaacgctatggaacaggtgtatggggctgaatatgtttcgctgcatgtgaggaagagtaacagggctgcattcaatctgtacaccgagacacttggatacaagatccatgacatggaggctaagtattatgcagatggagaggatgcatatgatatgaggaaacaattgaagggaaaacagcagcaccagcaacaacaccaccaccaccatcatcatcaccaccaccaccaccacggtggtggttgctgctctggcgaggcaaaagcc

SEQ ID NO: 998 - DNA, 1050 bp, Triphysaria pusilla
agccctttttatattgtacatttgtattaaagaaactcatccaagacctcgtctaaccctaacccctctccagcccctgccgattccaaatccaatagaaacaaaaccctaaccctcaaatcctctaccctaaattccaatcgattgaaccaagcgaaatggtttgtatcaggaaagcaacggtggatgacttgctggcgatgcaggaatgcaatttgttctgcctgccagagaactaccagatgaaatactatctgtaccacattctatcatggccccagctcctctacgtcgccgaggactacaacggcaagattgtaggttatgttctggccaagatggaggaagagtcgaacgagtgccacggacacataacctcgctcgccgttctcaggactcaccggaaactcggcatcgccactaagctcatgaccgctgctcaaaacgccatggatcaagtgtacgaagctgaatacgtgtcgcttcatgtcaggaaaagcaacagggctgcatttaatttgtacacagagacgttaggatacaagattcatgatgtggaggcaaaatactacgctgatggagaggatgcttatgatatgaggaagcagttgaagggtaggaagcagcaccatcaccaccatcatcatggtggcggatgttgctccggagacttgaaagcagatggaccagctgaggccaaaacggtgtaacgaacatgggactgaaaattgtcatgttattctaaagatcgtgcatgttcaacatatttccccgtcgtaagccgtcattactgtttaagatcaaggtttgaagttatgcaggatttttggatatttatattaagtagcgatgactattatcgtgctctcttctatttgttctatgcatggtttgcaattcagaccgtattgtgagtttcttttcctttgctatgccagattgccaggtatgatatactagttgaatgtgattaatggtaatgccagtagaggattaagaagttttctaataaacttactgttttgctttagcaaaaaaaaaaaaaaaaaa

SEQ ID NO: 999 - DNA, 626 bp, Sarracenia psittacina
taaacaaccatggtgtgcatacgcaaggccaccgtcgaagacctcctagctatgcaagcctgcaacctcttttgcctccccgaaaactccagatgaagtactatttctaccacatcctgtcgtggccacagctcctctacgtcgcggaggactacggcggcaagatcgtcggctacgtcttggccaagatggaggaagaacctccgagtgccacggccacataacctccctcgccgtcctccgcactcaccggaaactcggtctggccaccaagctcatgactgccgccagaatgccatggacaggtctttgccgccgagtacgtctcattgcacgtcaggaagagcaatcgagcggtcgtttaattgtacacggagacgctgggatacaagattcacgatgtggaggcgaagtactatgccgacggcgaggatgcgtacgatatgaggaagcagctgaaaggtaagcaccaccaccaccacaaccgcatcaccatcaccaccaccaccaccatcacggtggtggctgttgctccggtgaggcgacggacggaaaggtaggcggtgggaggaggaaggacgggaagttaggaagggcgggtacttcgttcccggaggttggtattc

SEQ ID NO: 1000 - DNA, 833 bp, Capsicum annuum
tcagcatagtagtgctcggatatcactcgaaaccctaacaatcccttgagcttaagattccagaaatggtgtgcatacgaaaggcaacaatagacgatttacttgcaatgcaagcatgcaatttgctatgcctgcctgaaaactaccaaatgaaatactatttctatcacatactttcatggccacaacttttatacgttgctgaagattacaatggtaagattgttggatatgtgttagctaaaatggaagaggaaactactgagtgtcatggacatatcacttcacttgccgttgttaggactcatcggaaacttggtttggctactaagctcatgaccgctgctcagaatgccatggaacaggtgtttggagcagagtatgtgtctctgcatgtgaggaagagcaacagggctgcatttaagctgtatacagagacgttaggatataagattcatgatatggaagccaagtactatgcagatggggaagatgcttatgatatgaggaaggaattgaagggcaagaagcaccaccatcaccaccaccaccaccaccatggtggtgggtgttgctctggtgaggtgaagtttgtaccaaaggaaggagcagcagaagcaaaagcagtgtaattgtggatgtaaactttgggacttagaaattgccccgagtcaatttgcttgcaagaaatatatgttactactgtatgtttacttgaaacaaccacactgtttaaggtttgattaatgcttttggtttttctgatattctattcacccctcacatcttttttctaaggaggatgcatgtactgaaactgggcatttttgcgt

SEQ ID NO: 1001 - DNA, 783 bp, Capsicum annuum
cttaagattccagaaatggtgtgcatacgaaaggcaacaatagacgatttacttgcaatgcaagcatgcaatttgctatgcctgcctgaaaactaccaaatgaaatactatttctatcacatactttcatggccacaacttttatacgttgctgaagattacaatggtaagattgttggatatgtgttagctaaaatggaagaggaaactactgagtgtcatggacatatcacttcacttgccgttgttaggactcatcggaaacttggtttggctactaagctcatgaccgctgctcagaatgccatggaacaggtgtttggagcagagtatgtgtctctgcatgtgaggaagagcaacagggctgcatttaagctgtatacagagacgttaggatataagattcatgatatggaagccaagtactatgcagatggggaagatgcttatgatatgaggaaggaattgaagggcaagaagcaccaccatcaccaccaccaccaccaccatggtggtgggtgttgctctggtgaggtgaagtttgtaccaaaggaaggagcagcagaagcaaaagcagtgtaattgtggatgtaaactttgggacttagaaattgccccgagtcaatttgcttgcaagaaatatatgttactactgtatgtttacttgaaacaaccacactgtttaaggtttgattaatgcttttggtttttctgatattctattcacccctcacatcttttttctaaggaggatgcatgtactgaaactgggcatttttgcgt

SEQ ID NO: 1002 - DNA, 743 bp, Salvia sclarea
gcacgagggcgaaaccctaaccatggtgtgcataaggaaagccacagtcgatgatctgctggctatgcaggcatgcaatctgttctgcttgccggagaattaccagatgaagtactacttctaccacatcctttcgtggccgcagcttctctacgtcgccgaggattacaacggaaaaattgtcggctatgttcttgccaagatggaggaggagaccaccgagtgccacggccacatcacctccctcgccgtcctcagaactcaccgcaaactcggccttgccactaaactcatgactgctgctcagaacgccatggaacaggtgtatggggcagagtatgtttcattgcatgtgaggaaaagtaacagggctgctttcaatttgtacactgaaacattgggatacaagattcatgacgtggaggccaaatattatgctgatggagaagatgcttatgatatgagaaaacaattgaagggtaggaagcaccatcaccaacaccaacaccaacaccatcatcaccaccatggcggtgggtgttgttctgcagatgctaagtcagttgagaagcccggatcagcagaaatgaaatcagagtgattataattcattccagtggtcagaattttgttatattgcttatctggtgcagaattcgatccgttttggtagcttggatgtatgaaatatgtagtgaggcaaatgaagtgatggtaatgggatatagaataacaatgctgga

SEQ ID NO: 1003 - DNA, 903 bp, Nicotiana tabacum
gactcggttcttttttgagctagagggttttttgcttttcagtttagcggctcacacagtagagttgccgtaaagcctcaatttatcattaaagaagcgtccaccatagttaggatcagcgaaccctaaccctagctttgcgagatggtgtgcatacgcaaggcgaccatagatgatttgctggcaatgcaagcctgcaatctgctttgccttcccgaaaactaccagatgaagtactacttctaccacatactctcttggccgcagcttctgtacgtggccgaggattacaatgggaagattgtgggctacgtattggctaagatggaggaagaaacctctgagtgccatggacacatcacctccttagccgtactcaggactcaccgtaaacttggtatagctactaagctcatgaccgctgctcaaaacgccatggaacaggtgtttggggcagagtatgtgtctctgcatgtgaggaagagcaacagggctgcatttaagttgtacacagagacattacagtacaagattcacgacatggaagctaagtactatgctgatggggaagatgcttatgacatgaggaagcaattaaaaggcaagaagcaccatcagcatcaccaccaccaccaccatcatgctggtggatgttgttctggggaggtaaaggtagtagctacggagagaactgcagaagggaaaaaggagtgattgtggaggaacttttgccaagagattgtgtagtctgcttaatgggcattcaagactggaattgttgctattgtatgcttttaataagagagtaacgtgtcttgaaaagttgaacacatgcttatggcatttgttcttctttggttgtatgtgttcttttgtgtctcttgaatgaaagagcaaggcaaa

SEQ ID NO: 1004 - DNA, 1013 bp, Coffea canephora
ggctcttccacccccttgtattcattgattccaagaaaattgttgaagccagaaaccctttccaaaatcccatcgaaatccaatcaaaatccatcatcgaagggaattaacaatggtttgtattcgcaaggcaacagtggatgacctattggctatgcaagcctgcaatctcttctgtttaccagagaattaccagatgaaatactacttctaccacatactttcttggccacagctcctctatgtcgctgaagattataatgggaaaattgtgggatatgtgttggctaagatggaggaggaaagctctgagtgccatggccatatcacttctcttgctgttctgaggactcataggaaacttggtttagctacgaaattaatgactgctgcccagaatgccatggaacaagtgtatggagcagaatatgtgtcgctgcatgtgagaaaaagtaatagggctgcatttaatttgtacacggagacattgggctacaaaattcatgatgtggaggccaagtactatgcggatggggaggatgcttatgatatgaggaagcagttgaagggtaaaaaacatcagcaccatcaccaccaccaccaccaccatcaccatcatcatcaccatggtggtggctgttgctccggagaagctaaggtcgaaggaaaagcaggtgaaccggaagcaaaggcagagtgatgatctcatcgagaatattgctgagtttcttgtaggatggtattcttggtaatactcaaagcaaatgtaatcgtaatattagtagcttttacttcttaaaagtgtgtcataacatagtcaaatttgtggttctcaaactatgtgcttgtaatgaaattggttacctgatggtgattagtttttctgaagctgatctattgatctcttaaaccataaattagctacaggcatgctacacatttagtatgaaatccaggggatactttattaatcatagttggcttttggttgcatgtattacatgattgtccaa

SEQ ID NO: 1005 - DNA, 959 bp, Catharanthus roseus
gcatctgaagtcccgtagccctaaaaccctctgtgagcctcacccaaatctagccacaaccatggtatgcattcgcaaggccacagttgatgatctattggctatgcaagcttgcaatctattctgcttgccggagaattaccagatgaaatactacttttaccacatactttcatggccgcagctgctttatgttgctgaggattacaatgggaaaattgtcgggtatgttttggctaagatggaagaggagagctccgagtgccacggtcatatcacctctcttgctgttcttaggactcataggaaactcggtttggcaactaagctcatgactgcggctcaaaacgccatggaacaggtgtatggagcagaatatgtgtctctgcacgtgagaaaaagtaacagggctgcgtttaatttgtacacggggacattaggatatgagattcatgacgtagaagcgaagtactacgcagatggggaggatgcgtatgatatgcgaaagcagttgaggttaaaaagacaccatcatcaacatcagcatcatcatcatcaccatcatcatggaggtggctgctgctctggagaggtgaagataggagggaaggccacagagacagaggctaaggcagagtaacagcggcagtaattggaggaatttagcttgtttacttacagaaattagtgttctatgagtaaaagtagtatattgacattgttgtcactgtatgtttcttgcaagtttgtttagaaagtttgaaaattcttgcattcagattgttatgatgtacgtgattatttgatgtaaaactgcagtctgggctttgaatcgtctttacgaatggatttggtacgtgcacaccacagacataatgtcgtcctgagaatatatttctattctgtgtttgataagtgagaatgcaataactaataatactaatcaattggctgatgca

SEQ ID NO: 1006 - DNA, 1065 bp, Citrus sinensis
  misc_feature (873)..(873): n is a, c, g, or t
  misc_feature (908)..(908): n is a, c, g, or t
  misc_feature (913)..(913): n is a, c, g, or t
  misc_feature (915)..(916): n is a, c, g, or t
  misc_feature (949)..(949): n is a, c, g, or t
  misc_feature (992)..(992): n is a, c, g, or t
ggggaccacggaaaccaaatcgacgaaactctaaccctaaacccctaaaccaaaaaaaaagaaaaaaaaggaaaaagagtctatcaaaatcaacagaagccatggtgtgcatacgcaaggcgacagtagacgatttgcttgcgatgcaagcctgcaatttgttctgtcttccggaaaattaccagatgaagtattatttttaccatattttatcgtggccgcagctgctctacgtggccgaagattacaacggccgtattgtcggctacgtattggctaagatggaagaagaaagcaacgagtgtcacggccacatcacctctctcgccgtacttcgcacgcatcgcaagttaggattggccactaagcttatgaatgctgcacagtcagctatggaacaggtttttggagcagagtatgtctcactgcatgttaggaagagtaaccgggcagcatttaatttgtacacagaaactttaggttataaaattcatgatgtggaggcaaagtattatgctgatggagaggatgcatatgatatgcggaagcagctaaaaggaaagcagagtcatcagcatgggcaccaccaccaccaccaccaccatcatcatcatcatcatggtggtggatgctgctctggtgaggtgaaaagtgcagagacaaggggtgctgaggcaagaggagatgcaaaatcagattcgaaagccagcacgaaatcagattcgaaagcgagctgactaaggtaaaatgagtattcagagaggtggaggctggttatttgttgtatttgttggagcattattgggattattaaatatttgtgttgtgttgcataataatgcaccggaatgagagtcatatggctatttttgntccctaattgacactaaaattattacgatgacctncttgngnnggttggctgtggtgttctttcttttcgcccggngcggaggcgaggggttgtcgtccttgatccactggagcctcanccgggggggggcgggcgtggagcatgcagctggcgttgccgtgggctgcgcgcggcaacccctcctaaaattg

SEQ ID NO: 1007 - DNA, 1131 bp, Citrus clementina
gtgaacagcccaattggcggcccaattgagggcacgatatcgtcaatattcatcggccttgacttgctaactcttctcgctcaccacggaaaccaaatcgacgaaaccctaaccctaaacccctaaaccaaaaaaaaaaagaaggaaaaagagtcgatcaaaatcaacagaagccatggtgtgcatacgcaaggcgacagtagacgatttgcttgcgatgcaagcctgcaatttgttctgtcttccggaaaattaccagatgaagtattatttttaccacattttatcgtggccgcagctgctctacgtggccgaagattacaacggccgtattgtcggctacgtattggctaagatggaagaagaaagcaacgagtgtcacggccacatcacctctctcgccgtacttcgcacgcatcgcaagttaggattggccactaagcttatgaatgctgcacagtcagctatggaacaggtttttggagcagagtatgtctcactgcatgttaggaagagtaaccgggcagcatttaatttgtacacagaaactttaggttataaaattcatgatgtggaggcaaagtattatgctgatggagaggatgcatatgatatgcggaagcagctaaaaggaaagcagagtcatcagcatgggcaccaccaccaccaccaccatcatcatcatcatcatggtggtggtggatgctgctctggtgaggtgaaaagtgcagagacaaggggtgctgaggcaagaggagatgcaaaatcagattcgaaagccagcacgaaatcagattcgaaagcgagctgactaagggtagatggcactagaagattatgctgtattgctgtttgtgcatcaagcgtcaacacatcaactatctacaaaagtcaaagtcttgatttatatggccaagtagacaagtgagtctcgtagtataataattgattattgtgcatattatagtcggggctcggataatcagttactggaaaaagttgtgtttgcagtgtccaagttggtggctgtaatattcaaccgtgctctattattctctcttttcacattcttgaagacttgaactgttggagatcattttgccttacttaatacataaaccggtttttttt

SEQ ID NO: 1008 - DNA, 1135 bp, Citrus sinensis
gtgaagagcccaattggcggcccaattgagggcacgatatcgtcaatattcatcggccttggcttgctgacctttctcgctcaccacggaaaccaaatcgacgaaactctaaccctaaacccctaaaccaaaaaaaaagaaaaaaaaggaaaaagagtctatcaaaatcaacagaagccatggtgtgcatacgcaaggcgacagtagacgatttgcttgcgatgcaagcctgcaatttgttctgtcttccggaaaattaccagatgaagtattatttttaccacattttatcgtggccgcagctgctctacgtggccgaagattacaacggccgtattgtcggctacgtattggctaagatggaagaagaaagcaacgagtgtcacggccacatcacctctctcgccgtacttcgcacgcatcgcaagttaggattggccactaagcttatgaatgctgcacagtcagctatggaacaggtttttggagcagagtatgtctcactgcatgttaggaagagtaaccgggcagcatttaatttgtacacagaaactttaggttataaaattcatgatgtggaggcaaagtattatgctgatggagaggatgcatatgatatgcggaagcagctaaaaggaaagcagagtcatcagcatgggcaccaccaccaccaccaccaccatcatcatcatcatcatggtggtggatgctgctctggtgaggtgaaaagtgcagagacaaggggtgctgaggcaagaggagatgcaaaatcagattcgaaagccagcacgaaatcagattcgaaagcgagctgactaagggtagatggcactagaagattatgctgtattgctgtttgtgcatcaagcgtcaacacatcaactatctacaaaagtcaaagtcttgatttatatggccaagtagacaagtgagtctcgtagtataataattgattattgtgcatattatagtcggggctcggataatcagttactggaaaaagttgtgtttgcagtgtccaagttggtggctgtaatattcaaccgtgctctattattctctcttttcacattctcgaagacttgaactgttggagatcattttgccttacttaatacataaaccggtttttttt

SEQ ID NO: 1009 - DNA, 923 bp, Solanum lycopersicum
ggccattctatgaagcccaaataaaaagcccaaattgctaattgcctatcaattcctgacgaacacgatacagttcccctcttgtaaaaatctgtgcaaaccctaattatcgtgtgagattgagattgaaaaatggtgtgcatacgaaaggcgacgatagatgatttgcttgctatgcaagcatgcaatttgttatgccttcctgagaattaccagatgaagtactacttctaccacatactttcgtggcctcagcttctgtacgttgctgaagattacaatggtaaaattgtgggatatgtgttagcaaaaatggaagaggaaaccactgagtgccatgggcacatcacttcccttgccgtagtcaggactcaccggaaacttggtttggctactaagctcatgaccgctgctcagaatgctatggaacaggtgtttggagcagagtatgtgtctctgcatgttaggaagagcaacagggccgcatttaagctgtatacagagacattaggatataagattcatgatatggaagccaagtactatgcagatggggaagatgcttatgatatgaggaaggaattgaagggcaagaagcaccaccagcatcaccatcaccaccaccaccacggtggtgggtgttgctctggtgaggtgaaggtaggaccaaaggaaggagcagcagaaacaaaagcagcataattatggacctaaagtttgggacttggaaatttcctggagttcacaagaaatatatgttactaatgtatgtgttctacatgaaacaactacaccttgtaaggttggaacattggtacaagtaatgcttttggtttttctgatattgtattcacatttcatatctattttctgaagaaactattgaaaaatgaatttccaaaagttatccatcttgattaaat

SEQ ID NO: 1010 - DNA, 566 bp, Ipomoea nil
acaatttctgctcaaaccctaagcaggaagaagaaggtttagaaggcaacaatggtgtgcatacgcaaggcgacgatcgacgacttgctggcgatgcaggcgtgcaatctgatgtgcttgccggagaactatcagatgaagtactacttctaccacatcctgtcatggccacagctgctctacgtggcggaggactacaacggcaagatcgttggctacgtcctggccaagatggaggaggagacctccgagtgccacggccacatcacctccctcgccgtcctccgcacccatcgcaaactcggcattgccaccaagctcatgaccgctgctcagaacgccatggaacaggtgtttggggctgaatatgtgtcactacatgtaaggaaaagtaacagggccgcattcaagttgtacacggagacattaggatacaagattcatgatgtcgaagcaaagtactatgcagacggtgaagatgcttatgatatgcggaagcaactgaagggtaagaaacatcaccaacaccaccaccaccatcaccatcaccatcaccatcatcacgg

SEQ ID NO: 1011 - DNA, 989 bp, Quercus alba
ctcattccccttccttttctctctctccacaaaaatccccaaatcaaaaactcccaccacacagaaaaaaccctaaccctaaacccccaaattcaaaatcccccacaaaaatcaaccaaatcaaagaccaacccaacaatggtgtgcatacgcaaagccacaatcgacgatctcttagccatgcagacctgcaatctcttctgtctcccggagaattaccagatgaagtactatctctaccacatcctctcatggccgcagcttctctacgtggccgaagactacaacggcaagatcgtgggctacgtgctagccaaaatggaagaggaaagcaccgagtgccacggccacatcacgtcgctcgcggtgttgcgcactcaccgcaagctcgggctggcgaccaagctcatgagcgcagctcagaacgccatggagcaagtgtttggagctgagtatgtgtcgcttcacgtgaggaagagtaatagagctgcgtttaatttgtacacggagactttggggtataagattcatgatgtggaggctaagtactatgcggatggtgaggatgcttatgatatgaggaagcaattgaaggggaagcagtatcatggacatggacatgggcatgggggacatgggcatcatcatcaccatcatcatgagcatggaggtgggtgttgttcaggggagagggtggaaccaaaagggactgggaagaagtaggccagggtgaactgaggtgaagtggtactgctattcggttgtttttttttttttttggttgtattttgttgggttccattatgtgaggaataatggttaatgggtatttgtttaattatacattgaacttaatttacaatgatgggcatggatatctaatgttatatgcacttttttgtgtcaattgtattagattcagttgccaaggttatatctttttgggtcctgtttattgtggttgttttagtgaggaataatggttaatt

SEQ ID NO: 1012 - DNA, 1088 bp, Quercus alba
cgtgtctctaggaattcccgggatcaaaattgcacaacccatctcaatctatcgtgaaagcccaaaaccaaatcccaatatttagaatccaaatacctcttttacatttcactctcattcccccttccttctctctctctccacaaaaatccccaaatcaaaaactcccaccacacagaaaaaaaaccctaaccctaaacccccaaattcaaaatcccccacaaaaatcaaccaaatcaaagaccaacccaacaatggtgtgcatacgcaaagccacaatcgacgatctcttagccatgcagacctgcaatctcttctgcctcccggagaattaccagatgaagtactatctctaccacatcctctcatggccgcagcttctctacgtggccgaagactacaacggcaagatcgtgggctacgtgctagccaaaatggaagaggaaagcaccgagtgccacggccacatcacgtcgctcgcggtgttgcgcactcaccgcaagctcgggctggcgaccaaactcatgagcgcagctcagaacgccatggagcaagtgtttggagctgagtatgtgtcgcttcacgtgaggaagagtaatagagctgcgttcaatttgtacacggagactttggggtataagattcatgatgtggaggctaagtactatgcggatggtgaggatgcttatgatatgaggaagcaattgaaggggaagcagtatcatggacatggacatgggcatgggggacatgggcatcatcatcaccatcatcatgagcatggaggtgggtgttgttcaggggagagggtggaaccaaaagggactgggaagaagtaggccagggtgaactgaggtgaagtggtactgctattcagtttttttgtgtatttgttgggttccattatgtgaggaataatggttaatgggtatttgtttaattatacattgaacttaatttacaatgatgggcatggatatctaatgttatatgcactttttttgtgtcaattgtattagattcagttgccaaggttatatcttttttgggtccttgtttatttgtggtttgttttagtgaggaataat

SEQ ID NO: 1013 - DNA, 972 bp, Tabernaemontana elegans
acgaaacccaaaaggacaagcccaagtccaagtcctacacagccctgcttgattttcctatcaaatcttaaacagaaacgccccggtttttatttgtgatccgtcgaaaatccacacgcttagaatctctgccatcaagagccctgaaattcccctaacctagaacgctgtgttatctcatccaaatctagacataacaatggtgtgcattcgcaaggcaacagttgatgatttgttggctatgcaagcttgcaatttgttttgcctgccggaaaattaccagatgaaatactacttctaccacatactttcatggccgcagctgctctatgttgctgaggattataatggaaaaattgtgggatatgttttagctaagatggaagaggagagctctgagtgccatggccatatcacctctcttgctgttcttaggactcataggaaactgggtttggccactaagctcatgacagctgctcaaaacgccatggaacaggtgtacggagcagagtatgtgtctctgcatgtaagaaaaagtaacagggctgcatttaatttgtacacaggaacattaggatacgagattcatgatgtggaggccaaatactatgcggatggggaggatgcttatgatatgagaaagcagttgaagggtagaaagcatcagcatcagcatcagcaccagcatcatcaccatcaccatcatcatggtggtggctgctgctctggagaggtgaagacaggagggaaagctacagaggcagaagctaaggcagagtgatggtggaggtaaaattctgttatggggaattcagttatattataggaatttcatgttgtatggggcaaagaacatgtaatggcattgttgcattattcacttcttgcaattgtgttctgagagtttggaaattttgcattcaaatttgtattgtgataaatggttatgtgattgcttttgcaatgttg

SEQ ID NO: 1014 - DNA, 810 bp, Lactuca sativa
ccatcatctctctatcgtcttctcgcgaacgccgaacaccataccctagatttccatacgcaaagcaagaatggtgtgcatacgcaaagcaacgatggatgacctgtttgcaatgcaggcctgcaacctcttctgtctccctgagaactaccaaatgaaatactacttctatcacatcctctcctggccccagctcctacacgtcgccgaggattacggcggaaagatcgtcggatacgttcttgccaagatggaagaagagaccacggagtgtcacggccacatcacttccctcgccgttctccgtacgcaccgtaagttagggcttgcgacgaagctcatgaccgcttcacagaacgccatggaacaggtgtttggtgcagagtatgtgtcactgcatgtgaggaagagtaatcgtgcagcattccatttgtacacagagacacttggataccagatccatgacatagaggcaaagtattatgcggatggagaggatgcatatgatatgaggaagcagttgaaagggaagcatcaacatcagcatcagcatcagcatcaacaccatcatcaccaccatcatgctggtggttgctgctctggagatgcaaaagccgaatgaagaaggtatgattgagttgtaaaaggatagctgtcatcattgctgagtcacttgtttctgtacacttggtatttgaatttgaggcaggtaagctgtctaggaactttatgctaatgtgcattttttattgctagtgttggtttggtgccatatgtttttcaataaaaaagctgataatattgtcgttt

SEQ ID NO: 1015 - DNA, 1197 bp, Tropaeolum majus
cggccgggggttccacaagagctacgaaaacaaataagaaaatttgcaaaaccctaacgcttgaaaccactctctacagccatcaaccatggtgtgcatccgcaaggcgacgatggacgacctgttggctatgcaggcatgtaatctgatgtgccttccggagaactaccagatgaagtactacctgtaccatatcctttcgtggccgcagcttctctatgtggccgaggactacaacggacgtatagtcggttatgtcctagccaagatggaggaagagagtaacgagtgccatggacacattacatccctagctgtcctccggacacatcgcaagctcggtctagctacgaagctcatgagcgctgctcaagcagccatggagcaggtatttggagctgagtacgtctcattacacgtgagaaagagcaatcgggcagcctttaatctgtacacagggacattagggtatcagataaatgatgtggaggctaaatactatgccgatggggaagatgcatatgatatgcgtaaacaactaaaagggaagcaaactcatcatcatgggcataatcataatcatcatcaccatggtggtggatgctgttcgggtgatgccaagagtggtgatgcaacccaagtgagaggggaagctaaatcagactcaaaagctagcacaaaatcagagtcgaaagcaggatgatgatactcttccgtcttcgtatggagaaaagtcgatatcatagcttgtttagtatgtctgtttcatcattattattggtagtaaaatacattacttcatctgtttgcagggatggaataatacacttactagcacactagatctgtgatcagtgtggtcttgtgctttgtgttgacaaatgaacttcttgtgtctacgatattgagtttgttggcatatactttggctttatttcgtcttaaatcaattttctccctcaatcccaacgcaaaatgaatccagataaactgttaaaagtgaatccagataaactgtttatactgtataccaaaggtagtttattatcttccttggagttggatttgagttatcttttggtaaaggtttgtggatgttttataggatttttatatccggtgtttaaaagtagtgatgaaatttggtctctggattcaaacaagatcagagttctctaggacattttcatgtgctaa

SEQ ID NO: 1016 - DNA, 966 bp, Artemisia annua
gatccccaaattcaaagtcaaaaccctagcccctctcttcccaaaaaacacactaaaaaacacacacaaaaatggtgtgcatacgcaaagcaacagtagacgacctcctatcaatgcaagcctgcaacctcttctgcctcccagaaaactaccaaatgaaatactatttctaccacatcctgtcatggccccacctcctctacgttgccgaagattacggcgggaaaatagttggatatgttttagccaaaatggatgaagagtcaacaactgagtgtcatgggcatattacttcactcgctgtgctaaggactcataggaagctgggccttgctactaaactcatggctgctgcccaaaacgctatggaacaggtgtttggtgctgagtatgtatcactgcacgtaaggaagagtaacagggcagcatttaatttgtacacggagacactaggttaccagatccatgacatggaggctaaatattatgcggatggagaagatgcatacgatatgaggaaacaattgaagggaaagccacaacagcaaccccaacatcaccaccaccatagtggtggttgctgttccggacatgcaaaggcttaatgatggaggaagaaccgcaagcgggattaatgaaggtctcaaatctggaacaacacgggttatgcagtctgtggtgacagtcctctaaataaggacactacttcaatttcctgttgtttatgcaaacttattgtgatagacttaaaagggtttttgttgattgcttattcaagtgcttatcacttatttttacacagataagcaattttgcatgtttggatatttataactgcttatttgattattgtttggtgcatcttgtttttcaaaaactaagcactttgaaagaagcgatcacctctttagacttctaaattctaaatgaagatggatggctgttgattctccgctctatatacca

SEQ ID NO: 1017 - DNA, 836 bp, Cichorium intybus
ctcttttctctctgtctccacaaccaaaccctagcccctttcttccatagaaacgccacagcttcagaatccaaatccttgaaaatggtgtgcatacgcaaggcaacgatagacgacctgcttgcgatgcaagcctgcaacctattctgtctcccagaaaactaccaaatgaaatactacttctaccacattctctcttggccccagcttctatacgtcgccgaggattacggcggcaagatcgtcggctatgtacttgctaagatggaagaagaaactactgagtgtcacggacacatcacctccctcgcagttctccgtacacaccgcaagttagggctcgcaaccaaactcatggccgctgcacaaaacgccatggaacaggtttttggtgctgaatacgtgtcactccatgtgaggaagagtaacagggcagcgtttaatttgtacacagagacattggggtacaagattcatgacatggaggctaaatattatgcagatggagaagatgcatatgatatgaggaaacaactgaagggaaaaagtcaacatcaacatcaacatcagcatcagcatcagaatcaacaccaccaccaccatcaccaccatgctggcggttgttgctccggcgatgcaaaagccgagtgatggagaagtaccctcaatcaagtgaaaggaataactcggttatgcattttctaggggcatttgtgggaaagagacatgaaaagtttgtatggtcacataaataccaataccaatttacatttcatgatgtcttgtcttaattgccacttctgttataaattataaagttattgacttttttgttc

SEQ ID NO: 1018 - DNA, 959 bp, Solanum melongena
agttcccttttgaagataataagaaaccctaagaactgtgtcagattgagattgaaaaatggtgtgcatacgaaaggcgacgatagatgatttgcttgcgatgcaagcatgcaatttgctatgccttcctgagaattaccagatgaagtactacttttaccacatactttcgtggccacagcttctgtacgttgctgaagattacaatggtaagattgtgggatatgtgttagccaaaatggaagaggaaaccactgagtgccatggacacatcacttcccttgccgtagtcaggactcatcggaaacttggtttggctactaagctcatgaccgctgctcagaatgccatggaacaggtgtttggagcagagtatgtgtctctgcatgtgaggaagagcaatagggctgcatttaagttgtatacagagacattaggatataagattcacgatatggaagccaagtactatgcagatggggaagatgcttatgatatgaggaaggaattgaagggaaagaagcatcatcatcaccaccaccaccaccaccaccaccatggtggtgggtgttgctctggtgatgtgaaggtaggagcaaaggaaggagcagcagaagcaaaagcagcataattgtagacataaagtttggtacttcggaattgcccttactactgttgttttctatgtgaaattgttgtaacgtattgaatcaagatgggaacttttgaaaaatcatatttcaatagtttcgcaaaacagttccagtggatgcttcctcctcagaatatcaacttttgttattactagatccaataatcatttttaagtattcatttcttgcattattattattattagttctgaatgatcaatggtttaatatatttaattactaagatgatattcagtgtgctcctatggaagcttctctcaaagtaggcactatgtctaattgcag

SEQ ID NO: 1019 - DNA, 836 bp, Utricularia gibba
gtgtgccctaatcagaaatggtgtgcattaggaaggcgactttggaggacttgctggcgatgcaggcctgcaatttgttctgcctgcccgagaattaccagatgaagtattacttttaccacatcctttcgtggccgcagcttctctatgtcgccgaggattacaacggcaagattgttggttacgttttagctaaaatggaggaggagtctactgagtgtcatgggcatatcacttctcttgctgttctcagaacccaccgtaaacttggcttggccacgaaactaatgactgccgctcagaacgccatggaacaggtctatggagcggagtacgtctcgctgcatgtcaggaaaagcaacagggctgcgtttaatttgtataccgaaacactgggatacaagatccatgatgtggaggccaagtattatgctgatggagaagacgcttacgatatgaggaagcagttgaagggcaagaagcagcatcagcaccaccaccatcaccaccatcatcacggtggtggatgctgtatgcctatagcgaaacctgatgaaaagattgcaccagcagagggcaaggccgagtaatctcaaatttgagctcattctccatttgatatcagtatagaagtcaagatcagtgccggcatcaagtgacaccaagatgagtcgaactggttgatctgtcaaacgcttcactcatctgttcctcattttgttggaacatggttttccattacattgtgtgtggcctctggatttgtgccatagtcgtgtctgtttgtctctcaattcaactattcatggggagtgctttaaggttccggttattag

SEQ ID NO: 1020 - DNA, 1217 bp, Vaccinium corymbosum
cggacgagttggtaactacaacgcgagagtcggcgagtcggcggagcggaggtggagtaagcttttacaactcaaaacgtcgacgcatcaagctcagcagcgcctgctgtcctctgctgtccttccggggcagaggatccggagccctccctccttcccccatcaacaaccgcgctctctctcgctctatcgaacagacccaaaccctagatccgacgaccgaccatccaaccaacaaccatggtgtgcatacgcaaggcgaccatcgacgacctcctggccatgcaagcctgcaacctcttctgccttcctgaaaactaccagatgaagtattacttctaccacatcctgtcgtggccgcagctcctctacgtggcggaggactacggtggcaagatcgtcggatacgtgctggccaagatggaggaggagagctccgagtgccacggccacatcacttcccttgctgttttaaggacccaccgtaaattagggctcgcaaccaagctcatgaccgccgcccaaaacgccatggaacaggtgtttggtgctgattacgtttctctgcatgtgaggaagagcaatagggcagcgttccatttgtatactgagacgctcaggtacaagattcatgacatggaggccaaatactatgcggatggggaggatgcctatgatatgcggaagcagttgaaggggaagcagtatcatacccatcaccaccaccaccacggcggtgggtgttgctctggtgaggcagtgaagagcggagatgcgaaaacagtggcggctgagtgatgggtaagagcctaagaggtatttgtattttaaactatttgtgtcatggtgtactttttgtgggctcaaagttcagaatatctacgggtaatgtggttagcattatcatgtagtaaaggtgggccttttttaattttacataatgcatgttaaactggtttgggaactttatgcattcctacaattgtgtgtttttgcactagagttgatacgtatgcaagaatttcagttttctagggtgttcatgttgtctggttactagttgttagtactttttcgaaagtacattcatcacgtttaccagactatgcggttgttgacattctagtttctctgtaaatgagtgcaaccatctccatatctagtttggggaaacgtagttttgaagcaagacctcaaaattgcagcattagctgcaa

SEQ ID NO: 1021 - DNA, 1423 bp, Taraxacum officinale
ggacgtaggtcagattagaccgaaccacgttaaatccctcgtgttcagttttgtgttcttattttcgtgagctgagtgtgtgtgattagtgtcgtgtgtgtgtgtgtctcgatcctaacaatatttttcaatccttaaagtaaataaaaaaaaaatacaatataagcatatgaatatgagtgataaccaactcaagaccaacccaaaacttatatacatttttttaaaccgtaaaacacacaaacctcaatttgtggtgacgattacttgttctatggtggaccagtggagtactgttggtgtggtggcggctgattaagttaagagagaatgagaagtatgtggtgggtgatggagctgttgtaatgcacgaaagaaggttgtgcaggttagggtatgtccactttccaccttgaagcaacggcggagatatgtgatcatgtgacatgtgaaaggttcagaagcagatataggggaaggggtaaggcaggcaagattttccgagatcctggaaaattcagttacaatattgaacgattaaaaggctggatcaagaatatgcgaaatatagggacaagatggtcaaatggtcgatattcggattcccattcccgttcccaatccatatccctagccccctcgtctctcgtcttctcacgaacaccataaccaactcaccatcgaaaattcaaaatggtgtgcatacgcaaggcaacaatggatgacctgtttgcaatgcaggcctgcaacctcttctgtctccctgagaactaccaaatgaaatactacttctatcacatcctctcttggccccagctcctccacgtcgctgaggattacggcggcaagatcgttggatacgtgcttgccaagatggaagaagagaccacggagtgtcacggccacatcacctccctcgcggttctccgcacgcaccgtaaactagggcttgcgacgaagctcatgacggcttcacaaaacgccatggaacaggtgtttggtgcggagtatgtgtcactgcatgtgaggaagagtaaccgggcagcattccatttgtacacagagacactcgggtacaagatccatgacatagaggcaaagtattatgcagatggagaagatgcttatgatatgaggaagcagttgaaaggaaagcatcaacatctgcaccaccatcatgctggtggttgctgctctggaaatgccaaaaccgaatgaacaagagatttagaagaagcaggaagctgatgaaacgcggtttaggcttgttcagaagctagctatgagttgaagttaccaaatgatctcgttcttacattaaatgattgtcattaatgtaggaattatttcagtttttattttggttatgaacctatgtttagtgattgtggtaattcatttttattaaagccatatgttttat

SEQ ID NO: 1022 - DNA, 857 bp, Lactuca sativa
gaagaaacgccacatcttctcaatccaaattcgaaaatggtgtgcatacgcaaagcaaccatagacgacctgcttgcgatgcaaacctgcaacctcttctgtcttcctgaaaactaccaaatgaaatactacttctaccacattctctcatggccccagctcctctacgtcgccgaagattatggaggaaagatcgtcggttatgtgcttgctaagatggaagaagaaaccaccgagtgtcacggacacatcacttccctcgctgttcttcgaacgcatcgaaagttagggctcgcaaccaagctcatggccgctgctcaaaacgccatggaacaggtttttgatgctgagtacgtgtcactccatgtgaggaagagtaacagagcagctttcaacttatacacagagacattgggataccagattcatgacatggaggctaaatattatgcagatggagaagatgcatatgatatgaggaaacaactcaaagaaaaaactcagcatcaacatcagaatcaccaccaccaccatggtggtggttgttgctgatgtaggtacaattttaaggaaataccctcaagtcgaatgaaggaataggagaagattgcattgttctataaataccgaataccatttctcttttgtgattttcttgtgttaattgcaacttctgttatcttagcataaattataaaatgaagaatctctttatacattactagctatggttaaggttattttagacatttgctcaggaggcaaaaacttgtgtctttactaccctttgaccagagatggataatgttgactttcaaattctaaatactatagatgtagatctttatgtgcacaaa

SEQ ID NO: 1023 - DNA, 1028 bp, Ricinus communis
gtcagtcaagtgccagagcaaaacctccgtcttctccgaaacagaccaaaccctaaaattgaagacgatggtgtgcataaggaaagcaacaatagatgacctactggcgatgcaggcatgtaacctgctatgcctaccggagaactaccagatgaaatattatttctatcacatcctttcctggccacagcttctctatgtcgctgaagattacaacggacgcatcgtcggttatgtgttggctaagatggaagaggagtcaaatgaatgccacggccacatcacctctctcgctgtcctccgtactcatcgtaagttgggcctcgctactaagctcatgagcgctgcccaaactgccatggaacaggtgtttggtgccgaatatgtctcattgcacgtgaggaagagtaatagggcagcattcaatctgtacacagaaacattgggctataagattcatgatgtggaggcgaagtattatgctgatggagaggatgcatatgatatgcggaagcagcttaaggggaaacagattcatcaccatgggcatcaccatcatcaccatcaccatcatcatcatggtggtgggtgttgtgcagctgacatcaagtctgtggaagcaagaccagactcgaaatcagaggcaaaagctagtgcgaaatcagaaccaaaagcaggataatggtgagatttcaaccaatatttggagaactcggccatgctcttttgttatatgattctgaaatactgctagcttgtattgagtaatgtagtttgtttttggtggtaaagacagggagttgcatgattattactgccattactattctcatatattatgatgagcattgttgtgtcatggttgctgcaaaacttttttttaggacacttcttcagtgccaatattttctttttggtcactttatctgttgttatatcgagtgtcaattattaggccatgtaacatcttgttattcctctcattccatgtttgcttccttacgaaaagaatttctcaacattctttc

SEQ ID NO: 1024 - DNA, 829 bp, Plantago ovata
ccaaaatcagaaccctaaccctagacgaacgagaacacaaccgaatcaatccaccaaccatggtttgcatcaggaaagcaactgtggacgatctgctggcgatgcaggagtgcaatctgttctgtctgccggagaattaccagatgaagtactacttctaccacatcctctcctggccgcaactcctctacgtcgccgaggattacaacggcaaaatcgtcggctacgttctcgccaaaatggaagaggaaaccaccgagtgccacggccacatcacctccctcgccgtgctcagaactcaccggaagctcggtcttgccactaagctcatgactgctgctcaaaatgccatggaacaggtttatgggtcagagtacgtgtccctccatgttaggaaaagcaatagggctgcttttaatttgtacactgggactttaggttacaagattcatgatatagaggcaaaatattatgctgatggcgaagatgcatatgacatgaggaagcagttgaagggtaggaagcatcaccaccaccatcatggtgggggatgctgctctggagaagtaaggtcagatgataaggcttcattgaccgaggcttaaactgatgcctggattatttcatggtcattgtactgttatttagttcatttgtcggaaccttccttgttatttgcagaatttgttactgaatactctttgcttatgtgcttattctgttgatcttttgaataatgtgatcttcagggaaggagtgtaagagaattcgattgagttgtttatgacgtttatgaaaaagatgaattaatttacagcagtgttgttag

SEQ ID NO: 1025 - DNA, 583 bp, Brassica napus
gagtccgcagcagcagccatggtgtgcatcaggcgagcgacggtggacgatctgctcgcgatgcaagcctgcaacctcatgtgccttcccgagaactaccagatgaagtactacctctaccacatcctctcttggcctcagcttctctacgtcgccgaggactacaacggccgcatcgtcggctacgtcctcgccaagatggaagaggagagcaacgagtgccacggccacatcacttccctcgccgttctccgcacccatcgcaagctcggtctcgctactaagctcatgaccgccgctcaagccgccatggaacaggtatatggggcagagtatgtttcattgcatgtgaggagaagtaacagagcagcgttcaatctctacacggagacgttaggctaccagattaacgatgtggaagctaagtattacgcggatggagaggatgcttatgacatgcgaaagaatctcaagggtaagcagattcatcaccacgccagccacggccatcatcatcaccatggaggtgggtgctgttcaggcgatgctaaagttgttgaacaactcaagctgaagatgctaa

SEQ ID NO: 1026 - DNA, 766 bp, Plantago ovata
ccaaaatcagaaccctaaccctagacgaacgagaacacaaccgaatcaatccaccaaccatggtttgcatcaggaaagcaactgtggacgatctgctggcgatgcaggagtgcaatctgttctgtctgccggagaattaccagatgaagtactacttctaccacatcctctcctggccgcaactcctctacgtcgccgaggattacaacggcaaaatcgtcggctacgttctcgccaaaatggaagaggaaaccaccgagtgccacggccacatcacctccctcgccgtgctcagaactcaccggaagctcggtcttgccactaagctcatgactgctgctcaaaatgccatggaacaggtttatgggtcagagtacgtgtccctccatgttaggaaaagcaatagggctgcttttaatttgtacactgggactttaggttacaagattcatgatatagaggcaaaatattatgctgatggcgaagatgcatatgacatgaggaagcagttgaagggtaggaagcatcaccaccaccatcatggtgggggatgctgctctggagaagtaaggtcagatgataaggcttcattgaccgaggcttaaactgatgcctggattatttcatggtcattgtactgttatttagttcatttgtcggaaccttccttgttatttgcagaatttgttactgaatactctttgcttatgtgcttattctgttgatcttttgaataatgtgatcttcaggaagagtgtaaaaaccg

SEQ ID NO: 1027 - DNA, 1894 bp, Gossypium raimondii
gtaaacttgaaaatcataaaaatcccaaatccctaattctggaattaaacaaacaaagagaacaatggtgtgcatacgcaaggcgaccatggacgacctactggctatgcaagcttgcaacttgctttgccttcccgagaattaccagatgaaatactatttctaccacatcctctcttggcctcagcttctttacgtcgccgaggactacaacggccgcatcgtcggttacgtcctcgctaagatggaggacgaaagcaacgagtgccacggccacattacctctctcgccgtcctccgcactcaccgcaagcttggcctcgccactaagctcatgaacgccgcccaagccgccatggagcaggtgtttggagcagagtatgtgtcgctgcatgtgaggaagagtaacagggcagcgtttaatctgtatacccagacgttgggatataagattcatgatgtggaggccaagtattatgcagatggggaggatgcatatgacatgaggaagcagttgaaaggaaagacgaaccatcatcatggtcatcatcatcaccaccaccaccaccaccatcatggtggtggatgttgttcaggtgatgcaagaagtggagaagcagctcatacacgaggagactcgaaatcagagtcaaaagctagcacaaaatctgattccaaaactggatgattactggaggtaaacacaagtatatggagaactatgcgtggtatttgtggctcatggtatttttagtttgtttattgaagtaataatctgactggagatttcaaaactatttggcttgctacatgggatttagtatgaacactgctgatgcaatggtgtctgtactgtctgtgttttacaatgcttttttgtctggattctggtcagatgttttcttgttccaccttgcgttttaaacaatagaaatagctctttgcatttcactttatgcattcatggttatggcttgttgacatctctgctccctttgtattcaatgcttgttgatggtcctttttcaagcactttcccttctatgttttcctttactcatgcaagatacaaagtgttgctccttgtgaaccgaatgaaatgttagttgagaaattacaaggatgcattatgatattgatatatatatatatagagagagagagagagagagaggtttaattaatattttcagataaaagtggattatgtggatgtctgcaactagagtggctagttgttggtagtctattctttgggagcatattgatattaagtagttggctatctgccaatcctggtgatggtatggggggctcttgtacttgaatcttaaagttggagtttgtgttccagtggcctgtaacaatcaatacttgaacgtttgtatcacggcattgtctatgatggtggatatcttttgaacattctcgagatatggctatggagagggtttagaattatttgacagtggagttttgtggaaatggatatgattgtaagacgtgttgtttcccatataccaaaaaaaaaaagaagaaaaacagttaaaggtatgaatctcgagaaggggtgtcttgttcagtgttcaagtcatcagtcatcaatgggtcttaagcacaaatgtgacaggcacttgatttcagcctcagcccagtgcagatccaaagatagttcaatgtacattttcgcattggtatttcctcctgctgtgaatggatgttgtcaaatctactatcgggatgttctgtttcaacatatgcctcactctattatagatgcgtaattttgaaaactattgttatctccatggaagttggatatattcatctttgtctctttttgtattaattcgatttttgttagttatttttaatgtttgtcttttcaacataa

SEQ ID NO: 1028 - DNA, 1350 bp, Gossypium hirsutum
atcccaaatccctaattctggaattaaacaaacaaagagaacaatggtgtgcatacgcaaggcgaccatggacgacctactggctatgcaagcttgcaacttgctttgccttcccgagaattaccagatgaaatactatttctaccacatcctctcttggcctcagcttctttacgtcgccgaggactacaacggccgcatcgtcggttacgtcctcgctaagatggaggacgaaagcaacgagtgccacggccacattacctctctcgccgtcctccgcactcaccgcaagcttggcctcgccactaagctcatgaacgccgcccaagccgccatggagcaggtgtttggagcagagtatgtgtcgctgcatgtgaggaagagtaacagggcagcgtttaatctgtatacccagacgttgggatataagattcatgatgtggaggccaagtattatgcagatggggaggatgcatatgacatgaggaagcagttgaaaggaaagacgaaccatcatcatggtcatcatcatcaccaccaccaccaccaccatcatggtggtggatgttgttcaggtgatgcaagaagtggagaagcagctcatacacgaggagactcgaaatcagagtcaaaagctagcacaaaatctgattccaaaactggatgattacttgaggtaaacacaagtatatggagaactatgcgtggtatttgtggctcatggtatttttagtttgtttattgaagtaataatctgactggagatttcaaaactatttggcttgctacatgggatttagtatgaacactgctgatgcaatggtgtctgtactgtctgtgttttacaatgcttttttgtccggattctggtcagatgttttcttgttccaccttgcgttttaaacaatagaaatagctctttgcatttcactttatgcattcatggttatggcttgttgacatctctgctccctttgtattcaatgcttgttgatggtcctttttcaagcactttcccttcatgttttcctttacttatgcaagatacaaagtgttgctccttgtgaaccgaatgaaatgttagttgagaaattacaaggatgcattatgatattgatatatttatatatatatagagagagagagaggtctaattaatattttcagataaaagtggattatgtggatgtctgcaactagagtggctagttgttggtagtctattctttgggagcatattgatattaagtagttggctatctgccaatcctggtgatggtatggggggctcttgtacttgaatcttaaagttggagtttgtgttccagtggcctgtaacaatcaatactt

SEQ ID NO: 1029 - DNA, 2927 bp, Eutrema halophilum
ttaactaaaaattaaatccacaagtgaagaaaaaaaagaaaaggtgagagagatctctccctcaccctcacacacgcttaaacagatggctatcgcgagcagatcgtgggtagccaccgtgaaccaccatgcaaacccacacagcttctcctctccgaagaaacccgttttctttctttcccaaaagcctcacatttcccacgtctgctcgtctcgatgctctctggttcttgaggaagatgaaaagaagtcaccgagttctaaacaagacaagtggccatttttcgaacctgtccctgatggccttaacctggtcttatccaggttgctacgagatcctgaaacccagaaactttcttcagagttttacgagaaagccaaggagaactcagagctgaggacgaccaagcatctgatcaattacttggtgaatgccaagaactgggacttgctcgtctcgctttgtgaggatctcagggaatacaatgcgttgcctgatgctcatacgtgttcccaactgatcaggagttgcatcagagagagaaagttccgagttgcgcactgcttgcttagcgtgtttagatcagacaaaacattggctgtgttcgcaactgattcggcgatgaaaggttttaacaaactccagatgtatagtagcacgatccaagtgtttgataggatgaaacaatatgtaggagttgagccaagcccgggatgttattgcaggatcatggaggctcatgaaaggatcggtgacaatcaaaaagtggttgagttatttcaagaatttaagagcaagaggttgagtttcttggccaaggaatcaggctccatctacacgattctatgcacctcccttgcaaaatcaggacgcgcattcgaagctcttgagtttttggaggagatgaaagacaaaggaattcaggaaactagtgcattgtactctacgctgatccgtgccttagcgggagctcgagaggttacaacggtcgagaagctattcaaagaagcaggggagaagaaactgttgaaggatccagaaatgtgtttgaaggttgtattgatgtatgttcgagaaggaaaaatggagagaactctagaggttgtggccgctatgaggaagaacgatttaagggtctccgactgcattctctgcgcgatcgtgaatggattttctaagcaaagaggttttgcggaagcagttagggcttacgagtggcttaagaagcaagaatgtgaggctggacaagtgacttacgcaataaccatcaatgcgtactgtcgactagaggagtacgagaaggctgaaatgttgtttgatgagatggtaaacaaaggatttgacaaatgcgttgttgcatactcaaacattatagatatgtacgggaaaacaaggaggctaagcgatgcagtgaaactcatggctaagatgaaacagagaggatgtaaacccaacatttggatttacaattctttgattgatatgcatgggagagctatggacttgaggcgggtcgaaaagatatggaaagagatgaagaggatgaaggtgttgcctgacaaggtgagttacacaagcatgatcggtgcgtgtaatagagcaaaagagttggagagatgtgtggagctttacaacgagtttaggatgaacagaggaaagattgatagggccatggcaggaatcatggtcggtgtattctccaaaaccagccggattgatgagctaatgagactgttgcaggacatgaaagttgaacgaaccaagcttgatgcgaggctctactcctcagctttgaatgctctgcgtgatgctggtctcaattcccagataagatggctgcaggaaagctttgacacagcacaaaccggtgcttcaagatattcgaatacgaagagtaaaacaactttgcagggttcttgaattgaagttgaaactgtagaagtcaagaattcttttgtaattaaatgtaatacattgtcacagagatctgctatcttgcaaatagaagatttccatctcaagttgtaaagccttaagaaaacaattggatttctgaaacatgatacataaacaaaagaggactagatatcaagtacaaccaaaggaagacaatggagaaaaacataatgtatttgccactcgagaacatatgactgcaaaatagggagcagtactagagccagccagcaaaccccactctaataatactcataattacctattttggtcatcctgctttaaagtctcacttcgaacttgctttagcctcttcagcttgagctgtttctacaacttttgcatcgcctgaacaacatccacctccatggtgatgatgaccgtggccatggtgatggttttgcttccccttgagatgctttcgcatgtcataggcatcctctccatccgcataatactttgcttcaacatcgtgaatcttgtagcctaatgtctccgtgtacagattaaatgcggctcggttacttctcctcacatgcagcgaaacatattctgcctctaacctgttccatggcagcctgagcggcggtcatgagcttagtggcgaggccgagcttccgatgggttcgaagaacggcgagagaggtgatatggccatggcactcgttgctctcctcctccatcttggcgagcacatagccaacgatgcgaccattgtagtcctcggcaacgtagagaagctgcggccaagagaggatatggtagaggtagtacttcatctggtagttctcaggaagacacatgagattgcatgcctgcatcgccagcagatcatccaccgtcgctcgcctgatgcagaccatggctgctcaatctacgtcttcttctcttctctctcctatcggggataaatttggggttagggtttcgggtctaatggcgtcgggctttattaatctggggacgaatt

SEQ ID NO: 1030 - DNA, 812 bp, Solanum tuberosum
ctcccctcttgaagatcagtgcaaaccctaattatcgcgtgagattgagattgaaaaatggtgtgcatacgaaaggcgacgatagatgatttgcttgcgatgcaagcatgcaatttgctatgccttcctgagaattaccagatgaagtattacttttaccacatactttcgtggcctcagcttctgtacgttgctgaagattacaatggtaagattgtgggatatgtgttagctaaaatggaagaggaaaccactgagtgccatggacacatcacttcccttgccgtagtcaggactcaccggaaacttggtttggctactaagctcatgaccgctgctcagaatgccatggaacaggtgtttggagcagagtatgtgtctctgcatgttagaaagagcaacagggctgcatttaagctgtatacagagacattaggatataagattcatgatatggaagccaagtactatgcagatggggaagatgcttatgatatgaggaaggaattgaagggaaagaagcaccaccagcatcatcatcaccaccaccacggtggtgggtgttgctctggtgaggtgaaggtaggaccaaaggaaggagcagcagaaacaaaagcagcataattatggacctaaagtttgggacttagaaatttccctgagtcaatttgcgcacaagaaatatatgttactaatgtatgttttctacatgaaacaactacaccttgtaaggttggatcattggtacaattaatgcttttggttttcctgatattgtattcacctttcatatctatttggaaactattgaa

SEQ ID NO: 1031 - DNA, 926 bp, Solanum phureja
ggccattctatgaggcccaaataaaaagcccaaattaatgattgcctatcaatttctgacgaacatagctcccctcttgaagatcagtgcaaaccctaattatcgcgtgagattgagattgaaaaatggtgtgcatacgaaaggcgacgatagatgatttgcttgcgatgcaagcatgcaatttgctatgccttcctgagaattaccagatgaagtattacttttaccacatactttcgtggcctcagcttctctacgttgctgaagattacaatggtaagattgtgggatatgtgttagctaaaatggaagaggaaaccactgagtgccatggacacatcacttcccttgccgtagtcaggactcaccggaaacttggtttggctactaagctcatgaccgctgctcagaatgccatggaacaggtgtttggagcagagtatgtgtctctgcatgttaggaagagcaacagggctgcatttaagctctatacagagacattaggatataagattcatgatatggaagccaagtactatgcagatggggaagatgcttatgatatgaggaaggaattgaagggcaagaagcaccaccagcatcatcaccaccaccaccacggtggtgggtgttgctctggtgaggtgaaggtaggaccaaaggaaggagcagcagaaacaaaagcagcataattatagacctaaagtttgggacttagaaatttccgcgagtcaatttgcgctcaagaaatatatgttactaatgtatgttttctacatgaaacaactacaccttgtaaggttggatcattgatacaattaatgcttttggttttcctgatattgtattcacctttcatatctatttggaaactattgaaatatgaatttccaaaagttatccatcttgattaaatacgttgcaac

SEQ ID NO: 1032 - DNA, 1279 bp, Castanea mollissima
tctccacaaaatccccaaatcaaaaactcccaccacacaaaaaaaccctaaccctaaaccctcaaattcaaaaaccccccacaaaaatcaaccaaatcaaagaccaacccaacaatggtgtgcatacgcaaagccacaatcgacgatctcttagccatgcagacctgcaatctcttctgcctcccggagaattaccagatgaagtactatctctaccacatcctctcatggccgcagcttctctacgttgccgaagactacaacggcaagatcgtgggctacgtgctagccaaaatggaagaggaaagcaccgagtgtcacggccacatcacgtcgctcgcggtgttgcgcactcaccgcaagctcgggctggcgaccaagctcatgagcgcagctcagaacgccatggagcaagtgtttggagccgagtacgtgtcgcttcacgtgaggaagagtaatagagctgcgtttaatttgtacacggagactttggggtataagattcatgatgtggaggctaagtactatgcggatggtgaggatgcttatgatatgaggaagcaattgaaggggaagcagtatcatggacatggacatgggcatgggcatgggggacacgggcatcatcatcaccatcatcatgagcatggaggtgggtgttgttcaggggagagggtggaaccaaaaggaactgggaagaagtaggccagggtgaactgaggtgaagtggtactgctattgggtttttatttttgttatattttgttgggttccattatgtgaggaataatggttaatgggtatttgtttaattatacattgagctgaatttacaatgatgggcatggatatctaatgttatatgcacttttttgtgtcaattgtattggattcagtggccaaggttagatctttgatctaatgttatctgcacttttttgtgtcaattgtattggattcggttgccaaggttagatctttttgggtcctgtttattgtggttgttttagtgaggaataatggttaattatgccttgaacttaattcacaatgatctatactactagacattgagtacatttttgttgtgaattgatgtggacttgccaaccagttatacatgaccggttatgcatggcatcataattcagcttccaaatcggtttgtaacaaaattgcaatagcacttataatatctagagcaattttcatgtgaattggaattatagggagagacactattatatgtagtttagtaatgatacttaattaatactag

SEQ ID NO: 1033 - DNA, 937 bp, Quercus alba
tcccaccacacagaaaaaaccctaaccctaaaccccaaattcaaaatcccccacaaaaatcaaccaaatcaaagaccaacccaacaatggtgtgcatacgcaaagccacaatcgacgatctcttagccatgcagacctgcaatctcttctgcctcccggagaattaccagatgaagtactatctctaccacatcctctcatggccgcagcttctctacgtggccgaagactacaacggcaagatcgtgggctacgtgctagccaaaatggaagaggaaagcaccgagtgccacggccacatcacgtcgctcgcggtgttgcgcactcaccgcaagctcgggctggcgaccaagctcatgagcgcagctcagaacgccatggagcaagtgtttggagctgagtatgtgtcgcttcacgtgaggaagagtaatagagctgcgtttaatttgtacacggagactttggggtataagattcatgatgtggaggctaagtactatgcggatggtgaggatgcttatgatatgaggaagcaattgaaggggaagcagtatcatggacatggacatggacatgggcatgggggacatgggcatcatcatcaccatcatcatgagcatggaggtgggtgttgttcaggggagagggtggaaccaaaagggaccgggaagaagtaggctagggtgaactgaggtgaagtggtactgctattcgggtttttttttggttgtattttgttgggttccattatgtgaggaataatggttaatgggtatttgtttaattatacattgaacttaatttacaatgatgggcatggatatctaatgttatatgcacttttttgtgtcaattgtattagattcagttgccaaggttatatcttttttgggtcctgtttattgtggttgtttttagtgaggaataatggttaatt

SEQ ID NO: 1034 - DNA, 576 bp, Vinca minor
aagagcaactgaaatcccttaccctaagccccctttctctgtaatctcaatcgaaatcgagctatagccatggtttgcattcggaaggcaaccgttgatgatttattggctatgcaagcttgcaatttgttttgcctaccggaaaattaccagatgaaatactacttttaccacatactttcatggccgcagctgctttatgttgctgaggattacaatggaaaaattgttggatatgttttagctaagatggaagaggagagctctgaatgccatggtcatatcacctctcttgctgttcttaggactcataggaaactcggtttggcaactaagctcatgacagccgcccaaaatgccatggaacaggtatatggagcagactacgtatcgctgcatgtgagaaaaagtaacagggctgcatttaatttgtacactgggacattagggtatgagattcatgatatggaagcaaaatactatgcagatggggaggatgcttatgatatgagaaagcagttgaagggaagaaagcatcaacaccaacatcaccatcatcatggtggtggctgctgc

SEQ ID NO: 1035 - DNA, 758 bp, Valeriana officinalis
gaccaaagaccaaaaataccaaacgaataggtagtgtaataacgaaaagccaccattgatgacttgctcgcaatgcaagcgtgcaatctcttctgccttccagagaattaccagatgaagtattacttctaccacatcctctcatggccccagctcctctacgtcgccgaggattacggcggcaaaatcgtcggatacgtactagcaaagatggaagaggaaagcaccgagtgtcacggccacataacctccctcgcagtcctccgtactcaccggaagttaggtcttgccaccaagcttatgacggcggctcagaatgctatggaacaggtcttcggcgccgatcacgtggcgttgcacgtgaggaagagtaaccgtgctgcgttcaatttgtatacggagaccttagggtataagattcatgatattgaggcgaaatattatgctgatggcgaggatgcttatgatatgaggaagcagttggcggggaaacgtgataaggttcatagtcatgctcatcatcatcatggaggtggatgttgctctggtgagtccaaacccgaatccactgctggttcctcggcttagttgctgattcaggtatgtttttttttgggttttgctggtttgtgttattttgggatgatgttttgaattatgaattgaattgaaatttataatcttcatgatgattgatgaacttaattgtgttgttgttagatttagattttgtggtaatttggtggttgacccaaaaa

SEQ ID NO: 1036 - DNA, 1171 bp, Gossypium hirsutum
attaaacaaacaaagagaacaatggtgtgcatacgcaaggcgaccatggacgacctactggctatgcaagcttgcaacttgctttgccttcccgagaattaccagatgaaatactatttctaccacatcctctcttggcctcagcttctttacgtcgccgaggactacaacggccgcatcgtcggttacgtcctcgctaagatggaggacgaaagcaacgagtgccacggccacattacctctctcgccgtcctccgcactcaccgcaagcttggcctcgccactaagctcatgaacgccgcccaagccgccatggagcaggtgtttggagcagagtatgtgtcgctgcatgtgaggaagagtaacagggcagcgtttaatctgtatacccagacgttgggatataagattcatgatgtggaggccaagtattatgcagatggggaggatgcatatgacatgaggaagcagttgaaagaaaagacgaaccatcatcatggtcatcatcatcaccaccaccaccaccatcatcatggtggtggatgttgttcaggtgatgcaagaagtggagaagcagctcatacacgaggagactcgaaatcagagtcaaaagctagcacaaaatctgattccaaaactggatgattactggaggtaaacacaagtatatggagaactatgcgtggtatttgtggctcatggtatttttagtttgtttattgaagtaataatctgactggagatttcaaaactatttggcttgctacatgggatttagtatgaacactgctgatgcaatggtgtctgtactgtctgtgttttacaatgcttttttgtccggattctggtcagatgttttcttgttccaccttgcgttttaaacaatagaaatagctctttgcatttcactttatgcattcatggttatggcttgttgacatctctgctccctttgtattcaatgcttgttgatggtcctttttcaagcactttcccttcatgttttcctttacttatgcaagatacgaagtgttgctccttgtgaaccgaatgaaatgttagttgagaaattacaaggatgcattatgatattgatatatttatatatatatagagagagagagaggtctaattaatattttcagataaaagtggattatgtggctgtctg

SEQ ID NO: 1037 - DNA, 865 bp, Lactuca sativa
ccaatccatatatctctagtgtctacgacgctaacctaacctaacccatcatctatctatcgtcttctcgcgaacgccgaaaaccataccatattctccatccattcgcagagcaataatggtgtgcatacgcaaagcaacgatggatgacctgtttgcaatgcaggcctgcaacctcttctgtctccctgagaactaccaaatgaaatactacttctatcacatcctctcttggccccagctcctccacgtcgccgaggattacggcggaaagatcgttggatacgtgcttgccaagatggaagaagagaccacggagtgtcacggccacatcacttccctcgccgttctccgtacgcaccgtaagttagggcttgcgacaaagctcatgaccgcttcacagaacgccatggaacaggtgtttggtgcggagtatgtgtcactgcacgtgaggaagagtaaccgtgcagcgttccatttgtacacagagacacttggataccagatccatgacatagaggcaaagtattatgcagatggagaggatgcatatgatatgaggaagcagttgaaggggaagaatcagcatcagcatcagcatcaacatcaacatcagcaccatcatcaccaccatcatgctggtggttgctgctctggagatgcaaaagctgaatgaagaaggaaggtatgatttagttgtaaaaggatggttgtcatgattgcagagtcacttgtttctgtacacttggtatttgaatttgaggcaggcaagctgtcgaggaactttatgctaatgtgcattttttattgttagtgttgatttggtgccatatgtttttcaataaaaagctgataatgttgtggt

SEQ ID NO: 1038 - DNA, 2077 bp, Fragaria vesca
accaaaatctcatcaaaaatcctcaacctcccaaagcgcttcttcgtccccaaatccaaaatcaaatcaatctcgaaaaccctaaccctagaaatccagcttgcagaaatggtgtgcatacgcaaggccacaatggacgatctgctggcgatgcaagcctgcaacctcttctgcctcccggagaactaccagatgaagtactacctctaccacatcctctcatggccgcagttgctctacgtcgccgaagactacaacggccgcatcgtcggctacgtcctggccaagatggaggaagagagcaacgagtgccacggccacatcacctccctcgccgtcctccgcacccaccgcaaattgggcctcgccaccaagctcatgagcgccgcccagaacgccatggagcaggtcttcgccgccgagtacgtctccctccacgtcaggaagagcaaccgcgccgccttcaatctgtacaccgagactttggggtataagattcatgacattgaagccaagtactatgccgacggagaagatgcttatgacatgaggaaggagctcaaggggaagaaagtgcatgctcattcgcaccatggccatcaccaccaccaccaccaccaccacgagggcgggtgttgctccgctgaggccaagccggccgagaccaaatccaaggcagggagtgccaagtgatagaggtaaaaattgagctatgtcagaagaatgtattgttttactttgcactgtggttttgatactggtatgtctcgactgttttggtttgtatctggtgaaaatgtatgccgttcgagtatttggaacttagttttatgatatttctattcagcttgatgtttaaatacctgctctgacttgtgtgctatgttgtgtggttttctattaatttacggttaattatcaactccatgttttttccgctctctgcaagtgattttattctctttggtagtattgcattgtgaatatgacatggaatcgcgttgcattgattgtgcatttatcgtttgtattttgtgtgttttctgattggcagtgtgtgccctttaccacatgctcataagatatatgaacatggttctacctagctctattatctcgactgattcttaagaatcagaaatacagagtaatactgaaatatagtaggaaatatgactagattgctctgctggctgattgatatcaggatctccagccccagctctgttgttaaagggcaggaggtaccattatgcccaaacgtgattgctagcttcatttgaaactttcatattttctgttcatatgtttcaattaggatcatttatgaaagcgcatatcttgtcgtacaagagatggtttacttgctatatgcacttataatgaccaactgtggtaactttaaagggatgtgttgtataaggtgattgtgtctgaagttaaataatgtcatcatctctgaagtacagggaatgaatagcttccattcgaaaatgttactagtttctttcccttaatttttttttcttttgccaagtgagttgccatagaacaattgagatctgtctttcgtttcagtagttaatttgttggatacatagcttgctaggtagtaatcctattcaaagatcttggcttgcttagtgctctctatagcgaatcaaaagcatttataaagaataaaaattgcgttgctcttgaaaatcattgtaggaagtgtgaatttttgcctctggcaaataaaacctctctctatgctgagctggtattccactgcttttagggtctggttgctcattcattttcagtattaactagattccttaagttgaataagcccattataacttggcactcatgcattggagtacgccaaataattaaggttttgtgaaaagagtgctcggtgtttactctggtctggtgtgcgtaactgtcgttacatttaaatagaaagctggagaatgataaaagttgacattagtgtagttgtcttctttttctcaactttgggaatttaaattcaatgcactgaatgcagtttgagagggatggccaatttgaaaaaagaaaaaaa

SEQ ID NO: 1039 - DNA, 1091 bp, Lactuca sativa
ttcgtcctttatcgttcccaatccatatatctctagtgtctacgacgctaacctaacctaacccatcatctatctatcgtcttctcgcgaacgccgaaaaccataccatattctccatccattcgcagagcaataatggtgtgcatacgcaaagcaacgatggatgacctgtttgcaatgcaggcctgcaacctcttctgtctccctgagaactaccaaatgaaatactacttctatcacatcctctcttggccccagctcctccacgtcgccgaggattacggcggaaagatcgttggatacgtgcttgccaagatggaagaagagaccacggagtgtcacggccacatcacttccctcgccgttctccgtacgcaccgtaagttagggcttgcgacaaagctcatgaccgcttcacagaacgccatggaacaggtgtttggtgcggagtatgtgtcactgcacgtgaggaagagtaaccgtgcagcgttccatttgtacacagagacacttggataccagatccatgacatagaggcaaagtattatgcagatggagaggatgcatatgatatgaggaagcagttgaaggggaagaatcagcatcagcatcagcatcaacatcaacatcagcaccatcatcaccaccatcatgctggtggttgctgctctggagatgcaaaagctgaatgaagaaggaaggtatgatttagttgtaaaaggatggttgtcatgattgcagagtcacttgtttctgtacacttggtatttgaatttgaggcaggcaagctgtcgaggaactttatgctaatgtgcattttttattgttagtgttgatttggtgccatatgtttttcaataaaaaagctgataatgttgtggtttcttgctgaaactgagtcctttactaatatgttttgtggtgttgtgtttaacatggatgtaaatttatttgtgatgttgttgaggagaagacatcttttgcagatgagtgattgagagtgaatccatgtcccacctttttcggtgggtctcatggataccaaatgtactacaatttgtttttgtcatggggcttatgtggatccttg

SEQ ID NO: 1040 - DNA, 1318 bp, Eucalyptus grandis
tctttcttctccgaaagagcgacaagcaaaccctaccctccacccccgaatccccccctcgaaggagcacgaagcttgggaaccggcggaaccagatcaacgatggtgtgcattcgcaaggccacagtggacgacctgctggccatgcaagcttgcaatctgatgtgtctacccgagaactaccagatgaagtactacctgtaccacatcctgtcttggcctcagctcctctacgtggcggaggactacaacggccggatcgtcgggtacgtcctggcgaagatggaggaagagaccaacgagtgccacggccacatcacctctctcgccgtcctccgcactcatcgcaagctgggactcgccacgaagctcatgaatgctgctcagaatgccatggaacaggtttatggggctgagtatgtttcgctgcatgtgcgtaaaagcaatcgtgctgcattcaatttgtacactgaaacactggggtacaagatacatgatgtggaggcgaagtactatgcagatggagaggatgcatatgacatgaggaagcagctcaagggaaagcagaaccatcatcaccatcatcatcatcgtcatgggcacgggcatgggcatggtcatggtcaccatcatcatcatcatcatcatcatggggatgggtgttgttcgggtgacatcaaatccgggggaattgaagctggacaaaagctggattcgaaggccaacaaagcaggctaatgaagagagttgaagtgggagctcagacatactgttggctatttttatgtcattttgctgttagttcaggtactttctccgtgaaaagaagaaggaaattgcagctcttgaaagtttaatggaaactcttcataagttagctttgtgagccattcattctgaagcgtgttccataaattaccttacatcatttagcgagtatttgtgtcgctttatcgacattccttttctcacttacgttttagccataacccctgttttcctctggtctataaatggtggtgacatgttttatgtgctaccatgggatttgatgactttaatcacaagcgaaggtgcaccctcggaaggggtcacggcctctctttttgttcggagttgttataaatgatagtggagtgtgatcccagtaaatgtgtgactgaggaggccatcggagcgaatttaacttcagcttctgtttttgcttttaatgtttgaggcttgattgttattttaaatggaactttctctgtggcatatgttatgtggacatttgtatacgaatctattatttttattgggatggatccttttctgc

SEQ ID NO: 1041 - DNA, 600 bp, Lactuca sativa
gggagcgatagattacactattacagtgttgttttctctgtctccaaaacaaaaccctaacccctcttttccgaagaaacgccacatcttctcaatccaatttcgaaaatggtgtgcatacgcaaagctaccatagacgacctgcttgcgatgcaagcctgcaacctcttctgtcttcctgaaaactaccaaatgaaatactacttctaccacattctctcatggccccagctcctctacgtcgccgaagattatggaggaaagatcgtcggttatgtgcttgctaagatggaagaagaaaccaccgagtgtcacggacacatcacttccctcgctgttcttcgaacgcatcgtaagttagggctcgcaaccaagctcatggctgctgctcagaacgccatggaacaggtttttggtgctgagtatgtgtcactccatgtgaggaagagtaacagggcagcattcaatttgtacacagagacattgggatacaagattcatgacatggaggctaaatattatgcagatggagaagatgcatatgatatgaggaaagaactcaaaggaaaaactctacatcaacatcaccaccaccaccac

SEQ ID NO: 1042 - DNA, 655 bp, Bruguiera gymnorhiza
gacgtcaagatccgtaaccctaaatactcctcccaaaaattgaagaagagaagagagagagagagaggaagaatggtgtgcataaggaaggcgacgatcgacgatttgctggcgatgcaggcgtgcaacctgctctgcctgccggagaactaccagatgaagtattatttctaccacatcctctcgtggccgcagctactctacgtcgccgaagactacaacggccgcatcgtcgggtacgttctcgccaagatggaggaggagtccaacgagtgccacggccacatcacctcccttgccgtcctccgcacccaccgcaagctcggcctcgccactaagctcatgaacgccgcccagaccgccatggagcaggtgtttggagcagagtatgtgtcactccatgtgaggaagagcaatcgggctgcattcaatctgtacacagggaccttaggttacaagattcatgatgtggaggccaagtattatgctgacggagaggatgcatatgatatgcggaaacagcttaaggggaagcaaacccatcatcatgggcatcatcatcatcatccccatcatcatcatcatggtggcgggtgttgtggtggtgctggggctgatgctaagcctgtggaaggtaagtcaaaacccgatgcca

SEQ ID NO: 1043 - DNA, 1074 bp, Arachis hypogaea
ataattcaaatgtgaaattggaagaaataattccaccatttattcattgtaaattaggtcaataaggcaggttcggccccaagtagagctctcactctcacaagttctactgttgtcggaagttgaatcccaagtccctaacccttgcttgaggctcgatggtatgcataaggaaggcaacggtggatgacctgctggctatgcaggcatgcaacctcttctgcctgccagagaactaccagatgaaatactacctctatcacatcctctcctggccccagcttctctacgtcgccgaggactacaacggccgcatcgtcggctacgtcctcgccaagatggaagaggagacttccgagtgccacggccacatcacctctctcgccgtcctccgcacccaccgcaagcttggtcttgccaccaagctcatgacggctgctcagaacgccatggaacaggtgtttggtgctgagtatgtctccctacatgtcagaaagagcaatcgtgctgcatttaatttgtatacagagacattaggttacaagattcatgatgtggaagcgaagtattatgcagatggggaggatgcttatgacatgaggaagcagctcaaggggaagcagacacatcagcatcagcatcatcatagtgggggtcatcatcaccaccaccaccaccaccaccaccatcaccatcaccatcatcatgagcatggtggtggctgttgttctagtgaagcaaaggcagagaagacagagaacagaaatgcaaaggccacctgattgtgagagcaattttccttcattttgtttctttggattttgttgttgttgttatggaagaaactgggtcagtggccagttttgaatggtcgaaatgggttgtcattgtcttctgtacttgtagatttattggtgtttgttgacgattttgtcttaatatgaccttttactacttttactttatgatgcttgaatagacatgctgcatttcagcttatctgcagatttatcacttggaaataatttcgaaactattgatggttctgaagaaattatgtccatgtactttgtt

SEQ ID NO: 1044 - DNA, 538 bp, Platanus occidentalis
aaagaagaaacgaaaccctaaccctaggaatcatggtttgcattcgaaaggccaccatcgacgacctgcttgcgatgcaggcctgcaatctcctttgtctccctgagaattaccagatgaagtactacttctatcatatcctctcatggccacaactcctctacgtcgccgaagactatggtggccgcatcgtcggctacgttcttgcaaagatggaggaggaaagctcggagtgccatggccatataacctcccttgccgttctccgcactcaccgcaagcttggcctcgccaccaagctcatgactgctgctcagaatgccatggaacaggtcttcggtgccgaatacgtctcgcttcatgtccgcagaagcaatcgcgctgcgttcaatttgtataccgagacccttggttacaaaatccacgatgttgaggcaaagtactatgctgatggagaggatgcgtatgatatgaggaaacagcttaagggaaagcagtatcagcatcagcatcatcatcatcaccatcatcatcacgg

SEQ ID NO: 1045 - DNA, 815 bp, Raphanus sativus
gaagcccccaaatctgcagcaggagcagccatggtgtgcatcaggcgagcgacagtggacgatctgctggctatgcaggcctgcaacctcatgtgcctccccgagaactaccagatgaagtactacctttaccacatcctctcttggcctcagcttctctacgtcgccgaggactacaacggtcgcatcgtcggctacgtcctcgccaagatggaagaggagagcaacgagtgccacggccacatcacttccctcgccgttctccgcactcatcgcaagctcggcctcgccactaagctcatgaccgccgcccaagctgccatggaacaggtttatggggcagagtatgtttcattgcatgtgaggaggagtaaccgagcagccttcaatctctacacggagacattaggctaccagattaacgatgtggaagccaagtattacgccgatggagaggatgcctatgatatgcgaaagaatctcaagggtaagcagattcatcagcaccacagcgccggccacgctcatcatcaccatggaggtggttgttgttcagctgatgctaaacctgttgaaacaacaactcaagctgaagctacaagttccaagtgagactccactctgtgagtagattgggctttagctctaatactgctcactctttttccattcatatgatttttgtttgagtgtctaaaatacatttgtgtttgttttccattgtcttctccaatcttttttctatgtatcaatgtttctttcagaagtaccaaccttgttttctccttttaaggctttacaactttagattgaca

SEQ ID NO: 1046 - DNA, 549 bp, Tripterygium wilfordii
agcgacgatggacgacctgcttgcgatgcaggcctgcaacctgctttgcctgccggagaattaccagatgaagtactatctctatcacactctctcctggccccagcttctctacgtcgccgaagactacaatggcaagattgtcggttacgtccttgccaagatggaggaggagtcgaacgagtgccatggccatattacctctctagctgtcctccgcacccaccgcaaacttggcctcgccaccaagctcatgaaagccgcccaagccgccatggagcaggtgtttggagcagagtatgtgtcacttcacgtgaggaagagtaatcgtgcggcatttaatctgtacactgaaacattgggttataagattgatgatgtagaggcaaagtattatgctgatggagaggatgcatatgatatgcggaagcagctgaagggtaagcagaatcaccatcatggtcatcatcaccaccatcatcatcagcatggtggtggttgttgctccggtgagcccaggagtgcagaaccaagaggggaggcaaaatc

SEQ ID NO: 1047 - DNA, 2914 bp, Eutrema parvulum
aattcgtccccagattaaaagaccgaagcaattacatagaccgaaaccctaagccctctttttatcacacccgcgagagaagagaagaaaattgagcagccatggtctgcatcaggcgagctacggtggatgatctgctggcgatgcaggcctgcaatctcatgtgtcttcctgagaactaccagatgaagtattacctctatcatatactctcttggcctcagcttctctacgttgccgaggactacaatggtcgcatcgttggctatgtcctcgcgaagatggaagaggagagcaacgagtgccacggccatatcacttctctcgccgttcttcgcacccatcgcaagcttggtcttgccactaagctcatgaccgccgctcaggctgccatggaacaggtttatgaggcagagtatgtttcacttcatgtgaggagaagtaaccgagcagcattcaatctctacacggagacacttggctacaagattcacgatgtagaagccaagtattacgcggatggagaggatgcctatgacatgcgaaagcatctcaagggtaaacaaaaccatcagcatggccacggtcatcatcaccatggaggtggatgttgttcaggtgatgcgaaagttgtagaaacagctcaagccgaagatgctaaagcaacaagctcgaagtgagactcaaaagcaggatgaccaaaacaggtgactgagtgtactggggtgtgttcgctggctagctctaatactgctcattattttccattcatatgatttcgagtgttaagtacatttggtaaccactcttgtgtttcttccattccaatcttttttacgtatcaatgttttgaaaattccaatgttcgccttacggttttacaacttcagatggaaatcttctatttgcaagataggagatctctatggcactatagtacatttaattacaataaaatttttttgacgttcttcagttttcctttcaattcaagaaccctgaaaagttctaatattcttcatattcgaatatcttgaagcagtagtttgtgctgtgtcaaagctttcctgcaaccacttgatctgggaattaaggccagcatcacgcagagcgtttaaagctgaggaatatagcctcgcatcaagcctggttctgtcagctttcatgtcctgcaacagcctcattagctcatcaatcctgctggttttggagaatataccgaccatgattcctgccatggccctatcaatccgtcctctgttcaacctaaactcctggtaaagctccacacatgtctcaaactcttttgctcggttatatgcactgatcatgcttgtgtaactcaccttgtccggaaacaccttcatcctcttcatctctttccatatcttctcgacccgcctcaagtccatagctcttccatgcatatcaatcaaggaattgtaaatccaaatgttgggtctacaccctctttgtttcatcttagccaagagtttcaccgcatcgcttagcctccttgttttcccgtacatatccataatgtttgagtatgcgacaacgcatttgtcaagtcccttcttcaccatctcttcaaacaacatttcagccttgtcgttctcctctagccgacagtatgcattgattgttattgcgtaagtcacttgcccagcttcacattcttgcttcataagccactcataagccttgactgcttccgcaaaccctctttgcttacaaaatccattcacaatcgcgcagagaatgcagtcagagaccttcaattcgcccttcctcatcgcggacacaacctctagagttctctccatttttccttctcggacatacatcaatacaaccttcaaacacatttctggatccttcaacagcttcttctcttctgcttctttgaatagcttctcgaccgttacaacctctcgggcttccgctaaggcacggatgagcgtagagtacaatgcactactttgtggaattcctttatcttttatctcctccaaaaactctacagcttcgaatgcccgtcctgagtttgcaagagacgagcataaaatcgcgtagatagagcctgattccttggccaagaaactcaacctaatgctcttaaactcttgaaacagctcaaccaccttttgattgtcatcaatcctctcatgagcctccattatcctgcaataacagccagggctaggctcaatacccacagtttgtttcaacctatcaaacacttggatcgtgctactatacatctggagtttgttaaagcctttcatcgctgagtcagatgcagacaccgccaatgttttttctgatctaaacacgttaagcaagcaatgcgtaatccggaattttctctctctaatgcaactcctgatcagtttggaacacgtgtgagcatcgggcaacgctttatattccttgagatcctcacaaagcgtgacgagcaaatcccagttcttgcaactcaccaagtaattaatcagatgctttgtcgtcctcagctctgagttctccttagctttctcgtagaactcagaagaaagtttatgggtttccgggtctcggagcaacctggataaaacccggttaaggccttccggggcaggttcgaaaaatggccacttgtcttctttgtgactcggcgacttcttttcatcttcctcaagaaccagagagcatcgagacgagcagacgtgagaagtgttaggcttttgggaaagaaagaaaacgggtttggtcggagaggtgaagctgtgtgggtttgcattgtggttcacggtggctacccacgatctgctcacggtggccatctgtttgtgtgtgaaggagaaggagagggagagatctctctctcctcgtcttctctttctttcacttgtggatttaattttttagttca

SEQ ID NO: 1048 - DNA, 1023 bp, Humulus lupulus
ccccttgagaaggcctagaaccaatcaatccgattccctcaaaccctaaaccagagaaaccctagattcctcaatccaatcccaaccatggtgtgcatacgcaaggccacgatagacgatcttctggcgatgcaagcctgcaacctgttctgccttcctgagaattaccagatgaagtactacctctaccacatcctctcatggccgcaacttctctacgtggccgaggactacaacggccgaatcgtcggatacgttctggcaaagatggaggaggagagcaacgagtgccacggccacatcacctcgctcgccgtgctccgaacccatcgcaaactagggctcgcgaccaagctcatgagcgcagctcagaacgccatggaacaggtatttggagctgagtacgtttctcttcacgttaggaagagtaatagagctgcttttaacttgtatacccagactttggggtataagattcatgatattgaggctaagtattatgctgatggagaagatgcttatgatatgaggaaagagcttaaggggaagaagattcatcagcatgtgcatgctcacggtcatagtcatggtcatggccatcatcatcatcaccatggacatggtggtgggtgctgctctggtggtgagcccaagagtgtggaggccagaggcggtaccaaggctgagaaagctaaagctgactccaaaactggctgagaatcgagaaatgaaatgtgggtagtaaagatttaattctttttggtttactttacctttattttatctgattgttctggcttggtaatttgaataatgcatttttggattgggaaatctaattatatattatgtgtgtttcctaatgtagcattaccatatatatattatggcttgggtagatagaatgtgttgtatgagctctttggtttaatggagtattcttgtgctttttgggcagcaatagattcttataccattgagagtcgtttggtttatacagttctctattgaatatttactggc

SEQ ID NO: 1049 - DNA, 619 bp, Brassica oleracea
aagccccctctagagaatcgcaatcctccgcagcagccatggtttgcatcaggcgagcgacggtggacgatctgctcgcgatgcaagcctgcaacctcatgtgccttcccgagaactaccagatgaagtactacctctaccacatcctctcttggccccagctcctctacgtcgccgaggactacaacggtcgcatcgtcggctacgtcctcgccaagatggaagaggagagcaacgagtgccacggccacatcacttccctcgccgttctccgcacccatcgcaagctcggcctcgccactaagctcatgaccgccgctcaagccgccatggaacaggtttatggggcagagtatgtgtcattgcatgtgaggagaagtaacagagcagcgttcaatctctacacggagacattaggctaccagattaacgatgtggaagctaagtattacgcggatggagaggatgcctatgacatgcgaaagaatctcaagggtaagcagattcatcaccacgcaagccacggccatcatcatcaccaccatggaggtgggtgttgttcaggtgatgctaaagttgttgaaacaactcaagctgaagatgctaaagcaacaagttc

SEQ ID NO: 1050 - DNA, 2880 bp, Eutrema halophilum
tcgtccccagattaataaagcccgacgccattagacccgaaaccctaaccccaaatttatccccgataggagagagaagagaagaagacgtagattgagcagccatggtctgcatcaggcgagcgacggtggatgatctgctggcgatgcaggcatgcaatctcatgtgtcttcctgagaactaccagatgaagtactacctctaccatatcctctcttggccgcagcttctctacgttgccgaggactacaatggtcgcatcgttggctatgtgctcgccaagatggaggaggagagcaacgagtgccatggccatatcacctctctcgccgttcttcgaacccatcggaagctcggcctcgccactaagctcatgaccgccgctcaggctgccatggaacaggtttacgaggcagaatatgtttcgctgcatgtgaggagaagtaaccgagccgcatttaatctgtacacggagacattaggctacaagattcacgatgttgaagcaaagtattatgcggatggagaggatgcctatgacatgcgaaagcatctcaaggggaagcaaaaccatcaccatggccacggtcatcatcaccatggaggtggatgttgttcaggcgatgcaaaagttgtagaaacagctcaagctgaagaggctaaagcaagttcgaagtgagactttaaagcaggatgaccaaaataggtaattatgagtattattagagtggggtttgctggctggctctagtactgctccctattttgcagtcatatgttctcgagtggcaaatacattatgtttttctccattgtcttcctttggttgtacttgatatctagtcctcttttgtttatgtatcatgtttcagaaatccaattgttttcttaaggctttacaacttgagatggaaatcttctatttgcaagatagcagatctctgtgacaatgtattacatttaattacaaaagaattcttgacttctacagtttcaacttcaattcaagaaccctgcaaagttgttttactcttcgtattcgaatatcttgaagcaccggtttgtgctgtgtcaaagctttcctgcagccatcttatctgggaattgagaccagcatcacgcagagcattcaaagctgaggagtagagcctcgcatcaagcttggttcgttcaactttcatgtcctgcaacagtctcattagctcatcaatccggctggttttggagaatacaccgaccatgattcctgccatggccctatcaatctttcctctgttcatcctaaactcgttgtaaagctccacacatctctccaactcttttgctctattacacgcaccgatcatgcttgtgtaactcaccttgtcaggcaacaccttcatcctcttcatctctttccatatcttttcgacccgcctcaagtccatagctctcccatgcatatcaatcaaagaattgtaaatccaaatgttgggtttacatcctctctgtttcatcttagccatgagtttcactgcatcgcttagcctccttgttttcccgtacatatctataatgtttgagtatgcaacaacgcatttgtcaaatcctttgtttaccatctcatcaaacaacatttcagccttctcgtactcctctagtcgacagtacgcattgatggttattgcgtaagtcacttgtccagcctcacattcttgcttcttaagccactcgtaagccctaactgcttccgcaaaacctctttgcttagaaaatccattcacgatcgcgcagagaatgcagtcggagacccttaaatcgttcttcctcatagcggccacaacctctagagttctctccatttttccttctcgaacatacatcaatacaaccttcaaacacatttctggatccttcaacagtttcttctcccctgcttctttgaatagcttctcgaccgttgtaacctctcgagctcccgctaaggcacggatcagcgtagagtacaatgcactagtttcctgaattcctttgtctttcatctcctccaaaaactcaagagcttcgaatgcgcgtcctgattttgcaagggaggtgcatagaatcgtgtagatggagcctgattccttggccaagaaactcaacctcttgctcttaaattcttgaaataactcaaccactttttgattgtcaccgatcctttcatgagcctccatgatcctgcaataacatcccgggcttggctcaactcctacatattgtttcatcctatcaaacacttggatcgtgctactatacatctggagtttgttaaaacctttcatcgccgaatcagttgcgaacacagccaatgttttgtctgatctaaacacgctaagcaagcagtgcgcaactcggaactttctctctctgatgcaactcctgatcagttgggaacacgtatgagcatcaggcaacgcattgtattccctgagatcctcacaaagcgagacgagcaagtcccagttcttggcattcaccaagtaattgatcagatgcttggtcgtcctcagctctgagttctccttggctttctcgtaaaactctgaagaaagtttctgggtttcaggatctcgtagcaacctggataagaccaggttaaggccatcagggacaggttcgaaaaatggccacttgtcttgtttagaactcggtgacttcttttcatcttcctcaagaaccagagagcatcgagacgagcagacgtgggaaatgtgaggcttttgggaaagaaagaaaacgggtttcttcggagaggagaagctgtgtgggtttgcatggtggttcacggtggctacccacgatctgctcgcgatagccatctgtttaagcgtgtgtgagggtgagggagagatctctct

SEQ ID NO: 1051 - DNA, 709 bp, Actinidia deliciosa
  misc_feature (419)..(419): n is a, c, g, or t
  misc_feature (423)..(423): n is a, c, g, or t
  misc_feature (432)..(432): n is a, c, g, or t
  misc_feature (450)..(450): n is a, c, g, or t
  misc_feature (485)..(485): n is a, c, g, or t
  misc_feature (516)..(516): n is a, c, g, or t
  misc_feature (528)..(528): n is a, c, g, or t
  misc_feature (542)..(542): n is a, c, g, or t
  misc_feature (552)..(552): n is a, c, g, or t
  misc_feature (555)..(555): n is a, c, g, or t
  misc_feature (558)..(558): n is a, c, g, or t
  misc_feature (560)..(560): n is a, c, g, or t
  misc_feature (574)..(574): n is a, c, g, or t
  misc_feature (578)..(578): n is a, c, g, or t
  misc_feature (584)..(584): n is a, c, g, or t
agagagaccctaaccctagaagctgcgatggtgtgcatacggaaggcgacgatcgacgatctgctggctatgcaagcgtgcaacctgttttgcctgccggagaactaccagatgaagtactatttctaccacatcctgtcgtggccgcagctgctgtacgtggcggaggactacggcggcaagatcgtcggatacgtgctggccaagatggaggaggagacctccgagtgccacggacacatcacctccctcgccgtcctccgcactcaccgcaagctcggcctcgccaccaagctcatgaccgccgcccaaaacgccatggaacaggtgtttggggccgaatacgtgtcgttgcacgtgaggaagagtaatagggcagcatttaatttgtatacagagacattgggttacaagattcntgangtggaggcnaaatactatgccgatggngaggatgcatatgatatgaggaagcagctgaaggngaagcaacatcaccatcaccaccaccaccancatggtggtggntgttgctccggtgnggcagtgaanagnggngnggcgaagacagagncggnagagtnatgggcaagagtccctatcttataggcgcaatcggttaaatgtgtgatattagtcggtgactggtcaaataaggattgcacttggtagatcttcttgctgcagcattctgtgtttttggaagttt

SEQ ID NO: 1052 - DNA, 706 bp, Olea europaea
cccctaaattattaaccactcggagtcccgaaaaccaaaccctaatcgaaactatggtgtgcatcaggaaagcaacagtagatgatctgttggctatgcaagaatgtaatttgttctgcctgccggaaaattaccagatgaaatactatttttaccacatactctcctggccgcagcttctctacgttgcggaggactacaatggcaaaatcgtgggctatgttttggccaaaatggaagaggagagctccgagtgccatggccacatcacctcgcttgccgtgctcaggacgcacaggaaactcggcctcgcgactaagctcatgactgctgcccagaatgccatggaacaggtgtatggtgcggagtatgtgtcacttcacgtaaggaaaggcaataaggctgcatttaatttgtatacagagacattagggtatacaattcatgacgtggaagcgaaatactatgcagatggggaggatgcatatgatatgaggaagcaattaaaggagaggaagcatcatcaccatcaccaccaccatcatcatggtggtgcatgttgttccggggatttgaagcctggtgagaaggctgcatcaacagaagccaaagcagagtaatggtaaagtattcaggatttggattttatcatgttacttattatatttactatatgaaagaaagtgtaccaatgaagtttcttttt

SEQ ID NO: 1053 - DNA, 973 bp, Arabidopsis thaliana
aaccctaacccctctttatccgcgcgagagcaattgagcagccatggtttgcatcaggcgagcgacggtggatgatctgctggcgatgcaagcctgcaatctcatgtgtcttcctgagaactaccagatgaagtactacctctaccatatcctctcatggcctcagcttctctacgtcgccgaggactacaatggtcgcatcgttggctatgtcttggctaagatggaggaagagagcaacgagtgccacggccacatcacttctctcgccgttcttcgtacccatcgcaagctcggtctcgccactaagctcatgaccgccgctcaagctgccatggaacaggtttacgaggctgagtatgtttcgttgcatgtgaggagaagtaaccgagcagcattcaatctatacactgagacattaggctacaagattaatgatgtagaagcaaagtactacgccgatggggaggatgcttatgacatgcggaagaatctcaaggggaagcagaaccatcaccacgcccacggtcatcatcatcaccatggaggaggatgttgttctggtgatgcaaaagttgtagaaacagctcaagccgtagatggtaaagcagtttccaaatgagattcgaaagcagataattatgagtatattgaggtgggttcactggctcgctctagtacttctcactatttccattcatatgattccgagtgacaaatacatttggtgaccactctgtgttactcctttgtctttctttggttgtattgaaaatttagccgttcctttttttgatgtatcattttggaaattccaagctttcattaaggctttacaacttaagctggaaatcttctatttgcaagatagcagatctctattggcaatatagtacatttaattacaagaaaaataatcttggcttgtacagttttccctttcaacttaaagttcctgtgttctttgtattcg

SEQ ID NO: 1054 - DNA, 683 bp, Carica papaya
agagactgaaccgagcaaaatcaggcacgatttcgaaagagtaaaccctaaccctaaatccaaacccctcagatactcgcaaccatggtgtgcatacgtaaggcaacggtggacgacctgttggcaatgcaggcatgcaatttgatgtgcttgccggagaactaccagatgaagtactacctttaccatattctctcatggccacagcttctctacgtcgccgaggactacaacggtcgaatcgtcgggtacgtcctagcgaagatggaggaggagagcaatgagtgccatggtcatatcacctccctcgccgtcctccgtactcaccgcaagctcggtcttgccacaaagctcatgaacgccgcacaggctgccatggagcaggtgtttggagcggagtatgtttctctgcatgtgaggaagagtaaccgggctgcatttaatctgtatacagagacattgggatataagattcatgatgtggaggctaagtattatgcagatggggaggatgcctatgatatgagaaagcagctaaaagggaagcagattcatcatcattctcatcatcaccaccaccatcatcatcaccaccaccaacatccgcaccagcatggtggtggttgttgtgctggtgatgcgaagaacacagaatcaactcaagcaaggggggaagctaaatc

SEQ ID NO: 1055 - DNA, 968 bp, Arabidopsis lyrata
aaccctaacccctctttatccgcgcgaggcattgagcagccatggtttgcatcaggcgtgcgacggtggatgatctgctggcgatgcaagcctgcaatctcatgtgtcttcccgagaactaccagatgaagtactacctctaccacatcctctcatggcctcagcttctctacgtcgccgaggactacaatggtcgcatcgttggctatgtgttggctaagatggaggaagagagcaacgagtgccacggccatatcacttctctcgccgttcttcgtacccatcgcaagcttggtctcgccactaagctcatgaccgccgctcaggcagctatggaacaggtttacgaggcagagtatgtttcactgcacgtgaggagaagtaaccgagcagcattcaatctgtacacagagacattaggctacaagattaatgatgtagaggcaaagtactacgccgatggggaggatgcttatgacatgcggaagaatctcaaggggaagcagaaccatcaccacgcccatggtcatcaccaccatggaggtggatgctgttcaggtgatgcaaaagttgtagaaacagctcaagccgtagatgctaaagcagtttcgaagtgagacttgaaagcaggtaattatgagtatattgaggtgggttcgctggctcgctctagtactgctcactattttccattcatatgatttcgtgtgacaaaaatacatttggtgaccactctgtgttactcctttgtctgtctttggttgtattgaaatttagccgttttttttttctatgtatcatgttttggaaattccaagctttcattaaggctttacaacttcagctggaaatcttctatttgcaagatagcagatctctattggcaatatagtacatttaattacaaaaaaaatcttggcttgtacagtttccctttcaacttaaagttcttgtgttcttcgtatttg

SEQ ID NO: 1056 - DNA, 805 bp, Musa acuminata
gttggcgagttcttatcagcatcatcggctccttctaaccctaacgtgtcgagagagacgggaagacgaagaagccgatctctcctccttccgccggccgatcaaacccatccatcaatcggtcgatcgaattgttaattggaggaggatatggtttgcatacggcaggcgacggtggaggatctgctggcgatgcaggcctgcaacctgctgtgcctgccggagaactaccagataaagtactacctctaccacatcctctcctggccgcagctgctcttcgtggccgaggactacggcggccgcatcgtcggctacgttctcgccaagatggaggaggacgcctccgagccctgtcacggccacatcacctccctcgctgtcctccgcacccaccgcaagctcggcatcgccaccaagctcatgaccgccgcccagaacgccatggagtccgtcttcggcgccgagtacgtctccctccacgtccgccgcagcaaccgtgccgccctcgtcctctacacctccaccctcggctacctcatccacgacgtcgaggccaagtactacgctgacggcgaggacgcttatgacatgcgcaaacaattcaaggttcggcctcatacccacggccatggtcaccaccaccaccaccatcaccgtggaggctgctgctcagtggaggcgaagaatgcagttgctgcaagtgcaggtacatctgcttcagctccagctccagcttcggcctccggggagtgagaaacttgcggctaagatgactttgtgatgtattgactgaattaggagc

SEQ ID NO: 1057 - DNA, 772 bp, Antirrhinum majus
  misc_feature (174)..(174): n is a, c, g, or t
  misc_feature (698)..(698): n is a, c, g, or t
  misc_feature (725)..(725): n is a, c, g, or t
cgaattcggcacgagctaaaaaaaccctagaatccgaaacgccgtcgtatcagcatggtttgcatcaggaaagcgacggtggacgatctgctggcgatgcaagagtgcaatttgttctgtttgccggagaattatcagatgaagtactatttctaccacatcctctcttggccncagcttctgtatgttgctgaggattacaacggcaaaattgtgggctacgttttggccaaaatggaggaggaaccgaccgaatgtcacggtcacatcacctcactcgctgttctgagaactcaccgtaaattagggctcgctactaagctcatgaccgccgctcagaacgcaatggaacagatttacagggcagaatacgtgtcactgcatgttagaaaaagcaatagggctgcatttcatttgtatactgagacactaggctacaagattcatgacttagaggcaaaatattacgctgacggggaagatgcctatgatatgaggaagcaattgaagggtaagaggcaccaccaccaccaccatcatcaccatcacggtggtggctgctgttctgctgatgcgaaaccagatgaaaaggttgcatcaacggaggccaaaacggcgcagtgaggctaaatttgggggtcagagttgtcttgtttgttccatttgataaaatgagatcttatttaagcttcacttanatataagaaaaatgtactgaatatatntaaacattctgtgccggtagttttgcttgcattgtccgcaaatatgt

SEQ ID NO: 1058 - DNA, 1044 bp, Elaeis guineensis
ggcggcgttggcggcagcgaagatggtgtgcatccgtcaggcgacggtggaggatctgctggcgatgcaggcgtgcaacctgctctgcctcccagagaactaccagatgaagtactatctgtatcacatcctgtcgtggccgcagctcctcttcgtcgccgaggactacggcggcaagatcgtgggctacgtcctggccaagatggaggaggatgcctcggagccatgccatggccacatcacctccctcgccgtcctccgcacccaccgcaagctcggcctcgccaccaagctcatgaccgccgcccagaacgccatggagtccgtcttcggcgcggagtacgtctccctccacgtccgtcgcagcaaccgcgccgccatcaacctctacacctccaccctcggatataagatccacgacgtcgaggccaaatactacgccgacggcgaagacgcctacgacatgcggaagcagctcaagggccgccccgctccccatcatcacggtcatggccaccaccacgctggcggtgcctgctgctccggggatgccgggaagccggtggaggctgatactggtactggcgcttctgcctctgcctctgctcctgctaatgcgggagagcgaagggctggtggcgtctaatcgaggtaatttcgtggatcttggtgcccggagttacggttctcttctccttgctgaattgctgttagttgtcttgttttccttgtatactggaatagctgcaagttcttgttagtatgttcttgatttggagttgattcttggatgactgaaccaggaagaaaagaacagtttctgaaaatttaagatggtcctgtatccgattattatgtatatgattatgttttgtgcgagaagaaactaaatgcttgaagttgggtctggatgttatctttgtttttttttgtttttgtttagattagtagagtagtgttgtcactagtagtagttagacgtactagtcgtcttacgtaggacgtacgtaccgaaccgaacggacgacgacggagggtagaggg

SEQ ID NO: 1059 - DNA, 962 bp, Zingiber officinale
  misc_feature (127)..(127): n is a, c, g, or t
  misc_feature (640)..(640): n is a, c, g, or t
  misc_feature (771)..(771): n is a, c, g, or t
gcttagccggcggtcggcggactctggttgtcgcccgcccacctctcccaaaggccactccgcacccttcgctagtgatctcgttcctcggatctcgcaggccagtctctccagccagccgccctcngtcggtagtcggtacagttaatccagtgaaagcgaaggagaaggaaatggtttgcattcgacaggcgaccgtcgatgatctgctggcaatgcaggcatgcaacctgctatgcctgccagagaactaccagatgaagtactacctttaccacatcctctcctggccacagctcctctttgtcgcggaggactacgacggacgcatcgtcggctacgtgcttgccaagatggaggaggatgcctccgagccttgccacggccacatcacctccctcgccgtcctccgcacccatcgcaagctcggcctcgccaccaagctcatgactgccgcccagaatgctatggagtctgtttttggggctgagtatgtatctctccatgtccgccgcagcaaccgcgctgccttcaccctctacacctccagcctcagctatcgcatccacgacgtggaggccaagtactatgctgatggggaggatgcctatgacatgcgcaagcagctgaagggccgtcnccatgcccatagccatagccacggccatcatcaccaccaccatcatggaggctgctgctcaggggagtctaaggctgcatctcccgtcgacgttggtgcagcagctgatccaggcactggtgcatctgggnccaattcttcagctccagcttctgctgctggggcgtgagaaactcatctccaaggtgcacttagtactatgctcttgatgtctcggactcagagttgccatatctctgaaaattgagtgtttatgattatatttaaggtatttgtatggattcttttagttcttatttatatcgacgaacttcaaaaaaaa

SEQ ID NO: 1060 - DNA, 889 bp, Manihot esculenta
tgaagagcgtaaaaacctaaccctaaacaccgaaaagagcttgagaaaaccagcaatccaaccatggtgtgcataaggaaggcaacaatagatgacctactagcgatgcaggcttgtaacctgctatgccttccggaaaactaccagatgaagtattatttctaccacatcctctcctggccgcagctcctctatgtcgccgaagactacaatggtcgcatagtgggctacgtgttggccaagatggaggaagaatctaatgaatgtcatggtcatatcacctctcttgctgtcctccgcacccaccggaagttgggactcgcaactaagctcatgagtgcagcccagactgccatggaacaggtgtttggagcagaatatgtctcactacacgtgaggaagagtaatcgggctgcatttaatctgtacacagaaacgttgggctataagattcatgatgtggaggcaaagtattatgcagatggagaggatgcatatgatatgcggaagcagcttaagggaaaacagattcatcatcatggacaccatcatcatcaccaccatcacggtggtgggtgttgtgcaggtgataccaagcctgtggaagcaagagcagacacaaaatcagaggcaaaagccggcacgaaatcagaatcaaaagcaggctgatgattgtaagtatacccaatatttggataacagcgcaattatctcttgttgagtgattaaggttgtagtgattattataattatagtttgtttctggttgtaataatgcagtgaaggacctggatttgcatggctatttccagtcatagtttccacatacattgtgatgaacattgttgtgtaattgttcttgcacctttatcataagatacattttatt

SEQ ID NO: 1061 - DNA, 1260 bp, Picea glauca
aacgtcgtggaatcgtgtcgaccaaacgacgaactccaccaccggtacagaggatgaccggattccttcggttgggcaatttcgtttatttgaggttgggaccaaaccctagcgctttgacaatctaaagggaaactcgatccttcagtgagagttatcgtaggaggaaccgagggagcaagcccttgaagaataaaaagaccaggagattaaaagaagtatccaacagagagcaataaatcgggagggtttctgcacataaactctgttacacaatatatattccagggtttaagcacaatatatgttctagggtttaaacccaccgtggtttgcagccatggtttgcattcgtcaagccacaatagacgacctgcttgcaatgcagacatgcaatttgatgtgtctgccggagaattaccagatgaagtattatttctaccacatcctatcatggccgcagcttctctatgtggccgaggattacaacaagaaaattgttgggtacgttctggcgaaaatggaagaggagtccacggaatgccacggccatataacctctctggccgtgttgcgcacgcaccgcaaactgggccttgcaacgaagctcatgaccgcagctcagaaggcaatgcatgaggtttttggggcagagtatgtttctctccatgtccgcaagagcaaccgggcggcgtttcacctgtacacccaaacactgggatataaaattcacgatattgaggctaagtactatgctgatggcgaggatgcctatgatatgcgcaaacagctgaaagtgaagtctgatggtaagcaccatcatcatcaccatcatcatcagcattctgggggttgctgcagcggagacggtggtgatgggaaattacagtccgcagttgataaaaagagcaaggaatgaacctcaattggaagggaagctgttgagatttgcggccttctcgaccgcttctgttgcggttagcacattgaactcttttgttgtagatgtttggcctgcaaatgatgatatgaattcatattgttattatgctattttgctttttattgtaagacaaagtctttcagttgtctgcaagagctgcgtatctcttcctgttgtggggactggaattcattgcctgctatgaaaccgcgttgaacgcttgtcatgtagatacttgacttacaaatgatgatagtttatacatattgttatcatgctgtttttcttttattgtatgacagtctttcagttgtctt

SEQ ID NO: 1062 - DNA, 2896 bp, Brassica rapa
aactcgtcaccagattaaatcctctcgataccactagaccaaaaccctaagcccccttagtgaatcgaatcgagtccgcagcagcagccatggtgtgcatcaggcgagcgacggtggacgatctgctcgcgatgcaagcctgcaacctcatgtgccttcccgagaactaccagatgaagtactacctctaccacatcctctcttggcctcagcttctctacgtcgccgaggactacaacggccgcatcgtcggctacgtcctcgccaagatggaagaggagagcaacgagtgccacggccacatcacttccctcgccgttctccgcactcaccgcaagctcggtctcgccactaagctcatgaccgccgctcaagccgccatggaacaggtttatggggcagagtatgtttcattgcatgtgaggagaagtaaccgagcagcgttcaatctctacactgagacattaggctaccagattaacgatgttgaagctaagtattacgctgatggagaggatgcatacgacatgcgaaagaatctcaagggtaagcagattcatcaccacgccagccacggccatcatcatcaccatggaggtgggtgctgttcaggcgatgctaaagttgttgaaacaactcaagctgaagatgctaaagcaacaagttccaagtgagaaactcaaaagcaggtgaatctgtgagtatattggactagctctaatactgctcagtgtactccattcatatgattttgttgagtgtctaaaatacattttggtaaccactcttgtgttgtttttctattctcttctcaatcttttctatgtatcaatgtttcagaagtaccaactttgttttccttgaggctttacaactttagattgaaatcttctatttgcaagataatacatttagtttacaaaagaatcttgacttgtacagtttccttttcaactcaagaaccctgcaaagttcttttgttctttacattcgaatatcttgaacttgaagcactagtttgtgctatgtcaaagctttcctgcaaccatctgatctgtgagttaagaccagcatcgcggagagcattcaaagcagaggaatacagcctggcgtcgagcctagttctttcgactctcatgtcctgcagcagcctcatcagctcatcgatcctgctggttttcgagaacacgccaaccatgatccccgccatggccctatcgatttttcctctgttcatcctaaactcatggtaaagctccacacacgcctcgaactctttcgctctgttgtaagcgctgatcatgctcgtgtagctcaccttatccggcaacaccttcatcctcttcatctctttccatatcttctccacccgcctcaagtccataccccttccgtgcatatcgatcaatgagttgtaaatccaaatgttgggtctgcatcctctttgcttcatcttagccattagcttcaccgcatcgctcagcctcctcgtcttcccgtacatatcgattatgttcgagtacgccacgacgcatttgtcgaaccctttattcaccatctcttcgaacagcttctcggccttgtcgtgctcctctagccggcagtatgcgttgattgttattgcgtaagtcacttgccccgcctcgcattcttgctttgtaagccactcgtaagccttgaccgcttctgtgaagcctctctgcttgcagaatccattcacaatggcgcagagaatgcagtcggttacctttaactctcccttcctcatcgcggccacgacctctagagtcctctccatgttcccttctctgacgtacatcaacacaaccttcaaacacatctccggatccttcaacatcttcttctcacctgcctctttgaacagcttctccaccaccataacctcgcgtgcttctgctaaggcgcggattaaagtagagtacaatgcactactctgaggaatgcctttatctttcatctcctccaagaactccagagcttcgagtgctcgtcctgatttcgcaagggacgagcacaagaccgtgtagatagagcctgattctttagccaagaaactcaacctcttactcttaaactcttgaaacaactcaacaaccttttgactatcaccaatcctctcatgagcctccatgatcctgcagtaacagccagggctcggctcaacctcttgctgtttcatcctatcaaacacttggatcgtgctgctatacatctgtaacttgttaaaccctttcatcgctgcatcagatgaagaaaccgccagtgttttgtctgttctaaacacgttaagcaagtaatgcgtaatcctgaatttcccttgtctgatgcagcttctgataagctgggaagaggtatgaagatcaggcaaggctttgtgttccctgagatcctcacaaagagagacgagcaagtcccagttcttggaactcaccaagtggttgatgagatgcttggtggtcctcagctctgagttctctttagctttctcgtagaactctgaagaaactttgtgggttttcgggtcttggaggtacttggataagacccggttaaggacgtccggggcaggttcgaaaaatggccacttgttgtcttgtttccgaccgggtgacttcttttcatcttcctcgagaactagagagcatcgagacgagcagacgtgaggcttttgggtaaggaagaaaacaggtttggtcggagaggtggtgaagctgtgggggtttgcatggtggtggtggttcacggtggctacccacgacctgctcaagatgaccatctgtttgtgtgtgtgtgggaaggagacggagagggggagagacctctctcccttgtcttttttgctttcacttgtggatttaattttttttagttcaac

SEQ ID NO: 1063 - DNA, 920 bp, Brassica rapa
aactcgtcaccagattaaatcctctcgataccactagaccaaaaccctaagcccccttagtgaatcgaatcgagtccgcagcagcagccatggtgtgcatcaggcgagcgacggtggacgatctgctcgcgatgcaagcctgcaacctcatgtgccttcccgagaactaccagatgaagtactacctctaccacatcctctcttggcctcagcttctctacgtcgccgaggactacaacggccgcatcgtcggctacgtcctcgccaagatggaagaggagagcaacgagtgccacggccacatcacttccctcgccgttctccgcactcaccgcaagctcggtctcgccactaagctcatgaccgccgctcaagccgccatggaacaggtttatggggcagagtatgtttcattgcatgtgaggagaagtaaccgagcagcgttcaatctctacactgagacattaggctaccagattaacgatgttgaagctaagtattacgctgatggagaggatgcatacgacatgcgaaagaatctcaagggtaagcagattcatcaccacgccagccacggccatcatcatcaccatggaggtgggtgctgttcaggcgatgctaaagttgttgaaacaactcaagctgaagatgctaaagcaacaagttccaagtgagaaactcaaaagcaggtgaatctgtgagtatattggactagctctaatactgctcagtgtactccattcatatgattttgttgagtgtctaaaatacattttggtaaccactcttgtgttgtttttctattctcttctcaatcttttctatgtatcaatgtttcagaagtaccaactttgttttccttgaggctttacaactttagattgaaatcttctatttgcaagataatacatttagtttac

SEQ ID NO: 1064 - DNA, 860 bp, Camellia sinensis
acagagaagaaacgaaaccctagaggaaggcaaaccaggaaatcaagcatggtgtgtatacgcaaggctaccgttgacgacctcctagcaatgcaagcctgcaacctgttttgcctgccggaaaactaccagatgaagtactacctgtaccacatcctgtcgtggccacagctcctctacgtagcggaggactacggcggcaagatcgttggctacgtgctggccaagatggaggaggagagctcggagtgccacggccacatcacctccctcgctgtgctccgtacccaccgcaaactgggtctcgccaccaagctcatgacggcggctcagaacgccatggaacaggtgtatggcgccgagtatgtgtccttgcatgtgaggaagagcaatcgagcggcatttaatctgtacacggagacgctgggttacaagattcatgatgtggaggccaagtactatgctgatggcgaggacgcatacgatatgaggaagctactcaaaggtaagcagcaccaccaccagcaccaccctcaccaccctcaccctcatcaccatcaccatcatgttggtgggtgttgctccggtgaggcagtgaagagtggggacacaaattcggaatccaaggccgggtcctctgagtgatgcctcacctcagagaggtaaattgagatttggaacaatatatttaagttatggaaattattattatgtttatttgaactatgttgtgatttgttcactggaagttttatgggtatgtgttaatggttctccatgttagtcacatcacttttttttacgtaataattcctataaaattgctttggcaagccaaaatgaaaaaacatgtcggccgg

SEQ ID NO: 1065 - DNA, 932 bp, Brassica napus
gtcatcaccagattaaaaatccccaaaaccattagaccgaaaccctaagccccctttgcgagacaagagaagagaagagaagcagccatggtgtgcatcaggcgagcgacggttgacgatctgctggcgatgcaggcctgcaatctcatgtgtcttcccgagaactaccagatgaagtactacctctaccacatcctctcctggcctcagcttctctacgttgccgaggactacaacggccgcatcgtcggctatgtcctcgccaagatggacgaggagagtaacgagtgccacggacacatcacttccctcgctgttcttcgtactcataggaagcttggtctcgccactaagctcatgaccgccgctcaggctgccatggaacaggtttatgaggcagagtatgtttcgctgcatgtgaggagaagtaaccgagcagcgtttcatctgtacacggagacgttaggctacaagattcacgatgtggaagcgaagtattacgcggatggagaggatgcctatgacatgcggaagtattttaagggtaagcaaaaccatcaacacagccacggtcatcatcatcatcaccatggaggtgggtgttgttccggtgatgcagtagatacagctcaagccgaagatgctaaagcaacgacgtcgaagtgagactgagtatattggtgtgtgtttgctggatagctagctctagtagtgctgcccaatgttttccattcatatgattttgagtgtcaaaatacatttggtaaaccactcttgtgctcgagtgtttctccattggtcttctttttggttgtacttatatttagccagtctttttttctatgtatcaaatgtttctgaaaaaaaaaaaaaaagggcggccgcgtgtagagtatccaaacctacgcggtccccagcgtcagcttcattat

SEQ ID NO: 1066 - DNA, 720 bp, Ipomoea batatas
gtttggtttcccagtggccgtgtggtcatctacagagagccatggtgtgcattcggaaggcgacgatcgatgacctgctggcaatgcaggcctgcaatctgctgtgcttgccggagaactaccagatgaagtactacatctaccacatcctctcatggccgcagctgctatatgtggccgaggattacaacggcaaaatcgtcggctacgtgctggccaagatggatgaggaggccaccgagtgccatggccacatcacctctctcgccgtcctccgcactcatcggaaactcggccttgccaccaagcttatgactgctgcgcagaacgcaatggaacaggtctttggggcagaatatgtgtcattgcatgtaaggaaaagtaacagggcagcatttaagttgtacacggagacattaggatacaagattcatgatttagaggcgaagtactacgcagatggtgaagatgcctatgatatgaggaagcaattgaagggtaagaagcatcagcagcaccaacaccaccaccaccaccacagtggaaggtgtcgctctggggaagtgagaactgaaggaaaggatggtgtggcagaagagaaggcacagtcataggcaactgtgcgttccatggtgcattccatcactctttctcactatttataaattattgtgctttgaagaagctgaaatcttgttaccatatgaaaacattgttctt

SEQ ID NO: 1067 - DNA, 897 bp, Mimulus guttatus
ccaatctagaaacccccaattgactgaacaatggtgtgcatcagaaaagcaacggtggatgatttgctggcgatgcaggagtgcaatttgttctgcctgccggagaactaccagatgaaatactacatataccacatcctctcgtggccgcagctcctctacgttgccgaggattacaacggcaaaatcgtcggctacgttttggccaagatggaggaggaatcgaccgagtgccacggccacatcacctccctcgccgtgctcaggactcaccggaaactcggcatcgccactaagctcatgaccgccgcccaaaacgccatggagcaggtatatggttccgagtatgtgtcgctgcatgtaaggaaaagcaataaggctgcatttaatttatacactgggacattagggtaccaaattaacgatatggaggcaaaatattacgccgatggagaggatgcttatgatatgaggaagcaattgaagggtaagaagcagcaccaccaccacggccaccaccaccaccatcacggtggtggttgttgttctgcagacgtgaaatcagatgaaaagcatggatcagcagaggcgaaaacagagtgataaacaacgggtcagagtttatcttatattattaaatttgctttgttagagtggaatcatcgagtacacctaacaaacacacatgttcaatgtatttgcttataataagcccttatggcgcttataaatatgcaatttgtttttttttttggaaatttatatgttaagtaatgacaattttgttttttttgtttttgttttcagtgttttggattattctgtactagctttgaattcagacaatttccatatcgttttcgagttttattggatgctatgtttttttctgggaac

SEQ ID NO: 1068 - DNA, 925 bp, Aristolochia fimbriata
acgccaataaacggttccgcacggaggccaggaaggccgagcaaaaccctcatcgttgtcgagcagccttggagggagagaatcaccgctccgaagatggtttgtattcgtcaggctaccatcgacgatctattggcgatgcaagcttgtaacctgctttgcttgccagaaaactaccagatgaagtactacttctaccacatcctctcttggccgcagctcctctacgtcgccgaggactacgggggtcgcatcgttggatatgtcctagctaagatggaggaggagagctccgaatgtcatggccacataacctcccttgccgtccttcgcacacaccgaaagctcggtcttgccaccaagctcatgactgcggcgcagaacgccatggaacaggtctacgaagccgagtatgtgtctcttcacgtacgccggagcaatcgtgccgccttcaatctgtacacggaaacgttaggctacaagatacatgacgtggaggcaaagtattatgcagatggggaggatgcctatgacatgcggaagcagcttaagggcaagcagcatcatcatcatcatggacatggccatcaccacggtcatgctcaccatcatggggcttgttgctcgggtcacgatggaaagggagcagaggcaaaagctggctctgtcgattgagatagaggtggaggtaatttggcggtctcgacttcgatagattattgtttgtagatgtgcttcaactatgcttgtaccttttattatggtcccaccatattaccggggagaacccgtttcaaaaaatattaccggggagaactgtgttgtggtgttggtggaatgtacttctattccataattaaggatttcttttttttattattactattattataatggaggtcgcttctgatagctaagttgtgct

SEQ ID NO: 1069 - DNA, 860 bp, Euphorbia peplus
ggagggggaagagcgatggtgtgcataaggaaggcgacgatagatgacctgctggcgatgcaagcatgcaacttgctatgtctgccggagaattatcagatgaagtattacttctatcacatactgtcttggcctcagcttctttatgtcgccgaagattataactcccgcatcgttggttatgttttggctaagatggaagaagaatctaatgaatgtcacggccatatcacctccctcgccgttctccgtactcaccgcaagctcggtctcgccaccaagctcatgagcgctgctcagaacgccatggaacaggttttcggagcagagtatgtttcgcttcatgtgaggaaaagtaacagggcagcattcaatttgtacacagaaactctaggctacaagattcatgatattgaggccaagtattatgcagatggagaggatgcatatgatatgcggaagcaactaaaggagaagcagattcatcatcatgggcatcatcaccatggcggtgggtgctgttcagctgacgccaagtccgtggaaggaagaccagagtcgaaatctgaggctaaagccagcactaaatgagaatcaaaagcagggtgatgatggtgagatgtacacctaatacttcagaacttggcaatggtatttttcaatgaggttgtgtactactgagccatattggttgctttaggtagtgattatgcattgcttcctcctcataatcatatattatactgagctgagcatttttatgtaatggttgttgcctcacactgtatgatacatttttgtgctgaaatttcctagttttctttcatctctttttggtaattttagtcatttagacatcg

SEQ ID NO: 1070 - DNA, 1366 bp, Picea glauca
gtcgtggaatcgtgtagaccaaacgacaaactccaccaccggtacagaggatgaccggattccttcggttgggcattttcgtttatttgaggttgggaccaaaccctagcgcttcgacactctaaagggaaactcgatccttcagtgagagttatcgtaggaggaaccgagggagcaagcccttgaagaataaaaagaccaggagattaaaagaagtatccaacagagagcaataaatcgggagggtttctgcacataaactctgttacacaatatatattccagggtttaagcacaatatatgttctagggtttaaacccaccgtggtttgcagccatggtttgcattcgtcaagccacaatagacgacctgcttgcaatgcagacatgcaatttgatgtgtctgccggagaattaccagatgaagtattatttctaccacatcctatcatggccgcagcttctctatgtggccgaggattacaacaagaaaattgttgggtacgttctggcgaaaatggaagaggagtccacggaatgccacggccatataacctctctggccgtgttgcgcacgcaccgcaaactgggccttgcaacgaagctcatgaccgcagctcagaaggcaatgcatgaggtttttggggcagagtatgtttctctccatgtccgcaagagcaaccgggcggcgtttcacctgtacacccaaacactgggatataaaattcacgatattgaggctaagtactatgctgatggcgaggatgcctatgatatgcgcaaacagctgaaagtgaagtctgatggtaagcaccatcatcatcaccatcatcatcagcattctgggggttgctgcggcggagacggtggtgatgggaaattacagtccgcagttgataaaaagagcaaggaatgaacctgaattggaagggaagctgttgagatttgcggccttctcgaccgcttctgttgcggttagcacattgaactcttttgttgtagatgtttggcctgcaaatgatgatatgaattcatattgttattatgctattttgctttttattgtaagacaaagtctttcagttgtctgcaagagctgcgtatctcttcctgttgtggggactggaattcattgcctgctatgaaaccgcgttgaacgcttgtcatgtagatacttgacttacaaatgatgatagtttatacatattgttatcatgctgtttttcttttattgtatgacagtctttcagttgtcttcaagattaagtatctcttattgtttttgctactggaattcattgcttgctttgaaacataacgaatctgtaatcgcttcggttttttacctgaaagtcatgctctgttt

SEQ ID NO: 1071 - DNA, 1215 bp, Picea glauca
ggaacgtcgtggaatcgtgtagaccaaacgagaaaccccaccaccggtacagaggatgaccggattccttcggttgggcatttttgtttatttgaggttgggaccaaaccctagcgcttcgacactctaaagggaaactcgatccttcagtgagagttatcgtaggaggaaccgagggagcaagcccttgaagaataaaaagaccaggagattaaaagaagtatccaacagagaacaataaatcgggagggtttctgcacataaactctgttacacaatatatattccagggtttaagcacaatatatgttctagggtttaaacccaccgtggtttgcagccatggtttgcattcgtcaagccacaatagacgacctgcttgcaatgcagacatgcaatttgatgtgtctgccggagaattaccagatgaagtattatttctaccacatcctatcatggccgcagcttctctatgtggccgaggattacaacaagaaaattgttgggtacgttctggcgaaaatggaagaggagtccacggaatgccacggccatataacctctctggccgtgttgcgcacgcaccgcaaactgggccttgcaacgaagctcatgaccgcagctcagaaggcaatgcatgaggtttttggggcagagtatgtttctctccatgtccgcaagagcaaccgggcggcgtttcacctgtacacccaaacactgggatataaaattcacgatattgaggctaagtactatgctgatggcgaggatgcctatgatatgcgcaaacagctgaaagtgaagtctgatggtaagcaccatcatcatcaccatcatcatcagcattctgggggttgctgcggcggagacggtggtgatgggaaattacagtccgcagttgataaaaagagcaaggaatgaacctgaattggaagggaagctgttgagatttgcggccttctcgaccgcttctgttgcggttagcacattgaactcttttgttgtagatgtttggcctgcaaatgatgatatgaattcatattgttattatgctattttgctttttattgtaagacaaagtcattcagttgtctgcaagagctgcgtatctcttcctgttgtggggactggaattcattgcctgctatgaaaccgcgttgaacgcttgccatgtagatacttgacttacaaatgatgatagtttatacatattgt

SEQ ID NO: 1072 - DNA, 1199 bp, Picea glauca
  misc_feature (38)..(38): n is a, c, g, or t
tacagaggatgaccggattccttcggttgggcattttngtttatttgaggttgggaccaaaccctagcgcttcgacactctaaagggaaactcgatccttcagtgagagttatcgtaggaggaaccgagggagcaagcccttgaagaataaaaagaccaggagattaaaagaagtatccaacagagagcaataaatcgggagggtttctgcacataaactctgttacacaatatatattccagggtttaagcacaatatatgttctagggtttaaacccaccgtggtttgcagccatggtttgcattcgtcaagccacaatagacgacctgcttgcaatgcagacatgcaatttgatgtgtctgccggagaattaccagatgaagtattatttctaccacatcctatcatggccgcagcttctctatgtggccgaggattacaacaagaaaattgttgggtacgttctggcgaaaatggaagaggagtccacggaatgccacggccatataacctctctggccgtgttgcgcacgcaccgcaaactgggccttgcaacgaagctcatgaccgcagctcagaaggcaatgcatgaggtttttggggcagagtatgtttctctccatgtccgcaagagcaaccgggcggcgtttcacctgtacacccaaacactgggatataaaattcacgatattgaggctaagtactatgctgatggcgaggatgcctatgatatgcgcaaacagctgaaagtgaagtctgatggtaagcaccatcatcatcaccatcatcatcagcattctgggggttgctgcggcggagacggtggtgatgggaaattacagtccgcagttgataaaaagagcaaggaatgaacctgaattggaagggaagctgttgagatttgcggccttctcgaccgcttctgttgcggttagcacattgaactcttttgttgtagatgtttggcctgcaaatgatgatatgaattcatattgttattatgctattttgctttttattgtaagacaaagtctttcagttgtctgcaagagctgcgtatctcttcctgttgtggggactggaattcattgcctgctatgaaaccgcgttgaacgcttgtcatgtagatacttgacttacaaatgatgatagtttatacatattgttatcatgctgtttttcttttattgtaaaaaa

SEQ ID NO: 1073 - DNA, 1063 bp, Amorphophallus konjac
gaagaagaatcatccaaatcctaaccctaaccccagcgatccatcggctgtagcagcgcgagagccaccaccagagaagatggtgtgcatccggcaggcgaccatggacgaccttctggcgatgcaggcctgcaacctgatgtgcctgccggagaactaccagatgaagtactacttctaccacatcctctcctggccgcagctcctctacgttgccgaggactatggtggcaagatcgttgggtacgttctggcaaagatggaggaggactccaccgagccctgccacggccacatcacttccctcgccgtcctccgcacgcaccgcaagctcggcctcgccaccaagctgatgaccgctgcccagaatgccatggagggcgtctacggcgccgaatacgtctccctccacgtccgccggtccaatcgcgccgcgctgaacctgtatacctccacgctcgggtacaagatccacgacatcgaggccaagtactacgccgacggcgaggacgcctatgacatgcgcaagcagctaaatgggcggagggaacaccaccaccaccaccaccaccatcaccacagtggcgggtgctgcgggggtgaggcgaagagcggcaggggtggggaggctgcggcgaagtcggggggtgctcctgccgctgcagccggcggtagcagtgctggggcttctgcttccggagaatgatcggaactatctgaagctagaaagaaatatctttccctccgttttcaaccaaactgtcctttttatggtaaatttacttgtttggttataagatttctgtatgcctttaatattgatgggaatctaatcttatcgtggaagatttggcttttggctgaggaactagaaaattggcgtatgttgatgttcagctgatttcacctttcagtgtttgttattcaaaggcagggtgaacgagtatgcgctgtcaatgtaggtgcagcctttacaaatatgtatcttgggaattgggtttgtctgtctttttgtttgtagatttcaaatgctcgatctttaacgccagtgttgcttcatatt

SEQ ID NO: 1074 - DNA, 571 bp, Brassica juncea
agcagccatggtgtgcatcaggcgagcgacggtggacgatctgctggcgatgcaagcctgcaatctcatgtgtcttcccgagaactaccagatgaagtactacctctaccacatcctctcttggcctcagcttctctacgtcgccgaggactacaacggccgcatcgtcggctatgtcctcgccaagatggacgaggagagtaacgagtgccacggacacatcacttccctcgccgttcttcgtacccatcggaagctcggtctcgccactaagcccatgaccgccgctcaggctgccatggaccaggtttatgaggcagagtatgtttcacttcatgtgaggagaagtaacagagcagcattccatctgtacaatgagacgttaggctacgagattcacgatgtagaagcaaagtattacgcggatggagaggatgcgtatgacatgcggaagtattttaagggtaagcaaaaccatcagcacagcagccatggtggtcatcatcatcatcatcatggaggtggatgttgttccggtgatgcagtagttgtggaaacagctcaagctgaa

SEQ ID NO: 1075 - DNA, 794 bp, Brassica napus
gcgagacaacagaagagaagagaagcagccatggtgtgcatcaggcgagcgacggttgacgatctgctggcgatgcaagcctgcaatctcatgtgtcttcccgagaactaccagatgaagtactacctctaccacatcctctcctggcctcagcttctctacgttgccgaggactacaacggccgcatcgtcggctatgtcctcgccaagatggacgaggagagtaacgagtgccacggccacatcacttccctcgctgttcttcgtactcatcggaagcttggtctcgccactaagctcatgaccgccgctcagtctgccatggaacaggtttatgaggcagagtatgtttcgctgcacgtgaggagaagtaaccgagcagcgtttcatctgtacacggagacgttaggctacaagattcacgatgtggaagcgaagtattacgcggatggagaggatgcctatgacatgcggaagtattttaagggtaagcaaaaccatcaacagagccacggtcatcatcatcatcatcatcatggaggtgggtgttgttccggtgatgcagtagaaataactcaagccgaagatgctatagcaacgacgtcgaagtgagactgagttgtattggtgtgtgtttgctggctagctagctctagtagtgctcactattttccattcatatgattttgagatttggtaaaccactcttgtgcttgagtgtttctccattggtcttctttttggttgtacttgatatttagccactttttttttctatgtatcaaatgtttctg

SEQ ID NO: 1076 - DNA, 1076 bp, Curcuma longa
gcacccgtctgcgttccccgcaactgttcagagacctaccgccgtgctcttccaccctttaccccttcctcttgtgatcttcgtatcgatctcgcagtcgcttagcctgcggtcggcggactctggttgccgcccgcccacccctcccaaaggccactccgcacccttctctagtgatctcgttcctcggatctcgcaggccagtctctccagccagccgccctccgtcggtagtcggtacagttgatcgagtgaaagcgaaggagaaggaaatggtttgcattcgacaggcgaccgtcgatgatctgctggcaatgcaggcatgcaacctgctatgcctgccagagaactaccagatgaagtactacctttaccacatcctttcctggccacagctcctctttgtcgcggaggactacgatggacgcatcgtcggctacgtgcttgccaagatggaggaggatgcctccgagccttgccacggccacatcacctccctcgccgtcctccgcacccatcgcaagctcggcctcgccaccaagctcatgactgccgcccagaatgctatggagtctgtttttggggctgagtatgtatctctccatgtccgccgcagcaaccgcgctgccttcaccctctacacctccagcctcagctatcgcatccacgacgtggaggccaagtactatgctgatggggaggatgcctatgacatgcgcaagcagctgaagggccgtccccatgcccatagccatagccatagccacggccatcatcaccaccaccatcatggaggctgctgctcaggggagtctaaggctgcatctcccgtcgacgttggtgcagcagctgatccaggcactggtgcatctgggtccaattcttcagctccagcttctgctgctggggcgtgatcagaaactcatctccaaggtgcacttagtactatgctcttgatgtctcgggctcagagttgccatatctctgaaaattgagtgtttaagataatatttttcatatttgtatggattcttttagttctaatagatatcgacgaacttcaacttctttgcttt

SEQ ID NO: 1077 - DNA, 1261 bp, Populus trichocarpa
aagtctctctcctcgtcactgaaacgagacctgcaggcaaaatcacacacaaaaaaaaaaccctaacctctgcatcaaaatctccaacatggtttgcgtaaggaaggcgacgatggacgacttgttggcgatgcaagcatgcaacttgctatgcttgcccgaaaactaccagatgaaatattacttctaccacatcctctcttggccgcatctcctttatgtcgccgaagattacaacggccgaattgttggctacgtgctggctaagatggaagaagaatctaccgaatgtcacggtcatatcacttctctagctgtcctccgtactcatcgtaagcttggcctcgctaccaagctcatgaaggccgcccaaaccgccatggaacaggtgtttggagcagagtatgtgtcgctgcatgtgaggaagagtaatcgggcagcattcaatctttatactgaaacattgggctataagattcatgatgtggaggctaagtattatgcagatggggaggatgcatatgatatgaggaagcagttcaaggtaaagcagagtcaccaccaccaccaccaccaccaccatggtggtgggtgttgttctgctgatgccaggcctgtggaagctcaaccagaatcaaaatcagaggcaaaagccagcaccaaggtggaataaaaaatgggttgatggtgaaaggtaactgactcactggagaagtgggcgttacacgcttttgttatgttaattggaatactgtttgtttgtcctgactaccgagtattgtagtttgttcatccttgttaacaatgcactggcagaccaggagttgcattgctatttctatttactgcttcctccatgcatattgggattagcattgctgtgtgtatttgcaccttcttcttgagagtgttttttttttctttttcttgcaattttgagaatctgctgccgctactatacagtatcgattttactactaccattaggatacagcatttgcaccacctatcccatgtgttttctttcacaaacgctgtgaactgattgataattttgtttctgtctatccccacgaatcatctcttccaagttactccagaagaaataagagttggagatttgtgatgatttttagattttgtcaagacctcgatgtccctctcactggtgttcttgtgcatgtgactataggatgataggaacccttgcttcatgtcattttgaaccatggtccttcaatatgctagttagttattatgt

SEQ ID NO: 1078 - DNA, 857 bp, Manihot esculenta
ggaaaagagcttgagaaaaccagtaatccaagcatggtgtgcataaggaaggcaacaatagatgatctgctggctatgcaagcctgtaatctgctatgtttaccggaaaactaccagatgaagtattatttctaccacatcctctcctggccgcagcttctctatgtcgccgaagactacaacggccgcatcgtcggctacgtcttagccaagatggaggaagaatctaacgagtgtcacggtcatatcacctctctcgccgtcctccgcacccatcggaagttgggcctcgccactaagcttatgagcgctgcccagaccgccatggaacaggtgtttggtgcagagtatgtttcactgcatgttaggaagagcaatcgggcagcattcaatctttacacagaaacattgggctataagattcatgatgtggaggcaaagtattatgcagatggagaggatgcttatgatatgcggaaacagcttaaggggaaacagattcatcatcacggacatcatcatcatcatcatggtggtgggtgttgtggaggtgacaccaagtctctggaagcaagaccagacccaaaatcagaggcaaaagctagtgcaaaatcagaatcaaaagcagggtgatgctgaaaaaacagtgtatgaagaacaagccaatgcccttttgttatgcgactcagattgtagccagtattgtggtttgtttatgctggtaatgcactgaaaaacctggatttgcatagctatttctgtcatctcttctccatatattgtgatgaacatcgttgtataatggttgttgcatcttcttcttagctagtacattttttgtgccaatattttctttg

SEQ ID NO: 1079 - DNA, 1043 bp, Musa acuminata
gtgaaaaagtggtgcatcaaacccgtcgtttccttcaaaccctatcgtctgaagcagagaaagaggggcggagggtatctcgatccttaggtcggccggctgatcgatcgattgatcggatcctcaatacaaagaagaagatggtgtgtatacggcaggcgacggtggaggatctgctagcgatgcaggcttgcaacctgctgtgcctgccggagaactaccagatgaagtactacctgtaccacatcctttcgtggccgcagctgctcttcgtggcggaggactacggcggccagatcgtcggatacgttctcgccaaaatggaggaggacacctccgagccctgccatggccacatcacctcccttgctgttctccgcacccaccgcaagctcggcctcgccaccaagctcatgaccgccgcccagaacgctatggagtccgtcttcggcgccgagtacgtctccctccacgtccgacgcagcaaccgcgccgcctttaccctctacacctccactctcggctaccgcatccacgacgtcgaggccaagtactacgccgacggagaggacgcctatgacatgcgcaagcagctcaagggccgtccccatggccacagccacggccacagccacggccacgggcaagctcatcaccaccaccaccatcatcatcatggaggcggctgttgctctggggaggtgaagcccccagccgctgcgggtgcatatgcttccgcatcttctgcttctgcttcagcatcggcttccgcttctggagagtgaaaagcttgtggccgaggtaatcttgaaagtttccttcatgctaaaggaaataattatgcttgttttttacttgaattataattttcggatgatgttagtgtttgaactctattatgtgtcagagtcttcagatgattatgtttgtgtggagtacttcaacttatctttggttgttggatatattcttgttttgctcctccttcctactgctattgatgattcttttaggattgtacaattctttctatcacagatatc

SEQ ID NO: 1080 - DNA, 1050 bp, Elaeis guineensis
ctctatcccagcccagaccgaatgaagattcttgacacatagccggttcaaaccgggtcgggttaactcgaaggtggtctcctcataccaagtgacgattcccaaatctaacccatcccctctcttattccggcggcggtgaaaccctaactcttgaactcgatccgtagagagaccctagccctggtggaatccggcgagcggacgccatggtgtgcatccgtcgagcgacgatcgaggaccttctggcgatgcaggcgtgcaacctgatgtgcctgcctgagaattaccagatgaagtactatctctaccacatcctctcgtggccgcagctcctcttcgtcgccgaggactatggcggtcgaatcgtcggatacgtcctcgccaagatggaggaggactcctccgagccctgccatggccatatcacctctctcgccgtcctccgctcccaccgcaagcttggcatcgccaccaagctcatgaccgccgcccagaacgctatggagtcggtcttcggtgctgagtacgtctccctccacgtacgccgcagcaaccgcgctgccttcaacctctacacctccaccttgggcttcaagatccacgacgtcgaggccaagtactacgccgacggcgaggacgcctacgacatgaggaagcaattcaagggtcgccaccaccaccaccatggcgacggatgttgctctggggactcaaaggcggccggttctggttcttcttcttcgtcgggtgagggaaaggtctaatcttgaggagatactggaaacaaatcaccaacttggcagggcagctgcgtttgggcaaagacggccaaggatggtgcttcattgagtgagagggagagagcactgtaccgaaaaagtgtgagggagagaatatcaaatgttgacttttgaggtgatctcatgaatattgctggaaaggaatcatccttattttttgttgctatcgctgttatgacttcttgtgatttgaagttgatgatttggtgcaaaatcaacaaatcattggattgcttttgcatattta

SEQ ID NO: 1081 - DNA, 539 bp, Euphorbia peplus
aaagcgactatagatgacctcttggcgatgcaagcttgcaacttgctatgcctccctgagaattaccagatgaagtattacttctatcacatcctctcctggccgcagctcctctatgtcgccgaggattacaacggccgtatcgtcggttatgtcttggctaagatggaggaagaatctaatgaatgccatggccacatcacctccctcgccgttctccgtactcaccgcaagttaggtctcgccaccaagctcatgagcgctgctcagaacgctatggaacaggtttttggagcagagtatgtgtcacttcatgtgaggaaaagtaacagggcagcattcaatttgtacacagaaactctaggttacaagattcatgatattgaggccaagtattatgcagatggagaggatgcttatgatatgcgcaagcaactaaaggtgaagcagatttctcatcatcatcatcaccatgccggtgggtgctgttcaagtgatgccaagtccgtggaaggaagaccggagtcaaaatcagatgc

SEQ ID NO: 1082 - DNA, 1058 bp, Abies balsamea
aacctagagcttcgaccctctaaaaaggaaaccagggagttatcgtgagaggaccggagggagcaagcctttaaagaataaaaaaccaggaataaacgaagtgcccaacagagaataagaaatcgggagggttcctgcatataaactctgttacacgatatatattctattgtttaagcaaaatatatgttatagggtttaaaaccaccgaggtttgcagccatggtttgcattcgccaagccacaatagacgacctgcttgcaatgcagacatgcaatctgatgtgtctgccggagaattaccagatgaagtattacttctaccacattctctcatggccgcagcttctctatgtggccgaggattacaataagaaaattgtgggttacgttctggcgaaaatggaagaggagtccacggaatgccatggccatataacctctctggccgtgttgcgcacacaccgcaaactgggccttgcaacgaagctcatgacggcagctcaaaaggcaatgcaggaggtttttggggcagagtatgtttctctccatgtgcgcaagagcaaccgggcggcgtttcacctgtatacccaaactctgggctataaaattcacgatattgaagctaagtactatgctgatggcgaggatgcctatgatatgcgcaaacagctgaaattgaagtctgatggtaagcatcaacatcatcatcatcatcattctgggtcgtgctgcggtggagacggtggtgatgggaaactgcattctgcagttgataaaaagagtaaggaatgaaactgtagtggaaaggaagctgttgaacttgaaatttgcggccttatccgcagcctttgttgtggttagcacattgaactctttcgccgtagatatttggcctggaaatgatgatatgaattcatattgttattacgctattttactttttattgtaagacaaagtctttcagttgtcctcaagaactgcgtatctctccttgttgttgctactggaattcgttgcttgccatgaaattgcgctgaacacctttcttgtagat

SEQ ID NO: 1083 - DNA, 1063 bp, Distylium racemosum
aaattccccgtcaaaggcaaaccttaatgtatactgcaacttggccaaaggaggtgcggaatatagcgagatatatggaagcaaggagcggaagaaacggatttgaaggtgcaaactccagaagatcgattacatcacggcaattttcttgtgtacttattggaatctggagcggctaaaatccgacagatagagagcttcttcgagggtttctgcgttaaaatccgttaaaaagcaggtttctttcacaaaaaccgtaatataacataaaacatttagggttttgaggagccttgatcggcagccatggtttgcattcgccaagccaccatggacgacctgctggcaatgcagtcgtgtaatctgatgtgcctgccggagaattaccagatgaagtactatttctaccacatcctttcatggccacagctcctctacgtggccgaggattataacaagaaaatcgtgggttacgtgctggcgaagatggaggaggagtccacggagtgccacggccacataacctctctggccgttgtgcgcacccaccgcaagttgggaatcgcaacaaagctgatgaatgcggcgcagagggccatgcatgaggtctttggggcggagtacgtttctctccatgtccggaagagcaacagggccgcctttcatctgtacacggagaccctgggctacaaaattcacgacgtggaggccaagtactacgccgatggcgaggatgcgtatgatatgcggaagcagctgaagcccaaggaagatcacagacatcatcattgcggcgggtgctgcggtgctgaagggaacgcggcagggggagatagaaagggcaaagaaggaggctagctttgcaaacaatgttgattaggtatataaggttttcggtgttttggactgctgaaatttgttattttgcttgcggacatgtggcctgcaattgcaaatagtgcggtttataactctgagattcgtagaaatttatctttgctattattacgaagtgttgtattcatttgaatttttagaaataatatagacaatgcctacaaat

SEQ ID NO: 1084 - DNA, 927 bp, Podocarpus macrophillus
ccaattccaagagtaacgctgtaggaaatcgaagtcaaagaacccaatagagcactaggggtaactttttgtttttgacaaaaatctgttaggtttctgccacaaaccctttagggttcattacaaaatctgctagggtttgaaatattagggtttaagggtttaccaataacagccatggtttgcattcgccaagccaccgtagacgatctgctttcaatgcagacatgtaatttgatgtgcctcccggagaattaccagatgaagtattacttttaccatatcctctcatggccgcagcttctgtatgtggccgaggattataacaagaagattgtgggctatgtgcttgccaaaatggaagaggagtccacggaatgccacgggcacattacttcgttggccgttctgcgcacacatagaaagttgggaatcgccacaaagctcatgactgctgcacaaaaggctatgcatgaagtgtttggggcagagtatgtttcgcttcatgtcaggaagagtaatagggcggcatttcatctgtatactgagactttggggtacaaaattcatgatgtggaggccaagtactatgctgatggtgaggatgcttatgacatgcgcaagcagttgaagaccaaggaagttagcaagcatcatcattgtggaggatgttgtggtggagaagctgaggcgaaaacacaggctactatagtttctgctggaggagagaagaagggcaaataaggaagccagtcatgcaatgatagttcctttttggttgttgttggtagtgttagatgtttggaattttgattttgcgcttgactgggctgcaaatgataatattgtggttgcaagttttgcattgactggcaacttgttcattgctttgacatttacatacttcatctttggggttgacaagtg

SEQ ID NO: 1085 - DNA, 1172 bp, Pseudotsuga menziesii
gatcaagagccctacaggttcggtctagaaaaggaaacccgatcttatagtgggagttcttgtgggccggtctttcagtggcagctatagtgcgaggacccgtgggtgcaagcccttaaagattaaaaaaccaggagattaagagaagcacccaacagagaacaatttatcgggaaggtttcggcacataacctctgttacacaataaatactatagggtttaagcacaatatatgttctagggtttaagcccactgtggtttgcagccatggtttgcattcgtcaagccacaatagacgacctgcttgcaatgcagacatgcaatctgatgtgtctgccggagaattaccagatgaagtattacttttatcacatcctctcatggccgcagcttctctatgtggccgaggattacaacaagaaaattgtgggttacgttctggcgaaaatggaagaggagtccacggaatgccatggccatataacctctcttgccgtgttgcgcacgcaccgcaaactgggccttgcaacacagctcatgaccgcggctcagaaggcaatgcaggaggtttttggggctgaatacgtctctctacatgtccgaaagagcaatcgggcggcgtttcacctgtatactcaaacactgggctataaaattcacgatattgaggccaagtactatgctgatggcgaggatgcgtatgatatgcgcaagcagcttaaaccaaagtctgatggtaagcatcagcaccatcatcatcatcatcatcatcattctggggcgtgctgtggcggagacggtggtgatgggaaattgcagtccacagctgataaaaagagcaaggaatgaatctgaattggaaaataagctgttgagatttgcggccttcacgacccgcatctgttgcggttagcatatttaactctgttgcggttagcatatttaactcatttgttgtagatatttggcatgcaaatattcttatttatgctattttgttttaactgtaagacaacaaagtctttcacttgtcttcaagagctgcctatctctttctgttgttgctactggaatcattccttgccatgaaaccacgttgaactattttcttgtagatacttgaactacaaatgatgatagtttattcatattgttatcatgctatttttc

SEQ ID NO: 1086 - DNA, 1080 bp, Sciadopitys verticillata
ttccaaagaaaggtagagggagcaaaagtttcgaagaataacacaagccctgaggctttctgtcacaaaaatctgagggtttctttcacaaaatcttttacaataacatcggttttaaaacccttttgatcagcagccatggtttgcattcgccaagccaccatagacgacctgcttgcaatgcagacatgtaatttgatgtgcctccccgagaattaccagatgaagtattacttttaccacatcctttcatggccccagcttctttatgtagcagaggattacaacaagaaaattgtaggttatgtgcttgcgaaaatggaagaggagtccacagaatgccacggccacataacttctctggccgttctgcgtactcaccgcaagctgggccttgccacaaagcttatgagtgcagcccagaaggctatgcaccaagtctttggggcagagtatgtttctcttcatgtccgcaagagcaacagggcagcatttcatctgtatacagagactttagggtacaagattcatgatgtcgaggctaagtactatgctgatggagaagatgcatatgatatgcgcaagcagttgaagccaaaggaagatagacatcaacattgtgggggttgctgtggcggcgaaggcgatgtgaaagctcacagtagcacatccacaggtggggataggaagggcaaagaagtgaattaggtctggaccgtatgctatttagccttgttagattcttatctgcttttggtgttgttagagtagtgaaccctttctttagcagatacttggactgtaaatggtcatagtaaattcatgttgttgtcatggagtttgcttatttcactgcaaggctcgataattttcatgcctttgagctgtacaggactcttttggtactggtaagtgccattctatgcttgcggaagttttcaattgtgtcaatgtcatatctaaaatattgttttttatatgaacttatgaagattgtttgttttgccaaaggaaaacattttgattattgtaccgtagaattgcaagagcgtgctgggtagttaaagatagcaattcaat

SEQ ID NO: 1087 - DNA, 785 bp, Euonymus alatus
gtagaagcttctctgcttcgatttcgaacccctaaccctaggaattcctgcactcgaggaaaatggtgtgcataaggaaagcgacgatggacgacctgctggcgatgcaggcctgcaacctgctttgcctgccggagaattaccagatgaagtactatctatatcacattctgtcatggccccatctcctctacgtcgccgaggactacaatggccgtatcgtcggatacgtcctcgccaagatggaagaggagtcgaacgagtgtcacggccatattacttctctcgccgtcctccgcacccatcgcaaacttggcctcgccaccaagctcatgagcgccgctcaagcagccatggaacaggtgtttggagcagagtatgtgtcacttcacgtgaggaagagtaatcgtgcagcgtttaatctgtatactggaacattgagttacaagattcatgatttggaggcaaagtattatgctgatggggaggatgcatacgatatgcggaaggagttgaaagggaagcagaatcatcatcatggacatcatcaccatcatcatcagcatggtggtggttgttgctcgggtgagccaaggagtgcagaaccaaggggggaggcaaaatcagactctaaagccagtacaaaatctgtcagttgatggtttgtagttttgttattgagttattgttggagttttctgtttgggtgatgcattgacattttgtttactgccgctctgactggcatggttatgtaatgttctctcatgctttcttatgaatgg

SEQ ID NO: 1088 - DNA, 1183 bp, Populus trichocarpa
cttcccttgcactagttttttttttcatttcctacagacaaggcaaaaacctaaaccctaacgacgtctgaatctcctccagcatggtgtgcataaggaaggcgaccatagacgacttgttggcgatgcaagcatgcaacttgctatgcttgcccgaaaattaccagatgaaatattacttttaccacatcctctcttggccgcatctcctctatgtcgctgaagattacaacggccgaattgtcggttacgttttggccaaaatggaagaagaatcgaacgagtgtcatggtcatatcacttctctcgctgtccttcgtactcaccgtaagcttggcctcgctaccaagctcatgaacgccgcccaaaccgccatggaacaggtatttggagcagagtatgtgtctctgcatgtgaggaagagtaatcgcgcagctttcaatctgtatacagaaacattaggctataagactcatgatgtggaagcaaagtattatgcagatggggaggatgcatatgatatgaggaagcagctgaagggaaagcagagtcatcatcatggtcaccaccaccaccaccatcaccatcaccatggtggtgggtgttgttcaggtggtgccaggcccatggaagctcgaccagaattgaaatcagaggcaaaagctggcaccaaggcagaattaaaaacgggttgacggtgaatggttgactagttggagaagtatcgtagatgccgattccgtagaggattgattgctgcagaaagcttgcatttggatatggcttctgttatttgaggagctgcaataaggtagctgtgctaggtggaagctccacctcaactcaaggccgccaaatgccagagaaaacaaagttaaatggtttttttcttttttctttttctaaggtaaatgaagttaaatgtcattgtgtagcaagaaatggattcaactaaagacaaaggctcctgtgactcgtgagggtatggatgctcttctagagtttgaaacgcgtctcaatgtggtagcgttgagtgatagggttgctgtgacactaaagtaatgtggttattagtagaagttaatgtgcagcttctgctgttcaaaggtggctactgtaccagtgtagttgagctaggttgaaacttgagattaaactccaaatacaagaacacgaagtgaaa

SEQ ID NO: 1089 - DNA, 733 bp, Tripterygium wilfordii
ggcgacgatggaggacctgctggcgatgcaggcctgcaacctgctatgtctgccggagaactaccagatgaagtattatctctaccacatactctcctggccccagctcctctacgtcgccgaggactacaatggccgtatcgtcggttacgtcctggccaagatggaggaggagtccaacgagtgtcacggccatattacctccctcgccgtcctccgcacacaccgcaaacttggcattgccaccaagctcatgaccgcgcccaagcagccatggagcaggtgtttggagtcagagtacgtgtcacttcatgtgaggaagagtaatcgtgcagcgtataatctgtacaatggaacattgggttataagattaatgatgtagaggcaaagtattatgccgatggagaggatgcatatgatatgaggaagcagttgaaagggaagcagaatcatcatcatggacatcattatcaccatcatcatcatcatcatcagcatggtggtggttgttgctcgggtgagccaaggagtgcagaaccgagaggggaggcaaaatcagactccaaagacatgacaaaatcagagtcaaaatctgccagttgatggtttgtagtttttgttaataatgtttgttggatttttttatggctacacttatcatagatatgttctacgactatgagtgcgcgataatgtacgtgaggattgggtgatacattgacatttatgttt

SEQ ID NO: 1090 - DNA, 1108 bp, Cannabis sativa
gcccaccatagagtctcgtctctatttcgtctcactcaattgctttcttcttcttcttctctacttccctagagaaccaaatcaatcaaattccctcaaaaccctaaaaaccagagaaaccctataatccccaatccaaaatccaaccatggtgtgcatacgcaaagccacaatagacgatcttctagctatgcaagcctgcaacttattctgccttccagagaattaccagatgaagtactacctctaccacatcctctcatggccgcaactcctctacgtagccgaagactacaatggaagaatcgttggatacgttctcgccaagatggaagaagagagcaacgagtgccacggccacataacctcgctcgccgtactccgaacccatcgcaaattagggcttgcaacaaagctcatgagtgcagctcaaaacgccatggaacaggtatttggagctgagtatgtttctcttcatgttaggaagagtaatagagctgcttttaatttgtatactgagactttagggtataagattcatgatattgaggctaagtattatgctgatggagaagatgcttatgatatgaggaaagaacttaaggggaagaaaacccatcaacatgttcatagtcatagccatggtcacggtcatggtcatcatcaccatggtcatggtggtgggtgttgttctggtggtgaacccaagagtgtggaggctaaaggtggtgccaaggctgagaaagctaagactgattccaaaactggctgagaattgagaaatgaaagtaaagatttgattttttttttttttttttttttggtttactcttttacatttatgttatcagattatgctggcttggtaatttgaataatgcatttttggatttggggaatctaattatatattatgtgtttcctaatgtagcattactatatctatataagctatctttagggtagatggaattagaagagctctttggtttaactgagtattatgttcttttttgggctgtatttgtttattataccattgagttgtttggttttctaaggttctttattggatagtttctggctaattatgtgtgccttgtgtctt

SEQ ID NO: 1091 - DNA, 992 bp, Phalaenopsis aphrodite
aaaaacctaaaccctagccatggtctgtatccgtcaagcgacgatggacgatctcctggcgatgcaggcctgcaatctgatgtgtcttcctgagaactatcagatgaagtactacttctaccacatcctttcgtggccgcagctcctcttcgtcgccgaggactatggcggaaagattgtcggctacgtcctcgccaagatggaggaggaatcttccgagccctgtcatggccacatcacttcactcgccgtcctccgcactcatcgcaaactcggcctcgctaccaagctcatgaacgccgcgcagaacgccatggagggcgtctttggtgctgagtacgtatcgctccacgtacgccgaagcaaccgcgccgcgttcaatctttacgcctccacccttggctacaagatccacgatttggaggccaaatactacgctgatggggaggatgcttatgatatgaggaagcagcttaagggaaggcagcagatgcaggctatcacgcgtggccatcaacatcatcaccatcacggtggagggtgctgctccggcgaggttaagcctgctgttgatggtcctggagtcgctacatcttcctcagaggggaaaggttcgtcattggagaacaaaggcgaataaataaataaagtaaagttttgcactaatattccctgtcaaatttgtgtgtttgttctgttaaggtcttttagtatggatagagtcatggatgaattatttccgtttttggaggttgaataatgttgattagggatgattactccaccctttcaacttgtttttagttgatattttttaaaataccaacttgatttctacaacctatgttccattgtcctatcccatagcgaagttattgtagatgctaatagaacgtaggttatgattataacactggcatcatagacctaattttgttgtatgccaaagaaagtttgatggtggaggcgattttgtgcaatgataattaata

SEQ ID NO: 1092 - DNA, 841 bp, Cleome spinosa
aatcgaaaccctaatcccaaacctcagcgaagaaggcggccggtgagaaatggtgtgcatacggcgagcgacggtggacgatctccttgcgatgcaggcgtgcaatctcatgtgtcttccggagaactaccagatgaagtattacctataccacatcctctcatggcctcagctcttgtacgtcgccgaggactacaatggccgtatcgtcggctatgtcttggcgaagatggaagaagagagcaacgagtgccatggccatatcacttccctcgccgtgcttcatacccataggaagctcggtctggccaccaagctcatgaccgccgctcaggccgccatggaacaggttcatgaagcagagtatgtctcactacatgtgaggaaaagtaacagagcagcgttcaatctgtacacggagacgttggggtacaagattcacgatatagaagcaaagtattacgcagacggggaggatgcctatgacatgcgtaaacagcttaaggggaagcaaaaccatcaacacgggcatcatcaccatcaccaccatggcggtggatgttgttcgaatgacgcaaaagttgcagaaactagtcaagcaaaaggagactcgaaagctgatgctaaagcaagttcaaagtcggaagccaaaacaggatgaccaaacaggtaatgcacattctgttagttgcctttggtttcatgatgctaatgcttgttgagaagcaattatttcgcttttcgatgatttccggtggcaataatacattctgtaatatcaggacaagcttatcctttttctttccatttgtactagatacctgatcatggtttatcctgt

SEQ ID NO: 1093 - DNA, 1149 bp, Chelidonium majus
ccctaattctgagaatcaaccatggtttgcatcagacaagctacaatcgatgacctactagcaatgcaagcctgcaatttactctgcctccctgagaattaccagatgaaatactatttctatcacatcctctcatggcctcaactcctttacgtcgctgaagactatggtggtcgtatcgtcggatacgtattggctaagatggatgaagaaagtacagattgccatggccatatcacatctctagctgttcttcgcactcatcggaaactagggcttgctacaaaactcatgactgctgctcaaaacgccatggaacaagtttttggtcagagtatgtttcacttcatgttcgtaggagtaataaagctgcttttcatttgtataatgagacattaggttataagattcatgatgttgaggctaagtattatgctgatggtgaagatgggtatgatatgaggaagcaactcaaaggaaaacaactacatcatcagaatcaacatgggcatagtcatggtcatgggcatcttcatcatcatcatggtggtgggtgttgttcgagtgaggccgccgcgaaaggggtagatgccaaggctctccctgctcagcatagtcatggtcataatcatagtcatgggcatgggcatgggcatgggaaccatcatcatcatcatggtggtggggggtgttgttcgagtgaggcggcgaaagggggagaggcgaaaccagctcctactgctgctgctgaatgagaattatgtttattgaggtaaaatttatttggatgaattagaaaggttagggtttttgtttggttattcatctctgagtggagtgtttctgtttccgtatttgtgtggtagtttatatatggatgaattatgcatcataagaatgtctttgttttcgggcgttgaattgccggggatgaacatgtttcttaaatttgtaacggcggctcctttttagaaatccttaattgggtggatcctttttggtacacagctttgttaagtttcttgctgtatggtattccggtacagcttcaccatgtttccattgcttgtcttttttaatctgaatacacatgccatgatagaggtctagatatggttgaatcttgaatgccaaaattatgataagacg

SEQ ID NO: 1094 - DNA, 693 bp, Brassica napus
ggcgagacaagagaagagaaacaagcagccatggtgtgcatcaggcgagcgacggttgacgatctgctggcgatgcaagcctgcaatctcatgtgtcttcccgagaactaccagatgaagtactacctctaccacatcctctcctggcctcagcttctctacgttgccgaggactacaacggccgcatcgtcggctatgtcctcgccaagatggacgaggagagtaacgagtgccacggccacatcacttcccccgctgttcttcgtactcatcggaagcttggtctcgccactaagctcacgaccgccgctcagtctgccatggaacaggtttatgaggcagagtatgtttcgctgcacgtgaggagaagtaaccgagcagcgtttcatctgtacacggagacgttaggctacaagattcacgatgtggaagcgaagtattacgctgatggagaggatgcctatgacatgcggaagtattttaagggtaagcaaaaccatcaacagagccacggtcatcatcatcatcatcatcatggaggtgggtgttgttccggtgatgcagtagatacaactccagccgaagatgctatagcaacgacgtcgaagtgagactgagttgtattggtgtgtgtttgctggctagctctagtagtgctgctcactattttccattcatatgattttgagtgt

SEQ ID NO: 1095 - DNA, 1004 bp, Prunus persica
ggaaaattagactttaagcccatgattgagcccaagcacacccaaccgaagccgatctcattaaaaattcagaaccctcaattcatttctttgacctcactctgattttcttcttccccaaaatcaaatcaaactaaaaaccctaaccctagaaacctagaccctccctcaaaaatggtgtgcatacgcaaggccaccatagacgacctcctggccatgcaagcctgcaacctcttctgcctcccagagaactaccagatgaaatactacctctaccacatcctctcatggcctcagctcctctacgtcgctgaagactacaacggtcgcatcgtcggctacgtcctagccaagatggaagaggagagcaacgagtgccatggccacatcacctctctcgccgtgctccgaacccaccgcaaactcggtctcgccactaagctcatgagcgcggcccagaacgccatggaacaggtgtttgcagctgagtacgtctcgcttcatgtgaggaagagcaatcgtgcggctttcaacttgtatacggagactttggggtataagattcatgatgttgaagctaagtactatgccgatggggaagatgcgtatgatatgaggaaggagctgaaggggaagaaggtacatggacatagtcatggacatggtcatgggcatgggcatgcgcaccatcatcaccatcatcaccatcatgaacatggtggtgggtgttgttcgggggaggcagtgaaaccggaaaagacagaggcgaaaaaggtggagagagggaatgcgaaggcggaggcaagagcgggatgagagtgagagaggtaaattgggaactgggtaaagtgtattttctgttgttttacttaatctatggttttgatgcttactgcaacttggaaaatgcatttgagagttcagaacttatatggtatttgtattaaggtgttgacgtttaaatacatactctgatttgagtggtttatgttgtcatattttgt

SEQ ID NO: 1096 - DNA, 839 bp, Euphorbia esula
caatcttcgaactccctcctcctccggccatggtttgcataaggaaggcgactatagatgacctcttggcgatgcaagcttgcaacttgctatgcctccctgagaattaccagatgaagtattacttctatcacatcctctcctggccgcagctcctctatgtcgccgaggattacaacggccgtatcgtcggttatgtcttggctaagatggaggaagaatctaatgaatgccatggccacatcacctccctcgccgttctccgtactcaccgcaagttaggtctcgccaccaagctcatgagcgctgctcagaacgctatggaacaggtttttggagcagagtatgtgtcacttcatgtgaggaaaagtaacagggcagcattcaatttgtacacagaaactctaggttacaagattcatgatattgaggccaagtattatgcagatggagaggatgcttatgatatgcgcaagcaactaaaggtgaagcagatttctcatcatcatcatcaccatgccggtgggtgctgttcaagtgatgccaagtccgtggaaggaagaccggagtcaaaatcagatgcaaaagctagcacaaaatcagggtgatcatggtgagatttacacctaatactttagaacttggcaatggtaatttttcaatgagtttgtgtactactgagcctttaggtagtgattatgcattgaaagactgaaaattgcatggctatttctgtcactgctttctcctcataatcatatattatactgagttgagcatttttatgtaatggttgctgcctcacactgtatgatacttttttatgctgaaagtttcta

SEQ ID NO: 1097 - DNA, 958 bp, Brassica rapa
tcatcaccagattaaaaatcccctaaaccattagttcgaaaccctaagccccctttgcgagacaacagaagagaagagaagcagccatggtgtgcatcaggcgagcgacggttgacgatctgctggcgatgcaagcctgcaatctcatgtgtcttcccgagaactaccagatgaagtactacctctaccacatcctctcctggcctcagcttctctacgttgccgaggactacaacggccgcatcgtcggctatgtcctcgccaagatggacgaggagagtaacgagtgccacggccacatcacttccctcgctgttcttcgtactcatcggaagcttggtctcgccactaagctcatgaccgctgctcaggctgccatggaacaggtttatgaggcagagtatgtttcgctgcacgtgaggagaagtaaccgagcagcgtttcatctgtacacggagacgttaggatacaagattcacgatgtggaagcgaagtattacgcggatggagaggatgcctatgacatgcggaagtattttaagggtaagcaaaaccatcaacagagccatggtcatcatcatcatcatcatcatcatcatcatggaggtgggtgttgttccggtgatgcagtagatacaactcaagccgaagatgctatagcaacgacgtcgaagtgagactgagttatattggtgtgtttgctctagtagtgatgctcactgttttccattcatatgattttgagtgtcaaaatacatttggtaaaccactcttgtgcttgagtgtttctccattggtcttctttttggttgtacttgatatttattagccagtcttttttttttctatgtatcaaatgtttctgaaatctttctgctcaagaagcctggaaggttcttatgtgctttatattgaagcactagtttgtgctgtgtcaaagctttcctgcaaccatctg

SEQ ID NO: 1098 - DNA, 703 bp, Brassica rapa
  misc_feature (18)..(18): n is a, c, g, or t
  misc_feature (655)..(655): n is a, c, g, or t
accctaagccccctttgngagacaacagaagagaagagaagcagccatggtgtgcatcaggcgagcgacggttgacgatctgctggcgatgcaagcctgcaatctcatgtgtcttcccgagaactaccagatgaagtactacctctaccacatcctctcctggcctcagcttctctacgttgccgaggactacaacggccgcatcgtcggctatgtcctcgccaagatggacgaggagagtaacgagtgccacggccacatcacttccctcgctgttcttcgtactcatcggaagcttggtctcgccactaagctcatgaccgctgctcaggctgccatggaacaggtttatgaggcagagtatgtttcgctgcacgtgaggagaagtaaccgagcagcgtttcatctgtacacggagacgttaggatacaagattcacgatgtggaagcgaagtattacgcggatggagaggatgcctatgacatgcggaagtattttaagggtaagcaaaaccatcaacagagccatggtcatcatcatcatcatcatcatcatcatcatggaggtgggtgttgttccggtgatgcagtagatacaactcaagccgaagatgctatagcaacgacgtcgaagtgagactgagttatattggtntgtttgctctagtagtgatgctcactgttttccattcatatgattttg

SEQ ID NO: 1099 - DNA, 1876 bp, Theobroma cacao
atgaaaatacgagaaaaccatttcctcgtgctaaaatacaaaaggatttgggccactcatctctctgtaatatcgggctacggcttgaaaaacaaagcccaagaccatgctgaagcacttaaccatcgaaacaagtctactcggttcatccgaccaaagtgatcaaaatcgctctcttctcaggatcgcacccgcaggagaaatctcaaaaaccctaatttcctgaattaggagaagagaatccagcagaagaaacgatggtgtgcatacgcaaggcaaccatagacgacctgctggctatgcaagcttgcaacctgctatgccttcccgagaattaccagatgaagtactatttgtaccatatcctctcttggcctcagttgctttacgtggcggaggactacaacggccgcatcgtcggctacgtccttgccaagatggaagaagaaagcaacgagtgccatggccatatcacctctctggccgtcctccgcacccaccgcaagcttggcctcgccactaagctcatgaacgccgcccaagccgccatggaacaggtgtttggagcagagtatgtctcgttgcatgtgaggaagagtaatagggcagcgtttaatctgtatactgagacattggggtataagattcatgatgtggaagccaagtattatgcagatggggaggatgcatatgacatgcggaagcagttgaaggggaagcagagtcatcatcacgggcatcatcaccaccaccaccaccatcatcatggtggtggatgttgtttgggtgaggctagaagcacagaagtgactcaaacaagaggggactcaaaatcagagtcaaaagctagcacaaaatctgattcaaaagcagcatgagtatgggaggtaaaccaagtattcggagaattacgtgtggcgttggcttatgttctttagattattattggtggcccatgatatttttagtttgtttatggaaagtaataatctgactaagtatttcaaaattatgttggcttccctacatattgtttagcatgctcctgctaatgtaacggtgtatgtactgtctgtgtcttttacaatgacctttttttaccaattttggtcaaatgttttcttttggtgtttcaactttgtgtttaaaacaatagaatggctctttatgtttcatttctgcatttatgttgctttgttggtatgtatatctctctctggcttgtttctgcttcctccactccctttgtaatcgatgttcggatcctttttctaccagattctctttaatgttatcccttacttgtgcaagatattaaatgtttctccatataagtgggtatcatcattccactctgtgatattagtactgtatgagggtgggcagttgttgtttgggggaatagtgatattaagtatttggcaatctgttaattctgttgatgttatggtatggctggttcttataccttcttgaatattgaaattagagtttctgttccgttggcctgttcttttgcttctttttagggaaaagaaggaagagggtaatggggatggagggtgggttcttacaaaatagaaccaaaaagagaaaagtggttacagtaagttgttgcacgacatagaaatggatataacaaaggctaaagttcaaattattggttcctaatttactctattagagaggaacatcgtagaagtagttattgtcatagatggaataatcgatacttaaaagtttgtgttatgccaaagttggtggctgtcgatcgaacattcttcagcctatggagaggagttcgaattatttgacaattgtaaactactctgtggcagtaaatagtgctttatgcttataaaaaagtgtggctttt

SEQ ID NO: 1100 - DNA, 876 bp, Linum usitatissimum
ggccaccgaggggaagcccgtgttccggagtccgaaaccctagttagcttgcggaaatccgatcatcctcgaacaccgggggcagcgatggtgtgcataaggaaagcgacgatggacgacctgctggcgatgcaggcttgcaacttgctatgcctgcctgagaactaccagatgaaatattacttctaccacatcctctcctggccgcagctcctctacgtcgccgaggactacaatggccggatcgtcgggtacgtgctggcgaagatggaagaggagtcgaacgagtgccacggtcacatcacttctctcgccgttctccgcactcatcgcaagttgggactcgccactaagctcatgaccgcagcccagagcgccatggaacaggtatttggggcagagtatgtgtctctgcacgtgaggaagagtaaccgggcggcatttcacctctacaccgagaccttgggatacagtattcaagatgtggaagcgaaatattacgccgatggagaggacgcatatgatatgaggaagcagctcaaggggaaacaaattcaccagcagcaccaccaccaccatcaccatcatcacggcggtggttgttgtgcgcctcagcccaaaccaattgaagcaaaacccgaaccgaaaactgagggaaaccccgttgcaaaagctgaagcaaaagcagcatgatgatgcccagatgtcaagttgctatgctcttcgtatcgcaattgaactacattagtatccgcttttgtaccgatctgtacgcacaagtaatgatatgcacttgcagtgttggaagattgattacttgttgtttcatgagttttacctagttttgtttacaattttaatataatctcattatcg

SEQ ID NO: 1101 - DNA, 833 bp, Linum usitatissimum
gcggaaatccgatcatcaatcgaacaccggcggcagcgatggtgtgcataaggaaagcgacgatggacgacctgctggcgatgcaggcttgcaacctgctatgcctgcctgagaactaccagatgaaatattacttctaccacatcctctcctggccgcagctcctttacgtcgccgaggactacaatggccggatcgtcggatacgtgctggcgaagatggaggaggagtcgaacgagtgccacggtcacatcacttctctcgccgttctccgcactcatcgcaagttgggactcgccactaagctcatgaccgccgcccagagcgccatggaacaggtatttggggcagagtatgtgtccctgcacgtgaggaagagtaaccgggcggcatttcacctctacaccgagaccttgggatacagtattcaagatgtggaagcgaagtattatgcagacggagaggatgcatatgacatgaggaagcagctcaaggggaaggagattcaccagcagcatcaccaccaccatcaccatcatcatggcggtggttgttgtgcgcctcagcccaaaccaattgaggcaaaacctgaaccgaaaactgagggaaaacccactgcaaaagctgaagtgaaagcaccatgatgatgcccataagccaagttgctatgctctttatatcgcaattgaactacattagtatccgcttttgtaccgatctgtaggcacatgtaatgatttgaacttgcagggttggaagattgattactagttgtttcatgagttttacctagttttgtttaaaatttaatatagtcattatcgttgttcttg

SEQ ID NO: 1102 - DNA, 911 bp, Papaver somniferum
aaaaccgaaaccctaagtttgggcatctaaaccagttcgattcaatcatggtttgcatccggcaagcaacgatcgatgatttactagcgatgcaagcttgtaacttgctttgtttaccagaaaattaccagatgaagtattatttttatcatatcctttcatggcctcaacttctctatgttgcagaagattacggtggtcgtatcgttggttatgtccttgctaagatggaagaagaaagtactgaatgtcatggtcatattacatcattagctgttcttcgtactcatcgcaaattagggcttgctacaaaactcatgactgctgctcaaaatgctatggaacaagtatttggttctgaatatgtttcacttcatgttcgtaggagtaatcgtgctgctttcaatctttatactgaaacattagggtatcagattcatgatattgaagctaagtattatgctgatggtgaagatgcttatgatatgaggaagcaacttaaaggaaagcaacttcatcaccgtggacatgggcatggacatggacatggtcaccatcaccatcatcatggaggtggatgttgctcgagtgaagcgaaacctgcaaaggggggagagactaaagcaattgctgctgctcctgctgagtgaaagttatactgaggtaaaaaaattgatgggagttaaagggttgtttgggtatgtttgtgactctgtatttctgtttctaaatgcgtgcggtagttttatggatgaattatgtgctagaagaatgtcttttatttatttacttgattatgaatgtatgaggataaacatgtttcggttttgacatgctcatttataaaccttgaattgtacctctcatcttagattcaatatatttttgaggttcaagtaaaaaaaaaaaaa

SEQ ID NO: 1103 - DNA, 915 bp, Papaver somniferum
taaaaatcaaaacccccaattcgacgctttcactctcgcataaaaccgaaaccctaagtttgggcatctaaaccagttcgattcaatcatggtttgcatccggcaagcaacgatcgatgatttactagcgatgcaagcttgtaacctgctttgtttaccagaaaattatcagatgaagtattatttttatcatatcctttcatggcctcaacttctctatgttgcagaagattacggtggtcgtatcgttggttatgtccttgctaagatggaagaagaaagtactgaatgtcatggtcatattacgtcattagctgttcttcgtactcatcgcaaattagggcttgctacaaaactcatgactgctgctcaaaatgctatggaacaagtatttggttctgaatatgtttcacttcatgttcgtaggagtaatcgtgctgctttcaatctttatactgaaacattagggtatcagattcatgatattgaagctaagtattatgctgatggtgaagatgcttatgatatgaggaagcaacttaaaggaaagcaacttcatcaccgtggacatgggcatggacatggacatggtcaccatcatcatcatcatggaggtggatgttgctcgagtgaagcgaaacctgcaaaggggggagagactaaagcaattgctgctgctcctgctgagtgaaagttatgctgaggtaatttttttgatgggagttaaggggttgttgggtatgtttgtgactctgtatttctgtttctaaatgtgtgcggtagttttatggatgaattatgtgctagaagaatgtcttttgtttatttacttgattatgaatgtatgaggataaacatgtttcgatattgacatgctcatttataaaccttgaattgtacctctcatcttatatt

SEQ ID NO: 1104 - DNA, 836 bp, Euonymus alatus
agaatcagtagaaagtttcacagatttgaatccctaaccccagaaatttctgtactcaaggagggatggtgtgcataaggaaggcgacgatggaggacctgctggcgatgcaggcctgcaacctgctttgtctgccggagaactaccagatgaagtactatctctaccacatactctcttggccccatctcctctacgtcgccgaggactacaatggccgtatcgtcggttacgtcctagccaagatggaggaggagtccaacgagtgtcacggccatatcacctccctcgcagtcctccgcacacaccgcaaacttggccttgctaccaagctcatgagcgccgcccaagccgccatggagcaggtgtttggagcagagtatgtgtcacttcatgtgaggaagagcaatcgtgcagcgtttaatctgtacactggaacattgggttataagattcatgatgtagaggcaaagtattatgctgatggagaggatgcatatgatatgaggaagcagttgaaagggaagcagaatcaccatcatggacatcaccatcatcaccatcaccatcatcagcatggtggtggttgttgctcgggtgagccaaggagtgcagaaccgagaggggaggcaaaatcagactccaaagtcatgacaaagtcagagtcgaaatctgccaattgatggtttgtagtttctgttattaatgttatgtttgttggatttttctatggctactcttattatagatatgtttatgagtgtgcgataatgtactcgaggattgtgtgatacattgacatttatctttactgttgctgcgactggcatgtttat

SEQ ID NO: 1105 - DNA, 678 bp, Silene vulgaris
tccaacaatggtgtgcataagaaaagcaacagcagacgatcttctccagatgcaagcatgcaatcttttatgtcttccagaaaactaccagatgaaatactacctctatcatgtcctctcatggccgcaattgctctacgttgcggaagattacaacggtaaaatagtcggttacgtgttagcgaagatggatgaagaaagctccgagtgccatggacatattacttctcttgctgttcttcgtactcataggaaattagggttagctactaagcttatgtccgctgctcaatctgctatggatcaggtgtatggagcggaatatgtgtcgcttcatgtgaggaagagtaatagagctgcattcaagctgtatactgaaactttgcattataagattcatgatattgaggctaagtactatgcggatggcgaagatgcttatgatatgaggaagacatttaagcctaaagctgtacaagggcatggacatggacacggacaccatcatcatcatggtggggggtgttgctcttcttctcatgcttctggtggtgcgtagggttgaggtcttagaggtaaaagtccagttcttgttaccgtatttcagagttgtcacgatgaatttatgataatattgccataatgtggaattctggatgcaagatggtgtttttcgtt

SEQ ID NO: 1106 - DNA, 924 bp, Silene vulgaris
cacactaacaatcaaatcatccttcaatctcctcaatcccacctccataaccccatccaaaaccctaattccatccttaaactccctcaactcagcctcattctcaaaaccctaaccctaacacacctcaaaatccaacaatggtgtgcataagaaaagcaacagcagacgatcttctccagatgcaagcatgcaatctactatgtcttccagaaaactaccagatgaaatattacctctaccatgtcctttcatggccgcaattgctctacgttgcggaagattacaacggtaaaattgtcggatacgtgttggcgaagatggatgaagaaagctctgagtgccatggacatattacttctcttgctgttcttcgtactcataggaaattagggttagctactaagcttatgtccgctgctcaatctgctatggatcaggtgtatggagcggaatatgtgtcgcttcatgtgaggaagagtaatagagctgcattcaagctatatactgaaactttgcattataagattcatgatattgaggctaagtactatgcggatggcgaagatgcttatgatatgaggaagacatttaagcctaaagctgtacaagggcacggacatggacacggacaccatcatcatcatggtggggggtgttgctcttcttctcatgcttctggtggtgcgtagggttgaggtcttagaggtaaaagatcagttcttgttactgtatttcggagttgttacgatgaatttaagataatatttgccataatgtggaattgtggatccaagatggtgtttttcgttgcaagtatttaaattttgtacgagtttgttttgtgttctccatatttataatggagagtctgaattcggaaaagtatctggtcattaccttggtgtattcatgaattatgaa

SEQ ID NO: 1107 - DNA, 626 bp, Aquilegia formosa
aaaatcgaaattgaaaaaccatggtttgcatacgccaagcaacaattgatgatcttctagcaatgcaagcatgtaatctactctgtttaccagaaaactatcaaatgaaatactacttctaccatatcttatcatggccacaacttctttatgttgctgaagattatggaggtaaaattgttggatatgttttagcaaaaatggaagaagaaagtacagagtgtcatggtcatataacttcacttgctgttgttcgaactcatcgaaaacttggtcttgctacaaaacttatgactgctgctcagaatgctatgggagaggtttttggtgctgagtatgtttctcttcatgttagaagaagtaatcgagctgcttttcatctttatactgaaacacttggatataagatttctgatattgaagctaagtattatgctgatggggaagatgcttatgatatgaggaaacaattgaagggaaggcaacatcagactcagcctcaacatcatcaccatcatcatcatcaccatggaggtgggtgttgttccagtggtgcaaagaccaccaccagcagcggaggaggaggaggagaggcgaaagcgtctacatctactagtgcggcgtga

SEQ ID NO: 1108 - DNA, 994 bp, Picea glauca
gaaggtgggtatggcagtctgattagggccgagggaaagaagcttcgaagtgaagaagtttgatgtgatttctgctattgacgattgattcgcagattcagaataaaaacgcaaggaaagtcgaagaagacctgcgaataaaaggcaagttaaagggagggttcaaggcgaatataataaaagctatctcttcatagggtttaagtaatccgttatattctagggtttaaacactctgtcatttgcagccatggtttgcattcgtcaagccactatggaagacctgctttccatgcagacatgtaatctgatgtgcctgccagagaattaccaaatgaagtattacttctaccatatcctctcatggccgcagcttctctatgtggccgaggattacaataagaagattgtgggttatgttctcgcgaaaatggatgaggagtccacagaatgccatggctatataacttctctggccgtgttgcgcacgcacaggaaactgggcctcgcaacgaagctcatgacggcagcgcagaaggctatgcatgaggtttttggggcggagtacgtttctctccatgtccgcaagagcaaccgagcagcattccatctgtatacccatacactgggctataaaatcaatgatatcgaggctaagtactatgctgatggcgaggatgcctatgatatgcgcaaacagctgaaagtgaagtctgatggtaagcaccatcatcatcaccatcatcatcagcattctgggggttgctgcagcggagacggtggtgatgggaaattacagtccgcagttgataaaaagagcaaggaatgaacctcaattggaagggaagctgttgagattgcggccttctcgaccgcttctgttgcggttagtcacatgacttctttgttgtagattgttgcctagcaatgctgatatgtaatcattatgttattatgcttattttgttacttttttaagtttagtttaaaggta

SEQ ID NO: 1109 - DNA, 2628 bp, Cephalotaxus harringtonia
attagggcaacgaaaaaccttacagcgtgacgctagggtttctgtaataaaaatctgttaaatttagggtttaaaagcgttttataaatccgcagccatggtttgcattcgccaagccaccatagacgacctgcttgcaatgcagacatgtaatctgatgtgtctccctgagaattaccagatgaagtattatttctaccacattctttcgtggccgcagcttctctatgtggccgaggattacaacaagaaaattgtgggctatgtgcttgcgaagatggaagaggagtcctctgaatgccacgggcatataacttctctggccgttcttcgcactcaccgaaagctgggacttgcgacaaagctcatgactgcggcccagagggctatgcacgaggtctttggggcagagtatgtttctcttcatgttcgcaagagcaaccgggccgcatttcatctgtatacggagactctgggatataaaattaatgatgtggaggctaagtactatgctgatggcgaggatgcgtatgatatgcgcaagcagttgaaactgaaggaggataagcatcagcattgtggggggtgttgtggtggtggcgaaggcgaggtgaaggctcagattggtatttctacgggtggggatagaaagggaaaagaaggaagctagttctgcagagatggttgttttgcctttttagctgaacaggtgcttttgttattgttagtttcttgaactttttcttttgcagacacctggtcactgcaaatgctattagtaagttcttattgttttagggtagttttcaaagtcttgttgtaatactttaaaattttcatgcgtttggaatgtaatggtggtggagaaaaaacttatgtacatcaatgaaattcagtgtaccgtcttggaggtgaaggttatagaaggattgggaactacgattgatgttatactgattaatggtgtgcttcatgaaggcgatcagattgtggtctgtggaatgcagggtcccattgttgcaagtatccgtgctttattgactccacatccaatgaaggagcttcgagtgaagggatcttaccaacatcacaaagagttgaaggcggcacagggaatcaagataactgcacaggggcttgagcatgctatagcaggaactcagttatatgttgttggacctgatgatgatttagatgatattaaggaagaagcaatgcaagatatgaataatgtaatgtctcggattgacaaaagcggggaaggagtttacgttcaggcttcaactcttggatcattggaggctttacttgagttcttgaagagcccagctgtgagcatcccagttagtgggattggtattgggcctgtgcacaaaaaagatgtcatgcgtgctagtgtaatgcttgagaaaaagaagaaagagtatgctgcaattttggcatttgacgtcaaaattactccagaagctcgagagcttgcagatgaacttggtgtcaagatatttatggcggacatcatttatcatctgtttgaccaattcaaagcatatatggacaatcttaaagaagaaaggaaaaaggattctgctgaggatgctgttttcccatgtgtactgggcattttgccaaattgtgtttttaataaaaaggatcctataattgttggtgtagatgttcttgaaggcattgcaagggttggcaccccattatgtgttcccacaaaagatttcatagatattggcaaaatagcctcaattgagataaaccataaagctgttgaaatggctaagaagggcgaaaaggtggccatgaagatcattgggagcaacgctgatgaagcacagaaaatgtttggtaggcattttgaaatggaggacgaatttgtgagccatctcactagaagatcaatagatatattgaaagaaaactatagggatgacctgtcaaatgatgattggaaacttgtggtgaaattgaagaagcttttaaaaattccgtaagctattgctaatgatgcatcgagagacggaccttcggattggagcaaaaccttctgatgaaaatggaaagatgcaccctgcaagattgcaagcatcacatacaggacaaaaaatgacgaactttgttgataccaggacaatagcctaccaaattctaagtttctatatgatttgctatgacctatatgctgcactgccggctacaataagacagtagtgaaatttcagatcatatatatgcagagggagtcttattcaaatgcctctgctgtttagctcgtattcttatgaaaatttagtagtttgaatgggtaagtgcgatattgccatgtggaaaatggagagtttgtgtagggatctgttttttgatttcttgaggcgatgaggaaaatatcatgaaaacattgttttaaataaattcatgttactactgcatttgtagggatctgaaaatatttccatgttgaggaagccatacgatgacagtctcagtattcactactgctatgctttggcctgtttcattttataggccaattttctaaagagaatgttggcccaattttatcaatcttataattggcaacagaaattaatggtttcccagatatattcatgtatctcctgc

SEQ ID NO: 1110 - DNA, 1126 bp, Distylium racemosum
gtttcagagcctcgtgagggtctctgtcggcaaaccctttagggttagggtgtcttcaacaaatactgtcagggttagggaaagcgttctgatcggcaaatatggtgtgcattcgccaagccaccctagacgaccttctggcaatgcagtcgtgcaatctgatgtgcctgccggaaaattaccagatgaagtactatttctaccacatcctttcatggccgcagctgctctatgtggcagaggattacaacaagaaaatcgttgggtacgtcctggcgaaaatggaggaggaggccacggagtgccacggccacataacttccctagccgttctgcgcactcaccgaaagctagggctcgcgacgaagctgatgagtgcggcgcagagggctatgcacgaagtcttcggggcggagtacgtctctctccatgtccgcaagagcaataaggccgcctttcatctctacacggagaccctgggctacaaaattcacgatgtggaggccaagtactatgccgatggcgaggatgcgtatgatatgcgcaagcagctgaagccgaaagaagatcacagccatcaccattgtggcgggtgctgcggtgccgaattggatgctaaagctactgcaggaggagacaggaagggcaaagaagggagctagctaggagaagaatggcgttgattaggtttctgagggtttcagctgctctcatggtgttgttgggcgactgaagctttttgtttgcgctgcaattgcaactgttgcagtttgcggaatttgactgtaagactctgccttttgtagaacttatctttggcattggaaagtgttgtatgggtttcgagatcattgctggctttaaattgtgttgaactttgatgaggaactatcggtttcctagtaaaatgaaaatgtattagggttttgttttagtagtggttgctttttctttagtaaagtcgtttttacttaatgccatgcacttcaggggcagtggaaacagagaaactcattattttggaatgaaaagtttataataatattcgagatagttatgcttatatatcagcagtgaattttatggctgatttatttaaagaagccagagtagagaagctagagaa

SEQ ID NO: 1111 - DNA, 1298 bp, Pinus pinaster
acaaggagaatgatgcatcaaacacgacactccaaccaggcgatgctaatatcaagcaaagcaaatattaattaaacattatgtataaatttcatttagaaaatgatccattccttttggttaagcaggttcgtcttcgtgaaaccctatcctgcaaagcggaagtctgatccctcagtggcagtttcagtggcagttatcctgggagaaccagagggagcaagcaaaaataaagaataaaaaaaccaggagaagtatctaacagagaacactaagtcgggaggatttctgcacataaactctgatacacaatatatattccagagtttaagcacaatatatgttctaggtttatacccaccgtggtttgcagccatggtttgcattcgtcaagccactatagatgacctgctggcaatgcagacatgcaatctgatgtgtctgccggagaattaccagatgaagtattacttctaccacatcctctcatggccgcagcttctgtacgtggccgaggattacaacaagaaaattgtgggttatgttctggcgaaaatggaagaggagtccacggaatgccacggccacataacctctctggctgtgttgcgtacgcaccgcaaactgggccttgcaacgaagctcatgaccgcagcccagaaggcaatgcaggaggtttttggggcagagtatgtttctctccatgtccgcaagagcaaccgggcggcgtttcacctgtatacccaaacactgggctacaaaattcacgatattgaggctaagtactatgctgatggcgaggatgcctatgatatgcgcaaacagctgagagtgaagtctgatggtaagcatcatcatcatcatcattctggagtgtgctgtggcggagacggtggcgatgggaaattgcagtctgcagctgataaaaagagcaaggaatgaacctgaattggaagtgaagctgttgagatttgcggccttagcgaccgcttttgttatggttagcacattgaactcttttgcagtagatgtttggcctgcaaatgatgatatggattcatatcgttattatgctattttgcccttttaatttaccagtccttaagttgtctccaagagctacgtatttcttcctgttgttgctactggaattcattgcctactgtgagatcgtgttgaactcttttcttatagatacttgacttacaaatgctgataatttactcatgttgtgctatttatcatttattgtatgacagccattcagttgtcttaaaaaattatctcttgttgttttt

SEQ ID NO: 1112 - DNA, 508 bp, Rosa hybrid cultivar
aaccctaaccctaactcaagaaagctagctttgcagaaatggtgtgcatacgcaaggccacaatggacgacctgctggccatgcaagcctgcaacctcttctgcctcccggaaaactaccagatgaagtactacctctaccacatcctctcctggccgcagttgctctacgtcgccgaagactacaacggccgcatcgtcggctacgtcttggccaagatggaggaggagagcaacgagtgccacggccacatcacctccctcgccgtcctccgcacccaccgcaaactcggcctcgccaccaagctcatgagcgccgcccaaaacgccatggagcaggtcttcgccgccgagtacgtctcgcttcacgtcaggaagagcaaccgcgcggcgttcaacttgtacacggagactctgggctataagattcatgatgtggaggctaagtactatgctgatggtgaagatgcttatgatatgaggaaggagctgaaggggaagaaggcgca

SEQ ID NO: 1113 - DNA, 753 bp, Brassica napus
atcaggcgagcgacggttgacgatctgctggcgatgcaagcctgcaatctcatgtgtcttcccgagaactaccagatgaagtactacctctaccacatcctctcctggcctcagcttctctacgttgccgaggactacaacggccgcatcgtcggctatgtcctcgccaagatggacgaggagagtaacgagtgccacggccacatcacttccctcgctgttcttcgtactcatcggaagcttggtctcgccactaagctcatgaccgctgctcaggctgccatggaacaggtttatgaggcagagtatgtttcgctgcacgtgaggagaagtaaccgagcagcgtttcatctgtacacggagacgttaggatacaagattcacgatgtggaagcgaagtattacgcggatggagaggatgcctatgacatgcggaagtattttaagggtaagcaaaaccatcaacagagccatggtcatcatcatcatcatcatggaggtgggtgttgttccggtgatgcagtagatacaactcaagccgaagatgctatagcaacgacgtcgaagtgagactgagttatattggtctgtttgctctagtagtgatgctcactgttttccattcatatgattttgagtgtcaaaatacatttggtaaaccactcttgtgcttgagtgtttctccattggtcttctttttggttgtacttgatatttattagccagtcttttttttctatgtatcaaatgttt

SEQ ID NO: 1114 - DNA, 649 bp, Papaver somniferum
gggcatctaaaccagttcgattcaatcatggtttgcatccggcaagcaacgatcgatgatttactagcgatgcaagcttgtaacttgctttgtttaccagaaaattaccagatgaagtattatttttatcatatcctttcatggcctcaacttctctatgttgcagaagattacggtggtcgtattgttggatatgttcttgctaagatggaagaagaaagtactgaatgtcatggtcatattacatcattagctgttcttcgtactcatcgcaaattagggcttgctacgaaactcatgactgctgctcaaaatgctatggaacaggtgtttggttctgaatatgtttcacttcatgttcgtaggagtaatcgtgcggcttttaatctttatactgaaacattagggtatcagattcatgatattgaagctaagtattacgctgatggtgaagatgcttatgatatgaggaagcaacttaaaggaaagcaacttcatcaccgtggacatggtcatggtcatggacatggtcaccatcatcatcatcatggaggtggatgttgctcgagtgaagtgaaacctgcaaaggctggagagactaaagcaattgctgctgctcctgctgagtgaaagttatgctgaggtaaat

SEQ ID NO: 1115 - DNA, 627 bp, Beta vulgaris
  misc_feature (45)..(45): n is a, c, g, or t
aaaatcttccccaattttacaaaccctaaccctagaatctccgantccagaatccaaacatggtgtgcataagaaaagcaacggtcgacgatcttctccagatgcaggctgcaaatcttctctgtttaccagaaaactaccagatgaaatactacctctaccacattctttcatggccgcaacttctctacgtcgccgaagattacaacggtaaaatcgtgggctatgtattagcaaaaatggaggaagaaagtactgaatgtcatggccatatcacttctctcgctgttcttcgcactcatcgtaaactagggttagcaacgaagcttatgtcggcggctcaagctgctatggaacatgtttacagtgctgaatatgtgtctcttcatgttaggaagagcaatcgtgcggcttttagattgtatactgaaactttgggttataagattcatgatattgaagctaagtattatgctgatggggaggatgcttatgatatgaggaagcaattgaaggcgaaatcgggacacggacacggacacgggcatgggcatggtcatggtcatggacatcatcatcatggtggggaatgctgctctcatgggcatggtagtgtggagacagaga

SEQ ID NO: 1116 - DNA, 787 bp, Cynodon dactylon
gccggggaagcatcaacctcttctcgccgtagaaccaccaaatccaccgcatcggagaattccaagatggtgtgcatccggcaggcgaccatcgacgacctgctggcgatgcaggcgtgcaacctgatgtgcctgccggagaactaccagatgaagtactacctctaccacatgctctcgtggccgcagctgctcttcgtcgccgaggactacggcggccgcatcgtcggctacgtcctcgccaagatggaggaggatccatctgagccctgccacggccacatcacctccctcgccgtcctccgctcccaccgcaagctggggctcgccaccaagctcatgtccgcggcgcaggcagccatggaccaggtcttcggcgccgagtacgtctccctccacgtccggcgctccaaccgcgccgccttcaacctctacacctccaccctcggctaccagatccacgacatcgaggccaagtactacgccgatggagaggacgcgtacgacatgcgcaagccgctgcggcagccgcagcctaagaagcaccaccaccaccatcaccatcacggccccggcggctgctgctcgcacgacgcgccccccgccgcggctgctggttcttctccatcttctggttcgtctgataagaaggctaactcttgacgcgggagtgaatctatcaagggagctgctgcgcccactgcacttacacatcttgtgctcccctcagatttttctttttgctagatttcttgtccagagagaatggagaagctctgtactgtga

SEQ ID NO: 1117 - DNA, 2356 bp, Cicer arietinum
gtagaaaccctaacctaataataatttcaggatcaattcaaatccgttactgcattctactaccattttcggagttatctctttgagttgtgaaagttgaagcgaatgccaaatttttgtgcggaaaaataaatgatttggatttgttaagtctgttataatgggtaggcgtcatggatgggaacttccttttcacacttttcaggttgtggctataacagtttatttcttgttatgcattgcttattacgccttctttgctccttttcttggaaaggaaatctatgaatatgtggcttttggtgtttactctgtactggcactctctgtattcgtcctctatgttcgctgcactgccattgaccctgctgatctgggagtgaggcttgactgtgaccaaacatccaataatagatcaaaacacgatgaagagttgacagaacccaacaagatagggctcaaggatgaaagaatgtctgatcggcatgattcaaatgtttgctccaaacttggatgttgcttgtgtagttccttgcaatggaagattgccgcagcgatgaagattctattctgcaacaagaatccggagaggaggaggctttgttctgtactttatgcaaagctgaggttcggaagttcagtaagcattgtagaagttgtgacaaatgtgttgatggattcgatcaccattgccggtggttgaacaattgtgttggaaggaagaattacatcacatttgtgtgcctaatggcagtgagcctggtttggcttttagtcgaatgcggagttgggattactgtgcttgtcagatgctttgctgataagaagcatacagagaatctgatagaagaaaagcttggagctggattttctcgagtcccatttgctacaatagtggccatatgcacagcagtttctttccttgcgactatacctctgggagaattgttctttttcatatgattctgattagaaagggaattactacgtatgaatatgtcgttgccatgagaactctgagtgaaccacctggtccttcagttgatgcgggtgatcagcagagtcttcctccgtctcctactagttcagctgtcactgcaattagcggaagaagctctgtgggaatgagtttgcaatacaaaggtgcctggtgtacacctccaagaatctttatggatcaccaggatgaaattataccacatttggagccaggtcgcctaccatctactgtagatccagatgcaatacaacaacccgacaaaggaaaaaatttgaatcaccgccctgtgcgaataagcgcatggaaacttgcaaaactagattccaatgaggcagctaaggcattagctaaagctagagcatcatcatctgtgcttcgtccaattagttctcggtctcatgcatacgatgttgatcatttatccagtagcaatgtgagtggaagaagcagtccaattagcaaccaaggatttcataacaaatacgatccatcagggacatcaaagttatctccttccaagagctcataccctcccagtcaagcaagcaaggaagatatagatgcatgtcaccacagtatgagtaacttcagcagtccacaagtccccaacttaactccttcgccaatgcagcggccaggtttgaacagagaccatttcaaccctatgtttcagcaaccatctgcaaatcagtctccttcatcagctaaaggaagcgaagggaatttaaacccagttcatgaaattggtgcacgtgtgccaatgagaagtaacaacttagctgtttcagaggataaaaatcatcagtgttttgggatccagcagctgggcgctttgtccctttctcgtctagtggtcaaggcagttatcagattcctagaacagagttatcgtatactgggcgttctatattttttggcagtcccgctgtgaacgaacagtcaaatgcagcaggaacaagaaatagcagctcggtagctggtgtttcggacagagattatccaataagggattttcagcgaggtagatcacatagaggtggccaacttcctgtgtttgttcctagttattcccagcaaaactaattttcttagagtacctttgaattggtggtataggataagaatggaatggaatatgataacatctaaaatttaaaatctaaatagtgaaatgttagcgcattccattccactccaatttaccattaattgcaattttttcttctcttccttttctagttgaaaaaaaagtcctaaaacatcttatcctgcattttttaatgtatgtcttctttcttgtttccaccttgttgtttagtacattcaccattccatctgtacaggctaatggatcac

SEQ ID NO: 1118 - DNA, 3930 bp, Cajanus cajan
tacatatggctgttgcagcttctggagaaagaagcttgcaggcaacacccacatgggcagtagctgttgtttgttcagtttttgtcattatctctgtcataattgaacatggaatccattcacttggaaagtggtttcaaaaacgacataagaaggccatgaatgaagcgttggagaaaatcaaagcggaattaatgttgctaggattcatatccctattacttacgtttggtacaaagtatgttgcaaagatatgcattcctgaatcatttggtgacaccatgctgccatgcaagaaggtgaaaccagatgatgactcaaatggcagaaggagactactttctttggacgagagcgtggaatggcgtcgagttttagaagctgcgtctggtggtggtgactcttgctcacaacagggtaaagtgcctttgatatctcagtcaggggtgcatcagttacatatatttatattcgtgctggctgtttttcacattttttacagcgtcatgactatggtgctagcccgagcaaaaatgaagaaatggaaggcttgggaagcggaaacaacctccctggagtatcaatttacaaatgatcctgcaaggttcaggtttgcgcatcaaacatcattcgttaggcgtcactctggttggtctaggatgccaggaattcgatggatagtggcattctttaggcaattctttgcgtctgtgactaaagtggattacatgactatgcggcacggatttattaacgcacattttgctcccaataccaaatttgacttccaaaaatacattaaaagatccatggaagacgacttcaaagtggttgtaggcataagtattccgctatgggcttttgcaatcatctttctgcttgtcaacgtttacaaatggtacacgctcacttggctatcattagcgccgctagtgatacttttattggtgggcatgaagctggaacttataatcatggaaatggcccaagaaatccaagatcgaaccacaattgttagaggagtacctgttgtagagccaaacaataagtacttttggtttaacaagcctcagtggattatcttcttaatccattttaccttattcgagaacgccttccaaatagcctttttcttgtggacatggtatgagtttaagatcacatcttgcttccatgaaaacttgccattaatactaacaagggttgtccttgggatagccttgcaaattgtatgcagttacataacatttcctctctattccctagtaacacagatggggtctcacatgaagaaagcaatatttgaggagcaaacagcaaaggcacttaagaaatggcaaaagacagcaaaggataagaggaagttaaggaaagcagggatagaaatagcttcaggagaaacaacaccaagccacgggacatcaccactgcatttgcttcacaagtcaaagccaagccacagccacatagaaatggacagtgttctctattctccacgatcgtaccaatctgatactgacttgtctgagacagagggatcctcacaccaacaaaatgaaataacacaaacacatcaacctccaaggaataatggactaactcatgatatcgatttttcatttgagaatcccttagagaggttttcattccgtcatggctaggcgtcatggatgggaactcccctttcacacttttcaggtcgtggctataacagtgtttttcttgctatctattgcatattatgccttctttgcccctttccttggaaaggatatctatgaatatgtggctcttggtgtttactctctactggctctctctgtattctttctatatgttcgatgcactgccattgatcctgctgaccagggagtaatgcttgattgtgacaagacatccaagaacagatcaaaacttgatgaagaattggcagaacccagcaagataggactaaaggatgaagagatgtctgataggcacaattcaaattggtgctccaaagttggatgtttcttctgtagtttccttgttagagaagattgccgcagtaatgaagatattattctacagcaacaatctggagaagaggatgctttattctgcactttgtgcaatgctgaggtgcggaagtttagtaagcattgtcgaagttgtgacaaatgtgttgatggatttgatcaccattgtcggtggttgaacaattgtgttggaaagaagaattacatcacgtttgtgtgtcttatggcagtgagcctagtttggcttatagttgaatgtggagttgggattgcagtgcttgtcagatgcttcgttgataagaaaggtacagataatcagatagctgaaaaacttggagctggattctctcgggtcccatttgctactatagtggccatatgcacggcagtttcattccttgcaactgtacctttgggagaattattctttttccatatgatcctgatacgaaagggtatcacaacttatgagtatgttgttgccatgagaactctaagtgaaccacctgggccttcagttgatgcgggtgaacagcagagtctaccatcatctcctacgagttcagctgtcactgcaataagcggaagaagctctgttggaatgagtttgcagtacaaaggtgcctggtgtacacccccaaggatctttatggatcacccggatgaaattataccacatttggagccaggacgcctaccctcaactgttgatccagatgcagtacagccacctgacaaaggcaaaaggttgaaccagcgccctgtacgaataagtgcatggaaacttgcaaagttggattctaatgaggcaactaaggcagctgctaaagctagagcatcatcatctgtgcttcgtccaattagttctcgacctcaggcgtatgatgtcgatcacttatccagtagcaatgtgagtggaagaagcagcccaattagcaatcgaggatttcataacaaatatgatactgcagggacatcaaggttatctccttccaagagctcatacgctcatagtcaagcaagcaaggaagatatagatgcatcatgtcaacacagtatgagtaactttagcagtccgcaagtctccaacttaactccttcaccaatgcagcaaccaaatttaaacagagaccatttcaaccccatgtatcaacaaccctcacgaaatcagtctccttcatcagctaaagaaagcgaagggaatatgaatacagttcacgataatgtgccacgagtaccaatgagaagtaacaccttagctgtttcagataatagaaggtcgtcagtgttttgggatcaagcagctgggcgctttgtatcatcctcatctagaggtcctggcagttcccagatttctggaacagagttgttgtacactggtcgttctatattttttggcagtcccgttgtgaatgaacaaccaactacaggaacaagaattagcagttcagtacctggtgtaccggatagagattctacattaagggattttcagctaggtagatcacataggggtggccagcttcccgtgtttgttccgggttattctcagcaaagcaagttcccttagattgcctccgatccttgaccattaatttgttacggaaactatttattgtccttttttgattttttcgaaaaatccctaaacaagttatcatgtacttttattgtccgtcttatcacttgtttccactgtatgagtgcattcgccttccatctgtacaggtacaggctaatggatcacaacccttttctgtacagcggctaatggatcacaacccctttctgtacaaatatgttgaccactatcattgcatttcaagtttgaatttgaacgtggacgtttagcttatttgactgcataatcaaaatcaagtgtgtagcacacaagtttattccatttctgcaa

SEQ ID NO: 1119 - DNA, 2327 bp, Cajanus cajan
ggggatgcttccgatttggtagtcccttagagaggttttcattccgtcatggctaggcgtcatggatgggaactcccctttcacacttttcaggtcgtggctataacagtgtttttcttgctatctattgcatattatgccttctttgcccctttccttggaaaggatatctatgaatatgtggctcttggtgtttactctctactggctctctctgtattctttctatatgttcgatgcactgccattgatcctgctgaccagggagtaatgcttgattgtgacaagacatccaagaacagatcaaaacttgatgaagaattggcagaacccagcaagataggactaaaggatgaagagatgtctgataggcacaattcaaattggtgctccaaagttggatgtttcttctgtagtttccttgttagagaagattgccgcagtaatgaagatattattctacagcaacaatctggagaagaggatgctttattctgcactttgtgcaatgctgaggtgcggaagtttagtaagcattgtcgaagttgtgacaaatgtgttgatggatttgatcaccattgtcggtggttgaacaattgtgttggaaagaagaattacatcacgtttgtgtgtcttatggcagtgagcctagtttggcttatagttgaatgtggagttgggattgcagtgcttgtcagatgcttcgttgataagaaaggtacagataatcagatagctgaaaaacttggagctggattctctcgggtcccatttgctactatagtggccatatgcacggcagtttcattccttgcaactgtacctttgggagaattattctttttccatatgatcctgatacgaaagggtatcacaacttatgagtatgttgttgccatgagaactctaagtgaaccacctgggccttcagttgatgcgggtgaacagcagagtctaccatcatctcctacgagttcagctgtcactgcaataagcggaagaagctctgttggaatgagtttgcagtacaaaggtgcctggtgtacacccccaaggatctttatggatcacccggatgaaattataccacatttggagccaggacgcctaccctcaactgttgatccagatgcagtacagccacctgacaaaggcaaaaggttgaaccagcgccctgtacgaataagtgcatggaaacttgcaaagttggattctaatgaggcaactaaggcagctgctaaagctagagcatcatcatctgtgcttcgtccaattagttctcgacctcaggcgtatgatgtcgatcacttatccagtagcaatgtgagtggaagaagcagcccaattagcaatcgaggatttcataacaaatatgatactgcagggacatcaaggttatctccttccaagagctcatacgctcatagtcaagcaagcaaggaagatatagatgcatcatgtcaacacagtatgagtaactttagcagtccgcaagtctccaacttaactccttcaccaatgcagcaaccaaatttaaacagagaccatttcaaccccatgtatcaacaaccctcacgaaatcagtctccttcatcagctaaagaaagcgaagggaatatgaatacagttcacgataatgtgccacgagtaccaatgagaagtaacaccttagctgtttcagataatagaaggtcgtcagtgttttgggatcaagcagctgggcgctttgtatcatcctcatctagaggtcctggcagttcccagatttctggaacagagttgttgtacactggtcgttctatattttttggcagtcccgttgtgaatgaacaaccaactacaggaacaagaattagcagttcagtacctggtgtaccggatagagattctacattaagggattttcagctaggtagatcacataggggtggccagcttcccgtgtttgttccgggttattctcagcaaagcaagttcccttagattgcctccgatccttgaccattaatttgttacggaaactatttattgtccttttttgattttttcgaaaaatccctaaacaagttatcatgtacttttattgtccgtcttatcacttgtttccactgtatgagtgcattcgccttccatctgtacaggtacaggctaatggatcacaacccttttctgtacagcggctaatggatcacaacccctttctgtacaaatatgttgaccactatcattgcatttcaagtttgaatttgaacgtggacgtttagcttatttgactgcataatcaaaatcaagtgtgtagcacacaagtttattccatttctagaacg

SEQ ID NO: 1120 - DNA, 3832 bp, Phaseolus coccineus
atggctggtggagcatccggtggagaaagaacgttgcaggaaacacccacgtgggcagtggcttctgtttgcgcagtcttcgtcgttctctctgtgttaattgaacatggaatccatttacttgaaaagtggtttcaaaaacgaaataagaaagccatgagagaagccttggagaaaatcaaagcagaattaatgctattaggatttatatccctgttaattacttttggtacaaaatacattgcaaagatatgcatccctacatcagctggtgatatcatgctcccatgcaagaaggtggaagagtcaaagaactccgatgattccaatggcaggaagttactttactttgaggacaatatggaatggcgtcgagttttagcaactgcgtcttctggtggtgacttttgctcacagaaaggtaaagtgtcattgatttctcagtcaggggtgcaccaattgcatatatttattttcgtgcttgctgtttttcacatactgtacagcgtaatgaccatggtactagcccgagcaaaaatgaagaaatggaaagcctgggaagctgaaacatcatctttggagtatcaatttacaaatgatccttcaaggttcaggtttgcgcatcaaacatcatttgttaggcgtcactctggtttgtctaggatgccaggaattcgatggattgtagctttcttcaggcaattctttgcgtctgtcacgaaggtggattacatgaccatgcggcatggattcattaacgcacattttgctcccaatagcaaatttgacttccaaaaatacattaaaagatccatggaggacgactttaaagtggtcgtgggtataagtattccgttatgggtttttgctatcgtctttatgcttgtgaacgtttacaaatggtacactctcacctggctatcattagcgccgctagtgatacttctattagtaggcaccaaacttgaacttataatcatggaaatggcccaggaaatccaagatcgaaccactgttgtcagaggagtccctattgtagagcccaacaacaagtatttttggtttaatcggcctcagtggattatcttcttaatccactttaccttgtttgagaatgcattccaaatagcctttttcttgtggacatggcattgcaagtggtgtgcagttacataacatttcctctctactcccttgtaacacagatgggatctcacatgaagcaagcaatttttgaagagcaaactgctaaagcactaaagaaatggcaaaaggttgcaaaagacaagagaaagttgagaaaagcaggggtagatgttccttcaggaacaatgagtggggaagcaacaccaagccaaggcacatcacccatacatttacttcacaagtacaagcctagccaaacagacacagatgttgttctctattctccacgatcataccaatctgatactgacttctctgacacagaggggtcatcacaccaactcaatcaaataacacaaactcatcaagctccaagaaatggagaggctcacagtatcgaattttcctttgcttttcactcggtcatggctcggcgtcatggatgggagcttccttttcacacttttcaggtcgtggctataacagtatttttcttactatctattgcatattatgccttctttgccccttttcttggaaaggacgtctatgaatatgtggctattggtgtttactctttattggctctctctgtgttctttctttatgttcgatgcactgccattgatcctgctgatcagggtgtaacggttgactgtgacaagtcatccaagaatagatcaaaacatgatgaagagttagcagaacccagcaagataggactaaagggtgaaggaatgtctgatcggcacaattcaaattggtgctcgaaagttgggtgtttcttctgtggttttcttgttagagaagactgccgcagtaatgaagatatcattccacagcagcaatctggagaagaggatgctttgttctgcactttgtgcaatgctgaggtgcggaagtttagtaagcattgtcgaagttgtgacaaatgtgttgatggatttgatcatcattgtcggtggttgaacaattgtgttggaaagaagaattacatcacgtttgtgtgtcttatggcagtgagcgttgtttggcttattgttgaatgtggagttgggattgcagtgcttgtcagatgctttgttgataaaaaaggtacagagcatcagatagctgaaaaacttggagctggattctccagggtcccatttgctactatagtggccatatgcacagcagtttcattccttgcaactgtgcctctgggagaattattctttttccatatgatcctgatacggaagggtatcacaacttacgagtatgttgttgccatgagaactctaagtgaaccacctggtccttcagttgatggaggtgaacaacagagtctaccatcatctcctactagttcagctgtcactgcaatgagtggaagaagctccgttggaatgagtttgcagtacaaaggtgcctggtgtacacctccaaggatctttatggatcacccggatgaaattataccacatttggagcctggacggcttccatccactgttgatccagatgcagtacaaccactatctgacaaagggaaaaagttgaaccagcgccctgtgcggataagtgcatggaaacttgcgaaattggattctaatgaggcaactaaggcagctgctaaagctagagcatcatcgtctgtgctacgtccaatcagttctcgacctcatgcatatgacgtggatcatttatctagtagcaatgtgagtggaagaagcagcccaattagcaatcatcaaggatttcataacaaatatgatacagcggggacatcaaggttatctccttcgaagagctcatacgctcctagccaagcgagcaaggatgatatggatgcatcatgtcatcacagtatgagcaacttcagcagtccacaagtctcaaacatgactccttcaccaatgcagcccagttcgaacagagaccatttcaaccccatgtatcaacaaccatcgggaaaccagtctccttcatcagctaaagaaagtgatggggggaacacgaaaccagttcaagaaaatgtggcacgtgtgccaatgagaagcaacagcttagctgtttcagataatagaagatcgtcggtattttgggatcaggctgcgggacgctttgtgtcgtcctcatcctcatcaagaggtcctggcagttcccagatctctggaacagagttattgtacactggtcgatctatattctttggcagtcccgttgtgaatgaacagccaaatacgggaacaagagttagcagttcagtaactggtattccggatagagattctacattaagggattttcagcaaggtagatcacatagaggtggccagctccctgtgtttgttcctggttactcccagcaaaataagttcccctagattgcctttgcctcactccttcaccattaatttcttactgcaactatttcttatccttttttaatttaaaagaaattctccaaacatgttatcttgcgcttttaaatgtccctcgtttgacttctttcccagctatgactcagccttcgtctttccatctgtacagactaatggatcaccacccttttctgtacaaatttatttcttcactatcattgcttttcaagtttctattcgaaggtgaatatgcagagcactttattcctcaaataagtacgttttagcttattactttttgtgtttatttctataaa

SEQ ID NO: 1121 - DNA, 3906 bp, Glycine max
aaaattaacatggctggtggtgctgctactgcagaaagaagcttaaaggagacacccacatgggcagtagctgctgtttgttcagtgttcatcatcatctctgtattaattgaacacggaatccattcacttggaaagtggtttcaaaaacgacataagaaggccatgaatgaagccttggagaaaatcaaatcggaattaatgttattaggattcatatccctattaataacttttggtacaaaatacattgcaaagatatgcatccctgtgtcagctggtgacataatgcttccatgcaagaaggtggaagtgtcagattcagatgatgactcaaatgacagaaggaagctactttcttttgacgacaacgtggtggaatggcgtcgagttttagcagctgcatctgggggtgactattgctcacaaaaaggtaaagtgcctttgatctctcagtctggggtgcaccagttgcatatatttatatttgtcctcgctgtttttcacattttctacagcgtcatgaccatggttctagccagagcaaaaatgaagaaatggaaggcttgggaagcagaaacatcttccctggagtatcaatttacaaatgatcctgcaaggttcaggttagcgcatcaaacatcattcgttaggcgtcactctggttggtctaggatgccaggaattcgatggatagtggcattcttcaggcaatttttcgggtctgtcactaaggtggattacatgaccatgcggcacggatttattaacgcacattttgctcccgatagcaaatttgactttcaaaaatacattaaaagatccatggaggacgactttaaagtggtcgtgggtataagcattccgttatgggtttttgcaatcgtctttatgcttgtgaacgtttacaaatggtacacgctcacttggctatcattagcaccactagtggtaatacttctattagtgggcaccaagcttgaacttataatcatggaaatggcccaacaaatccaagaccgagccacaattgttagaggagtccctattgtagagccaaacaacaagtatttttggtttaaccggccccagtggattatcttcttaattcattttaccttgttcgagaatgcattccaaatagcctttttcttgtggacatggtatgagtttaagatcacatcttgcttccatgaaaacttgcccctaatactgacaagggttgtccttgggatagccttacaagtcgtatgcagttacatcacattccctctctattccctagtaacacagatgggatctcacatgaagaaaacaatctttgaggagcaaactgcaaaggcacttaagaaatggcaaaaggctgcaaaggacaagagaaagttaaggaaagcaggaatagatattccttcagggactatgagtggggaaacaacaccaagccaaggcacatcacccttgcatttgcttcacaagtacaagccaagccacacagacacagatagtgttctttattctccacgatcataccaatctgacactgacttgtccgagacagagggatcttcacaccaattgaatgaaataacacaaacgcgtcaagcttcaagaaatggagaaactcataatatcgatttttccttttccgttagagtttcggtcatggctaggcgtcatggatgggagctcccctttcacacttttcaggtcgtggctataacagtatttttcttgctatctatagcatattatgctttctttgctccttttcttggaaaggacatctatgaatatttggctattggtgtttactctgtattggctctctccgtgttctttctttatgttcgatgcactgccattgatcctgctgataagggagtcatggttgattgtgacaagacatcaaagaatagatcaaaacttgatgaagagttggcagaacccagcaagatgggactaaagggtgatggaatgtctgatcggcacaattcaaattggtgctctaaagttggatgtttcttctgtggtttccttgttagagaagattgctgtagtaatgaagaaattagtctacagcaacagtctggggaagaggaggctttgttctgcactttgtgcaatgctgaggtgcagaagtttagtaagcattgtcgaagttgtgacaaatgtgttgatggatttgatcaccattgtcggtggttgaacaattgtgttggaaagaagaattacatcacgtttgtgtgtcttatggcagtgagcctagtttggcttatagttgaatgtggagttgggattgcagtacttgtcagatgtttcgttgataagaaaggtacagagaatcagatagctgaaaaacttggagctggtttctctcgagtcccatttgctattattgtggccatatgcacagcagtttcattccttgcaactgtacctttgggagaattattctttttccatatgatcctgatacgaaagggtatcacaacttacgagtatgttgttgccatgagaactctaagtgaaccacctgggccttcagttgatgggggtgaacagcagagtctaccatcgtctcctactagttcagctgtcactgcaatgagtggaagaagctccgttggaatgagtatacagtacaaaggtgcctggtgtacaccgccaaggatctttatggaccacccggatgaaattataccacatttggagccgggacgcctaccatccactgttgatccagatgccgtacaaccacctgacaaagggagaaaaatgaaccagcgccctgtgcgtataagtgcatggaaacttgcaaaattggattctaatgaggcaactaaggcagctgctaaggccagagcatcatcgtctgtgcttcgtccaattagttctcgacctcatgcgtatgatgttgatcatgtatccagtagcaatgtgagtggaagaagcagcccaatcagcaatcaaggatttcatataaaaaatgatacagtggggacatcaaggttatctccttccaagagctcgtaccctcctagtcaagcaagcaaggatgacatagatgcatcatgccaacacagtatgagtaactttagcagtccacgagtctccaaccttactccttcaccaatgcagaggccaggtttgaacagagaccatttcaaccccatgtatcaacaaccatcgggaaaccagtctccttcgtcagctaaaggaagtgaagggaacataaatccagttcacgacaatgtgccacgtgtaccaatgagaagcaacaccttagctgtttcagataatagaagatcgtcagtgttttgggatcaagcagctggacgctttgtctcgtcctcatcaagaggtcccggaacagaattattgtacacgggccgttctatattttttggcagccccgttgtgaatgaacagccaagtacaggaacaagaagtagcagttcagtagtagctggtattccggatagagattcttctacattaagggattttcagcaaggtagatcacataggggtggccagcttcctgtgtttgttcctggttgtggttatgcccagcaaaacaagtttccttagattgcctccttgttacggcaactgttttttatccttttttattttattttttttaaattaactaaactttttaaatgtccgtctttttacttcatcgtttcccccttatgacggtatgagtgcattcgcctttccatctgtataggctaatgaatggatcacgaccttttactgtacaaaattattgaccactatctttgcattttaagtttgaatatgaacgtgaatattcagagagtagtagttcacatgtagctttgagtactgagtagtttataagtttattttattaacttaaagtggttgtaatttttt

SEQ ID NO: 1122 - DNA, 3933 bp, Glycine max
caaattaattaacatggctggtggtggtgctactgcagaaagaagcttagaggaaacacccacatgggcagtagctgctgtttgctcagtgttcgtcatcatctctgtattaattgaacacggaatccattcacttggaaagtggtttcaaaaacgacataagaaggccatgaatgaagccttggagaaaatcaaatcggaattaatgttattaggattcatatccctattaataacttttggtacacaatatattgcgaagatatgcatccctgtgtcagccggtgacataatgcttccatgcaagaaggtggaagtgtcagattcagatgatgactcaaatgacagaaggaagctactttcttttgacgacaacatggaatggcgtcgagttttagcagctgcgtctgggggtgactattgctcacaaaaaggtaaagtgtctttgatctctcagtctggggtgcaccagttgcatatatttatattcgtcctcgctgtttttcacattttctacagcgtcatgactatggtactagcccgagcaaaaatgaagaaatggaaggcttgggaagcggaaacatcttccctggagtatcaatttacaaatgatccttcaaggttcaggtttgcgcatcaaacatcattcgttaggcgtcactctggttggtctaggatgccaggaattcgatggatagtggcattcttcaggcaattcttcggttctgtcagtaaggtggattacatgaccatgcggcacggatttattaacgcacattttgctccggatagcaaatttgactttcaaaaatacattaagagatccatgaaggatgactttaaagtggtcgtgggtataagcattccgttatgggtttttgcaatcgtctttatgcttgtgaacgtttacaaatggtacacgctcacttggctatcattagcaccactagtgatacttctattagtgggcaccaagcttgaacttataatcatggaaatggcccaacaaatccaagatcgagccacaattgttagaggagtccctattgtagagccaaacaacaagtatttttggtttaaccggccacagtggattatcttcttaatccactttaccttattcgagaatgcattccaaatagcctttttcttgtggacatggtatgagtttaagatcacatcttgcttccatgaaagcttgccgctaatactgacaagggttgtccttggaatagccttacaagtcgtgtgcagctacatcacatttcctctctattccctagtaatacagatgggatctcacatgaagaaagcaatctttgaggagcaaactgcaaaggcacttaagaagtggcaaaaggctgcaaaggacaagaggaagttaaggaaagcagggatagatatgagtggggaaacaacaccaagccaaggcacatcacccttgcatttgcttcaaaagtacaagccaagccacacagacaccgatagtgttctctactctccacgatcataccaatctgacactgacttgtctgagacagagggatcttcacaccaattgaatgaaataacacaaacgcatcaagctccaaggaatggagaaactcataatatcgatttttccttttccgttggagattcggtcatggctaggcgtcatggatgggagctcccctttcacacttttcaggtcgtggctataactgtatttttcttgctatctatagcatattatgctttctttgctccttttctgggaaaggacatctatgaatatgtggctattggtgtttactctgtattggctctctctgtgttctttctttatgttcgatgcactgccattgatcccgccgaccagggagtcatggttgattgtgacaagacatcaaagaatagatcaaaacttgatgaagagttggcaggaatagagcagattatacatcatgtaattgtgttaattagagtaactacaaaccctaaatcatatgtaacagatttatatatgcctttttgtagttggtgctctaaagttgggtgtttcttctgtagtttccttgttagagaagattgccgcagtaatgaagatattagtctacagcaacaatctggagaagaggaggctttgttctgcactttgtgcaatgctgaggttcggaagttcagtaagcattgtcgaagttgtgacaaatgtgttgatggatttgatcaccattgtcggtggttgaacaattgtgttggaaagaagaattacatcacgtttgtgtgtcttatggcagtgagcctagtttggcttatagttgaatgtggagttgggattgcagtacttgtcagatgctttgttgacaagaaaggtacagagaatcagattgctgaaaaacttggagctgggttctctcgagtcccatttgctattattgtggccatatgcacagcagtttcattccttgcaactgtacctttgggagagttattctttttccatatgatcctgatacgaaagggtatcacaacttacgagtatgttgtggccatgcgaactctaagtgaaccacctgggccttcagttgatgggggtgaacagcagagtctaccatcgtctcctactagttcagctatcactgcaataagtggaagaagctctgttggaatgagtatacagtacaaaggtgcctggtgtacaccgccaaggatctttatggaccacccggatgaaattataccacatttggagccaggacgcctaccatccactgttgatccagatgcagtacaatcacctgacaaagggagaaaaatgaaccagcgccctgtgcgaataagtgcatggaaacttgcaaaattggattctaatgaggcaactaaggcagctgctaaggccagagcatcatcgtctgtgcttcgtccaattagttctcgacctcatgcatatgatgtggatcatttatccagtagcaatgtgagtggaagaagcagcccaattagcaatcaaggatttcatatcaaatacgatacagcggggacatcaaggttatctccttccaagagctcataccctcctagtcatgcaagcaaggaagacatcgattcttcatgtcaacacagtatgagtaacattagcagtccacaagtctccaaccttactccttcaccaatgcagaggccaagtttgaacagagaccatttcaaccccatgtatcaacaaccatcgggaaatcagtctccttcgtcaggtaaaggaattgaagggaacataaatccagttcacgacaatgtggcacgtgcaccaatgagaagcaacaccttaggtgtttcagataatagaagatcgtctgtgttttgggatcaagaagctggacgctttgtctcatcctcatcaagaggtcccggcagttctcagattcccggaacagagttattgtacacgggccgttctatattttttggcagccccgttgtgaatgaacagccaagtacgggaacaagaagtagcagttcagtagtagctggtattccggatagagattcttctacattaagggattttcagcaaggtagatcacataggggtggccagcttcctgtgtttgttcctggctatgcccagcaaaacaagttcccttagattgcttccttgaccattaatttgttacggcaactgtttcttatccttttttaattttttaaaaattcctaaactttttctaaatgtccatctttttacttcttcgtttctcccgtatgacggtatgagtgcattcccctttccatctgtataggctaatggatcacgacctttatctgtacaaaattatttaccactagctttgcattttaagtttgaatatgtacgtcagagagttgatgtagctttgcgtactgagtagttttgtaagtttatttgatttaaattaaagtctttgtaattttttt

SEQ ID NO: 1123 - DNA, 2331 bp, Arachis hypogaea
agagagagagagcgatttcttctttggtcactctcagtcatggctcgccgtcatggttggagtcttccttttcacactttccaggtggtggctattaacggttttttcctgttatccatcgcattctatgccttctttgctccttttctcggaagggatatttatgaatacgtggcctttggtgtttattccgcaccggctctctctgtattccttctttatgttcgatgcactgccattgaccctgctgatttgggagttctgcttgattctgacaagacatcgaagaaccaatcaaaagccgatgaagaattggcagaaactggcaagacaggattaaaaggtgaaggaacgtctggtcagcataattcaagttggtgctccaaaattggatgtttcttctgtagtttccttgtcagagaagattgtcgcagtaatgaagataataatctacagcaacaatctggagaagaggaagctttgttctgtactttgtgcaatgctgaggttcggaagttcagtaagcattgtagaagctgtgacaaatgtgttgatggatttgatcaccattgtcggtggttgaacaattgtgttggacggaagaattatgtcacctttgtgtgccttatggcagtaagcctagtttggcttatagttgaatgtggagttgggattgctgtgcttgtccgatgctttgttgataagcgggacacagaaaatcaaatagcagaaaaacttggagctggattctctcgagtcccatttgctattatagtggccatctgcacagcagtttctttcctggcaactttacctttgggagaattgctcttttttcatatgatcctgatacgaaagggtattacaacatatgagtatgttgttgccatgagaactctaagtgagcctccgggtccttcagtagatgctggtgaacagcatagtctaccatcatctcctaccagttcagctgtcacggcagtaagtggaagaagttctgttggaatgagtttgcaatacaagggtgcttggtgtacacctccgagaatattcatggatcacccggatgaaatcataccacatttggagccaggaaggctgccatccacagttgatccggatgcaatacagccacctgacaaggggaaaaaaccaaatcatcgtgctgtgcgaataagtgcatggaaacttgcaaaactggattccaatgaggcagctaaggcagctgcgaaagctcgagcatcatcatctgtgcttcgcccaattaatgctcggtctaatccatatgatgcagataatttatccagcagcaatgtgagtggaagaagcagtccaattagcaatcaaggatttcataataaatatgatgcagctggcacatcaaggttatcaccttacaagggctcatatcctccaagtcaagcaagcaaagaagatttagattcatgtcagcacagtatgagtaactttagcagtcctcaagtttccaacttaaccccttcaccaatgcagattccaactttgagcagagaccatttcaacccaatgtatcagcaaccatcaggaaatcagtctcctttatcagccagagaaagcgaagggaatgtaaatccagttcgtgataacaatggacgcctaccaatgagaggtaacaacatagctgtttccgagaacagaagatcattagtattttgggaccaagaagctgggcgcttcgtctcgtcctcatctggtggtcatggcagttctcaagtttccggaacagagttattgtacagtggtcgttctatattttttggcagtcctgttgtgaatgaacaggcaactacgggaacaagaagtagcagctcagcagcgggtattcaagatagagatgctgcattgagggaatttcagcaaggtcgatcacatagaggtggccagcttcctgtgtttgttcccggttattcgcaatcgcaatcacaatcacaatcgcagcaaaacaagttctcatagactacgttctatttgtgacggcaattttttccttatctttagtgtctttaatttcgaatagaattcccaagccaaaacatatattatcttgcacgttaaagatccttgttgcgactgttgtggtttgatgcatttgccattccatctgtacaggctaatggaaaatggatcataacctttcactgtactaacatattgaccactgggcactgtcatcgcatttgaaattttaatttgaacattgatatttgattctgcccttgctacttggtatctgtaaacaagtagatatgtcaatgtaaacactaagttttatgtgaaaccaattattgatta

SEQ ID NO: 1124 - DNA, 1485 bp, Medicago truncatula
ctagtcagaccaatccaaggggttactcttcattctattctctataaaaaccaacccattaggtccttcatttctcaaatcccacagttcttgtcttcctatattgcgtgtgtctgggtgtggataaaaatggcagccactcatgggaaaataatcttgttcatgtttcttgcagcctttatgttgtttaatacccaaaatgcattcgtgagttgtgctttaacatcagagttacaaaacaaaattgctaaaatcaacgaagagggtccttatttgggtttaatcataccaaattcttttgaacttaaccctcttcttcaaaatccaggctatactcctagtgatagcatcatagattttgcaggaaggagatttcgttttggatccattggcgagaaaccagttatactggtaatgacgggattgagcgtgataaacgcagctataacaacacagcttctattaagctttttcaaagtagatggagttgttcattacggaattgctggaaatgcaaacccttcattgcatattggagatgttgctattccacattattgggctcatttagcactttggagctggcagaggtatgggcaagatgctgatgatacgttaccactagaaatcaatggtgactacacaagggacgtaggtttcttgaaattttcagattttacctcaaacataagtgctgctgacagtgttacagttgacaatcatctcaacaatctttggtaccaaccagaagagatttttccagttgatggcattcctgaacaaaggcaacatgctctttgggtccctgttgattccgagtactaccgtattgccaaaaaactcgagcaaatgaaactagatgcgtgtatagactcagacacatgcttgacaacgacaccaaaggttgtgcttgtggagagaggaacaagtgcagggttctatctagacaatgcagcatacagaaccttcatcttcaataagtttaacgtgagtccagtggacatggaaagtgcatcagtggctcttatatgcttgcaacaaaggattcctttcattgctattagggctctctctgacttggctggtggcggcaccgcggagtcgaacgaggctgataccttctcaccactggctgcaaccaactctgttgctgtggtcattgagtttgtgaagctattgtcatcacaccactctaagtggtaaactatgttatgatgatgttttcaataatccgtaattagtgcaattatatgcacatgtagacaacaactttgttctggttgtttgtccggaatataataaagcaccagcactaaataaatattatcatatatataattaagctctaaatggtacttatagatggactatcagacatctgaaggtaacgacatatatatcaactctaacacagtatttccattgcagcagcactagattaatgtttccctcagactccatttctcatgtgaaaataaatgcatt

SEQ ID NO: 1125 - DNA, 1341 bp, Medicago truncatula
agaccaatccaaggggttactcttcattctattctctataaaaaccaacccattaggtccttcatttctcaaatcccacagttcttgtcttcctatattgcgtgtgtctgggtgtggataaaaatggcagccactcatgggaaaataatcttgttcatgtttcttgcagcctttatgttgtttaatacccaaaatgcattcgtgagttgtgctttaacatcagagttacaaaacaaaattgctaaaatcaacgaagagggtccttatttgggtttaatcataccaaattcttttgaacttaaccctcttcttcaaaatccaggctatactcctagtgatagcatcatagattttgcaggaaggagatttcgttttggatccattggcgagaaaccagttatactggtaatgacgggattgagcgtgataaacgcagctataacaacacagcttctattaagctttttcaaagtagatggagttgttcattacggaattgctggaaatgcaaacccttcattgcatattggagatgttgctattccacattattgggctcatttagcactttggagctggcagaggtatgggcaagatgctgatgatacgttaccactagaaatcaatggtgactacacaagggacgtaggtttcttgaaattttcagattttacctcaaacataagtgctgctgacagtgttacagttgacaatcatctcaacaatctttggtaccaaccagaagagatttttccagttgatggcattcctgaacaaaggcaacatgctctttgggtccctgttgattccgagtactaccgtattgccaaaaaactcgagcaaatgaaactagatgcgtgtatagactcagacacatgcttgacaacgacaccaaaggttgtgcttgtggagagaggaacaagtgcagggttctatctagacaatgcagcatacagaaccttcatcttcaataagtttaacgtgagtccagtggacatggaaagtgcatcagtggctcttatatgcttgcaacaaaggattcctttcattgctattagggctctctctgacttggctggtggcggcaccgcggagtcgaacgaggctgataccttctcaccactggctgcaaccaactctgttgctgtggtcattgagtttgtgaagctattgtcatcacaccactctaagtggtaaactatgttatgatgatgttttcaataatccgtaattagtgcaattatatgcacatgtagacaacaactttgttctggttgtttgtccggaatataataaagcaccagcactaaataaatattatcatatatataattaagctct

SEQ ID NO: 1126 - DNA, 532 bp, Medicago truncatula
tttgtttctgaaaatatgtctagctgtggttgtggaagcagttgcaactgtggtgatagctgcaaatgcagcaagaggtctagtggattgagctatgccgaggccgaaaccacagaaaccgtgattttgggcgtcggtctggccaagatccaatttgaaggtgctgaaatgggtgttgcagctgaggatggtggctgcaagtgtggagataactgcacatgtgacccttgcaactgcaaatgaagtgcagcatatatatgaaagcctcttgaagcagagatagtggaaccaatatgtgtaattgtgtgtattagtacacatttaatatataagaagcatgtgtttccttttttagaataatatgaagtggtcatggatctcaccttcatcaaattcaaatgttcttagattttgttgaaggtgttatgagagctatgatcgctttgtgtttggttgtcttgtataatgtatagctaaaagctaatatgaatcataaatctctgcctattataaatagaatatattattgtgt

SEQ ID NO: 1127 - DNA, 503 bp, Pisum sativum
cgggggcctcaattgtagtgaagatcacagcccccacgcaattaatctcaattgttgttcgcaaaaaatcttagtttctgaaaatatgtctggatgtggttgtggaagtagttgcaactgtggtgatagctgcaaatgcaacaagaggtctagtggattgagctactccgaaatggaaaccacagaaaccgtgattcttggcgtcggtccggcgaagatccagtttgatggtgctgaaatgagtgttgcagctgaggatggtggctgcaagtgtggtgatagctgcacttgtgacccttgcaactgcaaatgaagtgcaacacatgaaaggttgaagcagagatattggaggcaatatatgtaatgatataatgtagaaaaagcatatcatatatgtttgcttttttaaaataaaataaagtggctatagttgctttgggtttggttgtcttgtgtaatgttaaagctaattatagctaatatcaatcataaatctctgctta

SEQ ID NO: 1128 - DNA, 497 bp, Pisum sativum
acaccacttttatagaagataacactaaccaagcaattaatatcaattgttgtttgcaaaaaaaaatcttagtttctgaaaatatgtctagctgtggttgtggaagcagttgcaactgtggtgatagctgcaaatgcagcaagaggtctagtggattgagctactccgaaatggaaaccacagagaccgtgattcttggcgtcggtccggcgaagatccagtttgatggtgctgaaatgagtgtcgcagctgaggatggtggctgcaagtgtggagatagctgcacttgtgacccttgcaactgcaaatgaatatgaaagtttgaagcagagatattggaggcaatatatgtaatgatatgatgtagaaaaagcatatcatatatgtttgcttttttaaaataaaataaagtggctatagttgctttgtgtttggttgtcttgtgtaatgttaaagctaattatagctaatatcaatcataaatctctgcttattat

SEQ ID NO: 1129 - DNA, 693 bp, Cicer arietinum
gattagcgtggtcgcggccgaggtaccatttcgacccagcggttttgtctagtggtctcagccagtgagacaaattgtcgaagcccggtcgtgttctgggcggcagccgaggctgcaaagaagaagaggttctctgggcagttctttttgcaaattgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgacgaagattcagttcgagggagctgaaatgagtgttgcagctgaagatggtggctgcaagtgtggatcaagctgcacatgtgacccttgcaactgcaagtgaggtgcatatagcaaatgaaagcttgaggcagagatattggaaccaatatgtgtaattgtgtgtatcggtacacatataatatataaaaaaagcatgtgtgtttgctttattagaataataaagttgtcatggatctcacctttagcaaattgaaattttctaattagattttgttgaaggtgttgtgagagcaatggttgctttgtgtgttgattttcttgtgtaagcaaatttagctaatatgaatcataaatctctgcttattgaatt

SEQ ID NO: 1130 - DNA, 591 bp, Cicer arietinum
gatttcgagcggccgcccgggcaggtctcaccaatattgttctttttgcaaattgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgacgaagattcagttcgagggagctgaaatgagtgttgcagctgaagatggtggctgcaagtgtggatcaagctgcacatgtgacccttgcaactgcaagtgaggtgcatatagcaaatgaaagcttgaggcagagatattggaaccaatatgtgtaattgtgtgtatcggtacacatataatatataaaaaaaagcatgtgtgtttgctttattagaataataaagttgtcatggatctcacctttagcaaattgaaattttctaattagattttgttgaaggtgttgtgagagcaatggttgctttgtgtgttgattttcttgtgtaagcaaatttagctaatatgaatcataaatctctgcttattgaat

SEQ ID NO: 1131 - DNA, 361 bp, Pisum sativum
gaagataacagcaaccaagcaattaatatcaattgttgtttgcaaaaaatcttagtttctgaaaatatgtctggatgtggttgtggaagcagttgcaactgtggtgatagctgcaaatgcaacaagaggtctagtggattgagctactccgaaatggaaaccaccgaaaccgtgattcttggcgtcggtccggcgaagatccagtttgaaggtgctgaaatgagtgctgcttctgaggatggtggctgcaagtgtggtgataactgcacttgtgacccttgcaactgcaaatgaagtgtaacatataaaagcttgaagcagagatattgaaaccattatgtttaattgtgtgtatgagtac

SEQ ID NO: 1132 - DNA, 602 bp, Trifolium pratense
gaagaatcaaccaaccaataatattaattgttctttgctttgcaaatatttgtttgtgagaaaatatgtcaggctgtaattgtggaagcagttgcaattgtggcgatagctgcaaatgcaacaagaggtcaagtggattgagctatgtcgaagtggaaaccacagaaaccgtgattctcggcgttggtccggcaaagatccaatttgagggtgctgaaatgggtgttgcagctgaggaaagtggctgcaagtgtggatcaaactgcacatgtgacccttgcaactgcaagtgagatgcaacatatgaaagtttgaagcagagataataatggtatcaatatgtataattgtgtgtatgagtaatgagtgtacacatttaatgtataagaagcatatactagtatgtatgtgtttgcttttatagaataataatataatgtgttcatggatctcactttcaacaaattgaaatattcttagattttgttgaaggtgttatgagagctatgtggttgctttgtgtttggttggcttgtgtaaactatacctaatttgaatcataaatctctgcatattataaatggaagttggttttaattaac

SEQ ID NO: 1133 - DNA, 522 bp, Trigonella foenum-graecum
atcaatccaatattaaattgttctttgctttgctaatctttgtttctgaaaatatgtctagctgtagttgtggaagcagttgcaactgtggtgataactgcaattgcaacagtagtgggttgagctacgccgaaggcgcagccacagaaacggtgattttgggcgttggtccggcaaagatccaatttgagggtgctgaaatgggtgttgcagctgagaatggtggctgcaagtgtggagataactgcacatgtgacccttgcaactgcaaatgaagtgcctattgaagcagagataatggaaccaatatgtgtaattgtgtgtatcagtacacatttaatgtataagaagcatgtatttggatttttagaataattataaagtggtcatggatctcaccttcatcaaattcaaatgttcttagattttgttgaaggtgttataactacaagaactatgttctctttgtgtttggttgccttgtgtaatgtatagctaaaagctaatatgaatcataaatct

SEQ ID NO: 1134 - DNA, 1270 bp, Cicer arietinum
gtgttgtgtgattttatctgtcttttgagaatatgtctggctgcaactgtggaagtagctgcaactgtggcgatagctgcaaatgcaacaagagatcaggattgagctatgtcgaagccggcgaaaccacagagacggtggttttgggcgttggtccgacaaagatccatttcgagggagctgaaatgagtgttgcagctgaagatggtggctgcaagtgtggatcaagctgcacatgtgacccttgcaactgcaagtgaggtgcttataacaaatgaaagcttgaagcagatatgtgtaattgtgtgtatggtatggtacacatataatgtataataagaatgtgtgtttgctttgttaaaatgttaaagtggtcacggatctcacctttagcaaattgaaatgttataattagattttgtcgaaggtgatatcagagaattgttgtctttcatgtgtaagcaaatatagctaatatgaatcataattctctgcttcttcaatgaaataaaaaacagaacgtgagctgagatggctggtggagttattcaacagttattgaggaggaaattccaatctcattctctgagtccttcagtgtcatccattttctcaaaggcagagggttctggatctaccggcagcagctccttaagagccctagctttaataggagctggtgtttcaggtcttttgggttttgcaacaacagcatcagctgacgaagctgagcatggcctggcatctccaaactatccatggcctcacgagggtatcctcagttcatatgaccatgcttcgattcgccgtggtcatcaagtttatacacaagtctgtgcttcctgccattccatgtctttgatatcataccgtgatttggttggtgttgcttacacagaagaagaggtaaaggctatggctgctgagattgaggtggaagatggccctaatgatgagggtgagatgtttacacgtcccggtaaactcagtgatcgctttcctcagccatatgccaatgaatcagctgctaggtttgctaatggaggagcctatcctccagatctaagtcttattaccaaagctcgtcacaatggtcagaactatgtgtttgccctgctaaccggttaccgtgacccacctgctggtgtttcgattagagaaggactgcactacaatccttattttcctggtggagccattgccatgcctaagatgcttaatgatggcgctgttgaatatgaagatggtgtccctgctacagaagctcaga

SEQ ID NO: 1135 - DNA, 684 bp, Cicer arietinum
gctagggttattgatttgagctttgagatttggagtttgagtttggggttgatggttgggagtgagatttggagcatggggagtttaggtgtaggaggggaaagggaaattgtgggaactcgaattatgggtttggaggatgccatgatcattgtggccatcgcgagggtaatttggaggatcagttacgctcgctctgtgtgttgtgtgattttatctgtcttttgagaatatgtctggctgcaactgtggaagtagctgcaactgtggcgatagctgcaaatgcaacaagagatcaggattgagctatgtcgaagccggcgaaaccacagagacggtggttttgggcgttggtccgacaaagatccatttcgagggagctgaaatgagtgttgcagctgaagatggtggctgcaagtgtggatcaagctgcacatgtgacccttgcaactgcaagtgaggtgcttataacaaatgaaagcttgaagcagatatgtgtaattgtgtgtatggtatggtacacatataatgtataataagaatgtgtgtttgctttgttaaaatgttaaagtggtcacggatctcacctttagcaaattgaaatgttataattagattttgtcgaaggtgatatcagagaattgttgtctttcatgtgtaagcaaatatagctaatatgaatca

SEQ ID NO: 1136 - DNA, 551 bp, Cicer arietinum
cctagattgttctttttgcaaattgtgttgtgtgattttatctgtcttttgagaatatgtctggctgcaactgtggaagtagctgcaactgtggcgatagctgcaaatgcaacaagagatcaggattgagctatgtcgaagccggcgaaaccacagagacggtggttttgggcgttggtccgacaaagatccatttcgagggagctgaaatgagtgttgcagctgaagatggtggctgcaagtgtggatcaagctgcacatgtgacccttgcaactgcaagtgaggtgcttataacaaatgaaagcttgaagcagatatgtgtaattgtgtgtatggtatggtacacatataatgtataataagaatgtgtgtttgctttgttaaaatgttaaagtggtcacggatctcacctttagcaaattgaaatgttataattagattttgtcgaaggtgatatcagagaattgttgtctttcatgtgtaagcaaatatagctaatatgaatcataattctctgcttcttcaatgaaataaatctttgcttatcaaa

SEQ ID NO: 1137 - DNA, 523 bp, Trigonella foenum-graecum
agataacatctaccaatcaatattattctttgctttgcaagttgagttgtgaatatgtctggctgtggttgtggaagcagttgcaattgtggtgataactgcacttgcaacagcaggtctagtgggttgagctacaccgaaggcgcaaccaaagaaaccgtgattctgggcgttgctccggcaaagatccattttgagggtgctgaaatgggtgttgcagctgaagatggtggttgcaagtgtggagatagctgcacatgtgacccttgcaactgttaagtgcagcatatgaaagattgaagcagagatattggaaccaacgtgtgtaattgtgtgtatgagtacacttataatatatacatgaagcatgtgtgtttggtttttagaataatataatgtggtcatggatctcaccttcaacaaatttaagtgttcttagattttgttgaaggtgttatgagagctatggttgctttgtgcttggttgtcttgtgtgtaaagtatggctaatatgaatcataaa

SEQ ID NO: 1138 - DNA, 851 bp, Cicer arietinum
ggtcttctatttggacacgacaatttcaaaagcaaaaccatggaaagaaaagggaaagtgccaccaagtcattgtttaaaagtaataacaacacttgaataaataaaaaaagtaataacaacagtcggtgtctttaataatttgatatgaaagtttgagtagagaaaaagagttgagaataaaaaatggagacggtgatggaagatgtagaagaatacaactacagagaagtgaatcttccttctctgatcccagtggtgggtgagccagagcttgaaagagaaacaggggagagaagaagaggaagggatatagttatagccatagatcatggtcccaatagcaaacatgcttttgattgggctcttattcatctatgcagacttgctgatactatccaccttgttcatgccgtttcagatgtgaagaaccaaattgtgtatgacatgacccaggtgctgatggaaaaattagctgttgaggcttttcaagtcgcaatggtgaaaacagtagctcggattgtggaaggtgatacaggaaaagtaatttgcaaagaagcagagagaaccaaacctgcagctgtggttatggggactagaggcagaagcttgtttcaaagtgtgttacacggaagtgttggtgagtactgctttcaccactgtaaagcagcacctcttgtcattgttcctggaaaagatgctggtgatgcttcaatcgtctagttgatttgccttgtgttttgtaatctatctaacttcatactcactgctttgcatgtaattgtaaaatattcatttcttcaatttaacaattgtttgccttcttatgttcacttttttatatataaaaaa

SEQ ID NO: 1139 - DNA, 877 bp, Cicer arietinum
ggtcttctatttggacacgacaatttcaaaagcaaaaccatggaaagaaaagggaaagtgccaccaagtcattgtttaaaagtaataacaacacttgaataaataaaaaaagtaataacaacagtcggtgtctttaataatttgatatgaaagtttgagtagagaaaaagagttgagaataaaaaatggagacggtgatggaagatgtagaagaatacaactacagagaagtgaatcttccttctctgatcccagtggtgggtgagccagagcttgaaagagaaacaggggagagaagaagaggaagggatatagttatagccatagatcatggtcccaatagcaaacatgcttttgattgggctcttattcatctatgcagacttgctgatactatccaccttgttcatgccgtttcagatgtgaagaaccaaattgtgtatgacatgacccaggtgctgatggaaaaattagctgttgaggcttttcaagtcgcaatggtgaaaacagtagctcggattgtggaaggtgatacaggaaaagtaatttgcaaagaagcagagagaaccaaacctgcagctgtggttatggggactagaggcagaagcttgtttcaaagtgtgttacacggaagtgttggtgagtactgctttcaccactgtaaagcagcacctcttgtcattgttcctggaaaagatgctggtgatgcttcaatcgtctagttgatttgccttgtgttttgtaatctatctaacttcatactcactgctttgcatgtaattgtaaaatattcatttcttcaatttaacaattgtttgccttcttatgttcacttttttatatataaaaaacaaacgttgctgtcaaaaaaaaaaaa

SEQ ID NO: 1140 - DNA, 931 bp, Cajanus cajan
aaaaaagcagttgctgttgagaatctttccttaatttcaaagcagagaaaaggtgaatggagacagtaatggaagatgaagaatacaactacagggaagtgacgcttccttctctgattccggtggtgccggagccagagctggagagggaaacaggggaaaggagacgtggaagggacttagtaatagccatagatcatggccccaatagcaaacatgccttccattgggctctcatccacctttctagactcgctgatactatccatctccttcacgccgtttcagacttgaagaatcaagttgtttatgacataacccaggggctcatggaaaacttagctgttgaggcttttcaagtagccatggtgaaaacagtagctcggattgtagaaggtgatccaggaaaagtaatttgcaaggaagcagagaggatcaaacctgcagcagtggttatggggaccagaggcagaagcttgattcaaagtgtgatacagggaagtgttggtgagtactgctttcaccactgtaaagcagcacctgttgtgattgttcctggaaaagatgccggagatgcctcaatcgtctagtggaattatgttttaaacaatgtaaagggatatgttttgtatattgcctttgttttatcgtgtatctaacttgaaatactagtgtgaagattgtttctaattcatttgaacaagaaaaaaaaaacaaagcatcaccctatgctgcggtttgtcttgtgattttacatattcttttctggaaagtaacaattgattgtctgcatacgttaccattatttaaaatctaattgtaacttttacttccatcaccgtggcttgtgtctcatagtttgcttttaggattatatttgttattggattaaattggtataaaggatatgacatgtatcttttttaacaaa

SEQ ID NO: 1141 - DNA, 1018 bp, Cajanus cajan
gggggggtacacgacatgtctaggcggctatggaaaagagaaagggcgagctgagacgcgctaatacaatatataaatatataaaaagaaaaaaagcagttgctgttgagaatctttccttaatttcaaagcagagaaaaggtgaatggagacagtaatggaagatgaagaatacaactacagggaagtgacgcttccttctctgattccggtggtgccggagccagagctggagagggaaacaggggaaaggagacgtggaagggacttagtaatagccatagatcatggccccaatagcaaacatgccttccattgggctctcatccacctttctagactcgctgatactatccatctccttcacgccgtttcagacttgaagaatcaagttgtttatgacataacccaggggctcatggaaaacttagctgttgaggcttttcaagtagccatggtgaaaacagtagctcggattgtagaaggtgatccaggaaaagtaatttgcaaggaagcagagaggatcaaacctgcagcagtggttatggggaccagaggcagaagcttgattcaaagtgtgatacagggaagtgttggtgagtactgctttcaccactgtaaagcagcacctgttgtgattgttcctggaaaagatgccggagatgcctcaatcgtctagtggaattatgttttaaacaatgtaaagggatatgttttgtatattgcctttgttttatcgtgtatctaacttgaaatactagtgtgaagattgtttctaattcatttgaacaagaaaaaaaacaagcatcaccctatgctgcggtttgtcttgtgattttacatattcttttctggaaagtaacaattgattgtctgcatacgttaccattatttaaaatctaaattgtaacttttacttccatcaccgtggcttgtgtctcatagtttgcttttaggattatatttgttattggattaaattggtataaaggatatgacatgtatctttttaacaaat

SEQ ID NO: 1142 - DNA, 843 bp, Glycyrrhiza uralensis
gaccccattgccaaattttgtagtataaaaaggagtattaacaaccacttgcgatcggtctttaattcctatttcgataatcgcaatctgaaaccgaagttggagtagagggaaactgaatagtgaaggaaaggaaatggagacagtgatggaagaggtggaggaatacaactacagagaagtgatgctaccgtcactgataccagtggtggcagagcctgagcttgagagggaaacaggggaaaggaggcgagggagggacatcgtcatcgccatagatcatggccccaacagcaaacacgccttcgattgggctctcgcccacttctgcaggctcgccgataccctccacctcgtccacgccgtttctgatttgaagaaccagcttgtctacgacactacgcaggggctcatggagaaattagcagttgaggcttttcaagtcgtaatggtgaaatcagtagctaggattgtggaaggtgatccagggaaagtaatttgcaaggaagcagagaggatcaaacctgcagcggtggttttggggaccagaggcagaagcttgtttcagagcgtgctacagggaagtgttggtgagtattgctttcaccactgtaaagcagcacctgttgtgattgttcctggaaaagatgctggagatgcgtcaaccatctagtagatttaggttgtaggagcttgtgttttgtatatccgctttgttttgtaatgtgtctaacttcatattcatatattagtgtgaagattgattccaattcatttgaaccaaaaaaagagcatcatgtgctgtggtttgttttgtgatactgatatcccacttttccgttt

SEQ ID NO: 1143 - DNA, 972 bp, Lotus japonicus
ctagtaggctagtataccaataataatttctgaaatttgagaacagatagagaaaacacaaagaaaagagagttgattgatcttatttggtgaaggaaatggagacagtgatggaagatgtggaagaatacaacttcagagaagtgaggcttccttctctgataccagtggtgccagagccagagcttgagagagagtcaggggaaagaagaagaggaagggacatagtgttagccatagatcatggtcccaacagtaaacatgcttttgattgggccctcatccacctttgcaggcttgctgataccatccaccttattcatgctgtttctgatgtgaagaaccaacttgtgtatgacactacccaggggctgatggagaaattagcagttgaggcttttgaagttgcaatggtgaaaacagtagctaggattgtggaaggtgatgcagggaaagttatttgcaatgaagcagagaggatcaaacctgcagctgtggttatggggaccagaggccgaagcttgattcaaagcgtgctacaaggaagtgttggtgagtactgtgttcacaactgtaaatcagcacctgttgtgattgttcctggaaaagatgctggagatgcgtcaatcatctagtgatgggtattaaattgcggtttcagctgcgttgcgaaattgtggatatatgcgggttgaaacaacagcaattgcagtcgagatgctgttgcgggggcttcaaaacctttactactgcggtccgcagtttaaaaccctgatctagtggcattaggttgtgaaaggttgtgttttatatataggctttgctttgttatgtatagcttcggtgtgttaagattgattctaattcagttgaacccaaaaattgtatctaactactgctagtgtgaagattgattccaattcatttgaacaagggaaaaaatgcatcatatgctgtggtttgttttgtgat

SEQ ID NO: 1144 - DNA, 1020 bp, Arachis hypogaea
ggggaacaaaaggttgaagtgggagaacatagattagagttggacgttttccacttggccacgacatttgagtgctgaggcggctcctccctcaataatagagtaaagaaaagaagaggagagaagagaaataatggagacagtgatggaggaagtggaggagtacaactaccgagaagtgaggcttccgtctttgataccagttgtgggggagcctgagctggagagggaaacaggggagcgaagaagaggaagggacatactcatagccattgatcatgctcccaatagcaagcatgcttttgattgggctctcatccacctctgccgcctcgctgacaccatccacctcacgtaaagaacgaggtcgtctacgacttaacccagggtctcatggagaagttagcagttgaggcttttcaagtcctcatgtgaagacagtggctcggattgtggaaggtgatgcagggaaagtaattgcagggaagcagagaggatcaaacctgcggctgtagttctgggatcaagaggcagaagcttaattcaaagtgtgctacagggaagtgttggagagtactgcttccaccactgcaaagcagcacctgttgtcatcgttcctggaaaagatgctggagatgcatcaatattgtagtgaagctttgtacgtatgtcaattggccttgttaatatatctaacagtcatgtttagtgaaatgaagattggttctgactcattttcaccaagaatagagatgttttccttgcatatttttacatgttaaccactagcatgttattaattcaatggcttagtaactcattttctcattgtgctgtttagactttctttgatgttacaaagcatttggacagctttatttttggaataggtttatttgagttgctgttagattctactggtataaatatactattcatttgtattaatagttaaggaaaaaatataataaaaagaaagttcatctgtgcaacataatgggcagtgttgtagctataggc

SEQ ID NO: 1145 - DNA, 831 bp, Glycine max
gaaagttaacttcaataaacaaaaaaattgcttttcctgtctatcaaaaacatacataggataaatgttttgagcaatacccttaactggccaaaaaaaaaagtaacttatgtttgtttaattgtcttatgagtataggaatggagacagtgatggaagaggaagaatacaactatagagaagtgaggcttccttctctgatagcagtggtgggcgagccagagctggggagggaaacaggggaaaggagaagaggaagggacataataatagccatagatcatggccccaataccaaacatgctttcgattgggctctggttcacctttgcaggctcgctgataccatccatctcgttcacgccgtttccgacttgcataaccaagttgtctacgacataacccagggtcttatggagaaattagccattgaggcttttcaagtactaatggtgaaaacagtagctcgaattgtggaaggtgatccaggaaaagtaatttgcaaggaagcagagaggatcaaacctgcagctgtggttatggggacccgaggcagaagcttgattcaaagtgtgctacagggaagtgttggtgagtactgctttcaccactgtaaagcagcacctgttgttattgttcctggaaaagaggctggagatgcgtcaatcctctagtcgaattatgttgtaaaaggctgtgtttttattatcgcatttgttttatcgtgtgtatctattatcaaatactagtgtgaagattgtttctaattcattagaacaagaaaaaagagcatcacatgctgtgattattaatattcttttctggaaagtc

SEQ ID NO: 1146 - DNA, 730 bp, Vigna unguiculata
ggaaatttagttataattagcatctaaaataagagaaaatcagggggagtggttttgagaatggagacggtaatggaagatgaagaatacaactacagagaagtgaaacttccgtctctgcttccggtggcgccggagccggagttggagagggaaaccggggaaaggagaagaggaagggacataatcatagccatagatcatggcctcaacagcaaacacgctttcgattgggctctcgttcatttttgtaggctcgctgatactatccatctcgttcacgtcgtttccgatttgaagatgaatgattattatgagataagccaggggctgatggagaaattggctgttgaggcttttcaagtagcaatggtgaaaactgtagcgaggattgtggaaggtgatccaggaaaaataatttgccaggaagcagagaggatcaaacctgcagccgtaattttggggaccagaggcagaggcttcttgcaaagtgtgctacagggaagtgttggggtgtactgcttgcaccactgtaaagcagcacctattgtgattgttcctggtaaagatgctggagacgagtcaatagtctagttaccagtggaattaacttgtaaaatacttgttatgtatatcgtctttcgttttaccctgtatctataggtgtggagattgttatctttctttttcttcctatccttgttttaataaatcagatttcaatcgttcc

SEQ ID NO: 1147 - DNA, 744 bp, Vigna unguiculata
ggaaatttagttataattagcatctaaaataagagaaaatcagggggagtggttttgagaatggagacggtaatggaagatgaagaatacaactacagagaagtgaaacttccgtctctgcttccggtggcgccggagccggagttggagagggaaaccggggaaaggagaagaggaagggacataatcatagccatagatcatggcctcaacagcaaacacgctttcgattgggctctcgttcatttttgtaggctcgctgatactatccatctcgttcacgtcgtttccgatttgaagatgaatgattattatgagataagccaggggctgatggagaaattggctgttgaggcttttcaagtagcaatggtgaaaactgtagcgaggattgtggaaggtgatccaggaaaaataatttgccaggaagcagagaggatcaaacctgcagccgtaattttggggaccagaggcagaggcttcttgcaaagtgtgctacagggaagtgttggggtgtactgcttgcaccactgtaaagcagcacctattgtgattgttcctggtaaagatgctggagacgagtcaatagtctagttaccagtggaattaacttgtaaaatacttgttatgtatatcgtctttcgttttaccctgtatctataggtgtggagattgttatctttctttttcttcctatccttgttttaataaatcagatttcaatcgttccaattttcttgaccg

SEQ ID NO: 1148 - DNA, 944 bp, Linum usitatissimum
cgaagaaacaagtcttttttcttctctctgaaatattgggcagccgcggtcggaatttgaaattcaaatcgaaaacaaacaaggaagaaggaaatggaagtgttgcaggaagaagaagagtacaactggaaggaagtaaagttgccatctttgatccctaaagttccagaaccagagttggagagagagaaaggggaaaggaggagaggcagagatattatcatagcaattgatcatggacccaacagcaagcatgcctttgattgggctctcatccatttctccaggcttgccgataccctccatcttgttcacgccgtctcaagtgtgaagaatgatattgtggatgagatgacgcaaggccttatggagaagctcgctgttgaggcttttcaggtctctatggtgaaaagtgtggctaggatagtgcaaggagatgcaggcaaagtaatttgcaaggaagctgaaaggattaagcctgcagctgttgtgatgggcactagaggcagaagcttagttcagagtgtgctgcaaggaagtgtgagtgagtactgttttcaccactgcaaagctgcacctgtcatcattgttccagggacagaagctggagatgaatctatggtatcatggaactaagcaaatgcagtacggatgttgatggtgattcgaggaccagtgtgttgatgttgtgtgtttttatctcgattgtttcgtaagctttcattggttgactggaagcttgaagcagattgatgttatctcttgaatgtagagaccgaaagaatgatgcgttgttgatttgtattgctaatgagaggatgtaatgcctcagctgtgtgtaatgtaatgatatgtgaacaattgttagtcttgttgtccataaacaaactgatcactaggtaaaactcactagctccaagtaagctaaaaacatgtaatttgaa

SEQ ID NO: 1149 - DNA, 1926 bp, Theobroma cacao
tttcattggcattttcgtaattagagtcaagataccggcgataaataatagccaagttctgaaaccctaacaacgaaactggttcagcttcaaaaccagatcttttcgtcccttcctctgccaaaatcaaaaactctagcctttatctttatcattttccatgttttctgcgtttttattttgcttattttgaggatttaatgtagaaagagaaggtgcgatgatgattgtagaaattaaatctcgttaatctgattcgtaacatgaggatgaactttttcatccattcttagacgtcttctgagcgtcgtctctttcttttttttggtgcttctggcttttcccctgtccctcctttgtgagaaagaaatcatttttatttgctattctttgtgggataatacaaacattgttttagctttaaaaacttgtgttgaaatgtcattgaggattccattttgttaatcttctacaaattctgatttttcggcttgaatggggattaagtgttgtagcattaaggaacgatacgattcagaaattattatgagaactgaaacatttgggatcggttggaaagtatgacataaaccaaagcttagaacacaagaactcaggaacgaaatccttttttcttttcttgcggaaatcattttggaatcaatcaacttaatggatacggttttggaagatgaagagtacagttacagagaagtaaagttgccaacgttgatcccaatagttccagagccagggttggagagggagtcaggggagagaaggagaggcagagatatagtaatagcagttgatcatggtcccaacagcaagcacgcctttgattgggcgcttattcaccttgtcaggcttgctgataccatccatcttgttcatgctgtttccagcgtcagaaacgagattgtttatgagaccagccaagggcttatggagaagttagctgtggaggcgtttgaggttgccatggtgaagactacagctcgaattgtagagggggatgcaggtaaggttatttgcaaggaagcagaaaggttgaagccagcagcagtggttatgggaacccgtggccgaagcttaatacaaagtgttcttcagggaagtgtgagcgagtattgcttccacaattgtaaatctgctcctgtcataatcgttcctgggaaagaagctggagatgaatcactgatatagtggaatcggcaaacgtggaaaactaatactcatcagatttgtctgttaaaaattaatagtcatcagatttgtttgtttgtgtgtgatggtcctgtataattttaccatacaatttgttgcgtgtaatttattgtttcttatctgatttgcttgattagctgaaatcctaatgtatatgaatgacttgattcgaaatgaacttgatgcatgcaatattatcttctatgattgcgggattttggtcatcctaaaagaaagcatgaaagtgtgaagcagaagtgctatatatacaagcaaagaggcagttcataactgtagatgtgatcctttcagaatccacaagacgagcatgattttttccatgggttgccaatttgttgatgcaacggagttgcggtcttaacaaatcaatggctgcaaagcagctgcttcgctgcaatgtctgtgattagtccaaatttttatctttattgaactagatgtctttgaatgctagaaaatggggcagtgaaagttcagataaatgtgtgattgtttcaaggaggtaaattggaatagactgatctttccttgcatttatccatccatatcaacctcctttaccccacctgttcctgggctatgttgacaccccaaatttttggtcccctcctccatcccatcaacctttcattgtaattggaatcgattttgttgtgattataaacataaaatttgaac

SEQ ID NO: 1150 - DNA, 947 bp, Linum usitatissimum
gcaggaagaagaagagtacaactggaaggaagtaaagttgccatctttgatccctaaagttccagaaccagagttggagagagagaaaggggaaaggaggagaggcagagatattatcatagcgattgatcatggacccaacagcaagcatgcctttgattgggctctcatccatttctccaggcttgccgataccctccatcttgttcatgccgtctcaagtgtgaagaatgatattgtggatgagatgacgcaagcccttatggagaagctcgctgttgaggcttttcaggtttctatggtgaaaagtgtggctaggatagtgcaaggagatgcaggcaaagtaatttgcaaggaagctgaaaggattaagcctgcagctgttgtgatgggcactagaggcagaagcttagttcagagtgtgctgcaaggaagtgtgagtgagtactgttttcaccactgcaaagctgcacctgtcatcattgttccagggacagaagctggagatgaatctatggtatcatggaactagtgaaatgtcgtgcgtatgctgatggtgattggagggcctgtgcgtggatgttgtgtgtttttatcgagattgttccgtaagctttcattggttgaccagaagcttgacgcagattgatgttatctcttgaatgtagaaaccgaaagaatgatgtgttgttgcttttgctagtgagaggttctgatgcctctgctgtttgtaatgtaatgatatgtgaacaattttttgtcttgttgtccataaacaaactgatcactaggtaaaactcagtagctccaaattagccaaaaacatgtaatttgaaggacaccaacatccaacttttatctcctccaaatagctaaaaacagaggctgaatgtgtgatatttgatgtttccagaacaaaacatttgaaactggaaaagattgcgtgg

SEQ ID NO: 1151 - DNA, 1232 bp, Gossypium hirsutum
gcggccgcgtcgacaattgaaacacgtaattcatgcgcctgtctatggcggctacaattcaaaagttcggtctcgtatttcaattcatcatcttccaacaacgaaactctagcaaatcaaacaaaatcctggaaaacccgatttcagaaacgaaaacaagatttctattttctttcattttgggaattaatcaacgaaatggagacggtgatggaagatgaagagtacaattacagagaagtaattttgccttcgctgatcccagtagtcccagagccagcactagagagggaaacaggggagagaaggagaggccgagatatactcattgctattgatcacggtcccaagagcaaacacgcctttgattgggctcttattcacttcctcaggcttgctgataccatccatcttgtccatgctgtttccagtgtcagaaacgatgtggtttatgaaactagtcaagctcttatggagaagttagcggtcgaggcttttgaggttaccatggtgaggactaaagctcgaatagtcgaaggggatgccggtaaggtaatttgcaaggaagcagagaggttgaagccagcagcagtggttatgggaactcgtggtagaagcttaattcaaagtgtatttcaaggaagtgtaagcgagtattgcttccacaactgcaaatccgcacccgtaataatcgtacctgggaaagaagctggagatgaatcactgatatagtggcaaaggcaatggttaacttgagaaaccattagtcatggaatcaatttgtttgcttgtagcactgtatgtaaagatagattgcttggttgtttatctgaatgtttgcatgttatggctgtgttgcttcagagcctcttatctagtgttaccatacgatatattgtgtgtaattttatcggtatttggtatttcgatttttatttcccgaatttatgcatccgaagttgtcatcaagaattaccaaccgactgaaccggacttcaaaaggtaccttagctttcacagcaaattcatatttctacaatggcaatctaagactaaagttgccttgactatctgatggtaatctttgcctagtctaaaatttcaactttgcaatatatattcattgaatttggccctatatctgcattgtaacaaaaaaagaagcagctattttctaaaaatctaagcagattcagtgatattaaagaaaacatcactttcaaaaaagcttc

SEQ ID NO: 1152 - DNA, 1294 bp, Gossypium hirsutum
gggtggtaccaagctacttttcttactggaaaacctgcctaatctatgactagtcacacgacacggtttcaaaattgaaacacgtaattcatgcgcccgtctatggcggctacaattcaaaagttcgatctcatatttcaactcatcttcttccaacaacgaaactctagcaaatcaaacaaaatcctggaaaacccgaattcagaaacgaaaacaagatttctattttctttcattttgggaattaatcaagaaaatggagacggtgatggaagatgaagagtacaattacagagaagtaaatttgccttcgctgatcccagtagtcccagagccagcactagagagggaaacaggggagagaaggagaggccgagatatactcattgctattgatcacggtcccaagagcaaacacgcctttgattgggctcttattcacttcctcaggcttgctgataccatccatcttgtccatgctgtttccagtgtcagaaacgatgtggtttatgaaactagtcaagctcttatggagaagttagctgtcgaggcttttgaggttgccatggtgaggactcaagctcgaatagttgaaggggatgccggtaaggtaatttgcaaggaagcagagaggttgaagccagcagcagtggttatgggaactcgtggtagaagcttaattcaaagtgtatttcaaggaagtgtaagcgagtattgcttccacaactgcaaatccgcacctgtcataatcgtacctgggaaagaagctggagatgaatcactgatatagtggcaaaggcaatggttaacttgagaaaccattagtcatggaatcgatttgtttgcttgtagcactgtatgtaaatatagattgcttggttgtttatttgaatgtttgcatgttatggctgtgttgcttcagaacctcttatctagtgttaccatacgatatattgtgtgtaattttatcggtatttggtatttcaatttttatttcccgaatttatgcatccgaagttgtcatcaagaattactgaccgactgaaccggacttcaaaaggtaccttagctttcacagcaaattcatatttctacaatggcaatctaagactaaagttgccttgactatctgatggtaatctttgcctagtctaaaatttcaactttgcaatatatattcattgaatttggccctatatctgcattgtaacaaaaaaaaagaagcagctattttctaaaaaatctaagcagattcagtgatattaaagaaaacatcactttcaaaaaaagcttc

SEQ ID NO: 1153 - DNA, 1300 bp, Gossypium raimondii
ggggtggtaccaagctacttttcttactggaaaacctgcctaatctatgactagtcacacgacacggtttcaaaattgaaacacgtaattcatgcgcccgtctatggcggctacaattcaaaagttcgatctcatatttcaactcatcttcttccaacaacgaaactctagcaaatcaaacaaaatcctggaaaacccaaattcagaaacgaaaacaagatttctattttctttcattttgggaattaatcaagaaaatggagacggtgatggaagatgaagagtacaattacagagaagtaaatttgccttcgctgatcccagtagtcccagagccagcactagagagggaaacaggggagagaaggagaggccgagatatactcattgctattgatcacggtcccaagagcaaacacgcctttgattgggctcttattcacttcctcaggcttgctgataccatccatcttgtccatgctgtttccagtgtcagaaacgatgtggtttatgaaactagtcaagctcttatggagaagttagctgtcgaggcttttgaggttgccatggtgaggactcaagctcgaatagttgaaggggatgccggtaaggtaatttgcaaggaagcagagaggttgaagccagcagcagtggttatgggaactcgtggtagaagcttaattcaaagtgtatttcaaggaagtgtaagcgagtattgcttccacaactgcaaatccgcacccgtcataatcgtacctgggaaagaagctggagatgaatcactgatatagtggcaaaggcaatggttaacttgagaaaccattagtcatggaatcgatttgtttgcttgtagcactgtatgtaaatatagattgcttggttgtttatttgaatgtttgcatgttatggctgtgttgcttcagaacctcttatctagtgttaccatacgatatattgtgtgtaattttatcggtatttggtatttcaatttttatttcccgaatttatgcatccgaagttgtcgttgagaattaccgaccgcctgaaccggacttaaacagctaacttagctttcacagcaaattcatatttctacaatggcaatctaagactaaagttgccttgactgtatctgatatttatctttgcctagtctaaactttcaactttgcaatatacattcattcaattaggccctatatctgcattgttacaaaaaacagaagaagaagctattttctaaaaatctaagcagattcagtgatattaaagaaaacatcactttcaaaaaagcttcaat

SEQ ID NO: 1154 - DNA, 1124 bp, Tropaeolum majus
gaagtttataatatatttaagaatttgttgctaccaaaaatataatattaaattaaatttaaaaaaaaactaccatcgaaaccgaaccgaaccaacatcaacatgcctaacgactgcaacatttatctggaaacataaaaagaagcttaggaaagtcataaagcagcctgtaatcccacgcgttatcaattccaacacgtcatttctcttcttttccggcggctgatgaccaaaactcagacacaaaaccaaccccaataagaaccctagaaatcatttctgatttttctagactttatttgaaattaggcaacaagaaacaaaatagagagaaaaaaatgtctttacgaatggaaaccgtgatggaggatgaagagtacaactacagagaagtaattctaccaaccttgatcccaatagtacctgaaccaggtctagagagagaaaacggtgaaagaagaagagggagagatatagttatagccattgaccatggacctaacagcaaacacgcatttgattgggctcttattcatctctgcaggcttgctgacaccattcatcttgttcatgctgtttccagtgttcagaatgatcttgtgtatgagatgagtcaatccctcatggaaaagctcagcgtggaggctcttcaggttgccatggtgaagtgtgtcgctcgtattgtggaaggggatgctggtaaggtaatatgcaaggaagcagaaaggttaaggccagcagctgtagtcatggggactcgaggcagaaccttaatacagagtgtcttgcaaggaagtgtaagcgagcactgtttccataactgtaaatctgcacccgttataatcgttcctggaaaagaagctggagatgtttcgatgatataaagtaaaacctgcaccagatctacctcatagtatttgcatagcggttttaggtagattttttgtattgttttgtatgtttttcggctatgggttgagtgtgcgtattcttattcagtattatttgtatcatcctggtaaagtcactttgttacttattcgagaccctcttattatagtttttcatccgaaattgttgaaccagttaccgattgatagatactatctctatttggttcgaac

SEQ ID NO: 1155 - DNA, 756 bp, Phaseolus coccineus
  misc_feature (721)..(721): n is a, c, g, or t
aagcagtgattcaacgcagagggcccattctggccgggggagaatggagacagtaatggaagatgaagaattcaactgcagagaagtgaaacttccgtctatgattccagtggccgcggagccggagctgcagagggaaacaggggaaagaagaagaggaagggacataatcatagccatagatcatggccccgacagcaaacacgcttttgattgggctctcattcacttttgtcagactcgctgatactatccatctcgttcacgccgtttccgatttgaagaaccaaattgtttatgacacaagccaggagctgatggagaaattggctgttgaggcttttcaagtaacaatggtgaaaacagtagccaggcttgtggaaggggatccaggaaaagtagtttgccaggaagcagagaggatcaaacctgcagctgtaattttggggaccagaggcagaggcttgattcaaagtgtgctacagggaagtgttggggcgtactgcttgcaccactgtaaagcagcacctattgtgattgttcctggaaaagatgttggagacgagtcagtaatctagttactagtggaattgagttgtaaaagactgtgttaggtatatcgcctttcgttttaccctgtatcttaacatcaaatacctgtgtggagattgtttctaattcatcagatcaagaaaaaaaaaagcatcgaatgctgtgattnttcttgtgattctacatattgttttctggaaagta

SEQ ID NO: 1156 - DNA, 2364 bp, Ricinus communis
tgagaaaatgaagtaaagttagagattttatttttcacattattaacaatcggacgtgaaatcttacagcaaagaattaccaaaagtagtataagattggaaatagcctaaaaacgaatgtctggtgtcttcttgtaaacgggcttgaagcttacgcttaattcagcccataggcttacaaagaaaaggaaatattggaccaccagaggtactccagtcagaaatgaaggtcctgttatatcatcaaatttacaggcggacggacggtgccatacccaattctcttaacttaccaatttgaaccgcaacagccattagcaacataaattcctctttaattatactcttcctatgtaaccagctccttccaccaatttctgtcaagttacagcatctcatgggaaggcaagcagtattgagttctaaacatcgctgatcggaccaaagctagcaaccatccttgcaccttacaatatcaaaaacccacaacctaaacaaaagggtactcgtttaataaaactaaacccataacaccatatccaccaaaaacacacaagaaagagaaagcgccattgtgtaagcttttacccaccaaacattatttctaccagtagactcaaagtcgaagtatagaaaatgataggcgggaagcttcgagagaaagagaaaaatagacaacccaccgaacaccttttgttattatatatcaagatttttacatgtcaaagtccttgtactaggactacgactcggaatagatgactcagttacaagcttcgcttcctatgggcttatggaaaaagaaaaaaagaagaagaaagtaacggagatccatggtcataacgtgcgaaaggcatgtctttcttttgtatttttcattgaactttgtaattttcctagttttttaatctaatattaacacatgtcaaacaagccactttcggcggctgacagaattgtccttgatcaatttaccttcaacaaaaccagggtaaaacgaaaaccataatcaccaatagacaaaaaaaaaaaaaaaggatctttggaaatatagcacaaaaacaaggagtggagtacaattggaaacaaaaaaaacaaagtaggaaacaaaaatggaggtacttaatgaggaggaagagtacgattggaaagaagtgaatctgccatcattgatcccaatagttccagaaccagagcttgaaagggagagtggagaaaggagaagaggcagagatatacttatagctatcgatcatggacccaacagcaagcatgcctttgattgggctatgattcatctttgcagattagctgatactatccatcttgtccatgctgtttccagtgtcaagaatgatattgtgtatgagatggctcaaggtcttatggagaagcttgctgtggaggcttttcaagttgccatggtgaagagtgtggctcgaatcgtgcaaggggatgcaggtaaagttatttgcaaagaagcagaaagtttaaggccagcggctgtggttatgggcactagaggcagaggcttagtgcaaagtgtactgcaaggaagtgtgagcgagtattgcttccaccactgtaaagcagcacctgttataattgttcctgggaaagaagctggtgaggaatcattggtacagtggaagtaatagcattatcataaagcaagagaaatggttgaactatctataagtttgacatctagggttgtgaaatttgtgatgttattgtagtttcttggttggatagaatgcaaggtcttccaagaagaaaatttatttttataacagagtgagagattggaatatgtaacttaacactttagtagaacactttagatttgtcgatttgttcattatcatggttctggatgcatggatttgatacataatatattgatagaaaccataagtagatcacagggaatgtctgatgcagcttgtcaagatgctgctaacttaccggctacttaagtcctgtcagcagcattagtcaagattggttgttcttagtttgcacaatatttggatcttgaagagcattcgtcaaactgtaatgcattaacaaaaggcagtctctgctacttgccagggattttgcaacaaccacttttaaaatttcatgacatgtatttttctccaatacatggaatttgagacttatcctgcatatgttggggtgactggatgtggggatacatagtagtctcactcagaaagagcttcatgaaagctcttctttgcttaggaaagtataatttagttctgccaaatggtatgacacaagaaagaaaatgaattataagtgggcagtgggattccttgtccacatgagtcccagaaagcatatttgtggccg

SEQ ID NO: 1157 - DNA, 1309 bp, Gossypium hirsutum
atgggggggtggtaccaagctacttttcttactggaaaacctgcctaatctatgactagtcacacgacacggtttcaaaattgaaacacgtaattcatgcgcccgtctatggcggctacaattcaaaagttcgatctcatatttcaactcatcttcttccaacaacgaaactctagcaaatcaaacaaaatcctggaaaacccgaattcagaaacgaaaacaagatttctattttctttcattttgggaattaatcaagaaaatggagacggtgatggaagatgaagagtacaattacagagaagtaaatttgccttcgctgatcccagtagtcccagagccagcactagagagggaaacaggggagagaaggagaggccgagatatactcattgctattgatcacggtcccaagagcaaacacgcctttgattgggctcttattcacttcctcaggcttgctgataccatccatcttgtccatgctgtttccagtgtcagaaacgatgtggtttatgaaactagtcaagctcttatggagaagttagctgtcgaggcttttgaggttgccatggtgaggactcaagctcgaatagttgaaggggatgccggtaaggtaatttgcaaggaagcagagaggttgaagccagcagcagtggttatgggaactcgtggtagaagcttaattcaaagtgtatttcaaggaagtgtaagcgagtattgcttccacaactgcaaatccgcacccgtcataatcgtacctgggaaagaagctggagatgaatcactgatatagtggcaaaggcaatggttaacttgagaaaccattagtcatggaatcgatttgtttgcttgtagcactgtatgtaaatatagattgcttggttgtttatttgaatgtttgcatgttatggctgtgttgcttcagaacctcttatctagtgttaccatacgatatattgtgtgtaattttatcggtatttggtatttcgatttttatttcccgaatttatgcatccgaagttgtcatcaagaattactgaccgactgaaccggacttcaaaaggtaccttagctttcacagcaaattcatatttctacaatggcaatctaagactaaagttgccttgactatctgatggtaatctttgcctagtctaaaatttcaactttgcaatatatattcattgaatttggccctatatctgcattgtaacaaaaaaagaagcagctattttctaaaaatctaagcagattcagtgatattaaagaaaacatcactttcaaaaaagcttcaatacctgcgcgg

SEQ ID NO: 1158 - DNA, 746 bp, Manihot esculenta
aaccaagaagaagaaatggaggtcctcaatgaagaagaagagtacaattggagagaagtccatcttccatcgttaatcccagtggttccacaaccagagctcgagagagagacaggagagcggaggagaggcagagacatcctcatagccattgatcatggacccaacagcaaacacgccttcgattgggccttgatccatctctgcaggctcgctgatactatccatcttgtccatgctgtttccagcgtgaaaaatgatattgtctatgagatggctcaagggcttatggagaagcttgctgtggaggctttccaggttgttatggtgaagagtgtggctcggattgtagaaggtgatccaggtaaagttatttgtaaagaagcagagagattgaggcctgcagctgtggtgatgggtaccagaggcagaggcttagttcaaagtgtgcttcagggaagtgtgagtgagtactgcttccaccattgcaaagcagcacctgttgtaattgttccagggaaagaagcaggggatgaatcactgatacaatggaagtagtcttattattttggcaattcattgagattgtaaaacttgtgtgttgatcattgaaaattatataaggattcaggaaggatgaggttgtgaaatttgtatgacaaagtttagctacatgtaaccaagaatgtctattatttgtagggtttgtgagaaaaacttttctatttatttttgccaatttcttc

SEQ ID NO: 1159 - DNA, 861 bp, Phaseolus coccineus
aagaaaaagatattaaagaaaatgtataggcagagaaaatgaagggaagtagttgagaatggagacagtaatggaagatgaagaattcaactgcagagaagtgaaacttccgtctatgattccagtggccattacggccggggctgcagagggaaacaggggaaagaagaagaggaagggacataatcatagccatagatcatggccccgacagcaaacacgcttttgattgggctctcattcacttttgcagactcgctgatactatccatctcgttcacgccgtttccgatttgaagaaccaaattgtttatgacacaagccaggagctgatggagaaattggctgttgaggcttttcaagtaacaatggtgaaaacagtagccaggcttgtggaaggggatccaggaaaagtagtttgccaggaagcagagaggatcaaacctgcagctgtaattttggggaccagaggcagaagcttgattcaaagtgtgctacagggaagtgttggggcgtactgcttgcaccactgtaaagcagcacctattgtgattgttcctggaaaagatgttggagacgagtcagtaatctagttactagtggaattgagttgtaaaagactgtgttaggtatatcgcctttcgttttaccctgtatcttaacatcaaatgcctgtgtggagattgtttctaattcatcagatcaagaaaaaaaaaagcatcgaatgctgtgatttttcttgtgattctacatattgttttctggaaagtagccattgactcgttgcttatgttcccatatttgaaaacctctctacctataaatttgaatgtaaataaagaacttattgctagttgttta

SEQ ID NO: 1160 - DNA, 959 bp, Populus trichocarpa
tcaaaatctaccagcttttgcttttagaaaccgaaccagataaagatacagagaaaacaccacaaaatatacagagaaagaaaacgatggagatactgcaagaagatgaagagtacaactggagagaagtaaagttgccttcattgattccagtaatacccgaaccagggctagaaagggagacgggggagagaaggagaggcagagacatacttatagctattgatcatggacctaatagcaagcacgcttttgactgggctttgattcacctttgcagactagctgacaccctccatcttgtccatgctgtttcgagtgtgcagaatactgttgtttatgagacaagccagcagctcatggagaagcttgccgtagaggctttgcaggttgccatggttaggactgtggctcggattgtgcaaggggatgctggaaaggtaatttgcaatgaagcagaaaggttaaagcctgcagctgtagtgatgagtaccagaggcagaagcctagttcaaagtgtacttcagggtagtgtgagtgaatattgcttccaccattgtaaagcagcacctgttataatcgttcctgggaaagaagatggagatgaatcattgatatagcggattcagcacttgaaggtcacggattttgttcgattgattgagcaggatagtaaggttttgaagaagttgattgtcaatatgtaacaagtcatgtatggtggtaattatttgtggtgtttaatatgtagtaaggatgtgtattatatgtataattactacacatttgaatgattattgttgaagttagctatagcgttcactcttcttatttctttgattcgatgcataacagagcagaaatcagagggctgctccattctgctaattttgtagaatttttctgtttctgcctgatggaagcagttgaatgtctaatgtaaaatttcaaggttgctc

SEQ ID NO: 1161 - DNA, 893 bp, Solanum lycopersicum
ggtggctggtgtccgtgtctctcatacttttaaacgtgatcgctttatcctactatttatatgtaaatcgtatacgaattggaaaatactcggattatccaaaacgcaaatctcacacaattttgcaaaatccaaaaaaaattaaccaaaaagaaggcaatggaaacggttatggaagacgaagagtacaattggagcgaagtgaagcttcattctctcatacccatagtgccggagccggagctcgatagggaaaccggcgaacggcgtcgcggccgtgatatagtgatcgctatagatcacggtcctaatagcaaacacgcttttgattgggccgttactcacctttgccgtctcgccgatacgcttcatctcgttcacgccgtctccagtctgaaaaatgagatagtttatgaggctacgcaaggactcatggagaagcttgctgttgaggctttttcggttgctatggtgaagacagtggctaggattgtggaaggagatgctggaaaggtaatttgcaaggaagcagaaaggttgaagccttcagctgtggttatgggaaccaggggacgtggcataattcaaagtgtactgcaaggaagtgtcgctgagtattgcttacacaactgtaagatagcaccggtcatcatagttcctggaaaagaagctggggaagtctctgtgatttaatcgagctttcaaagtttgaggaacttactctgaattgatgtccatccaagtaatgctgattggtatgatataatggcagcagctgtattactagtggcaggttcttcctttataatgtccgtgcttatataaaaagcttatgctatcattgatgtaaagtatttttatctggttttaaattgtgcttattttatgtcttc

SEQ ID NO: 1162 - DNA, 1024 bp, Trigonella foenum-graecum
cggccggggggttatataccattttgctttgtttcaactttcaactcactctttgattgtgatctttgtgaaacaatcataacatcactctgcaaaacactctcttgtagtaataggattgtgctgaagttattgtatttggctgagaagatctgatggcattggtaacgggaagaagttcagctctgaatccaaatgcacctctcttcgtacctgctgcatttcgtcaggttgaggatttttcacctcaatggtgggagcttgtgaaatcttcgacatggtttcataactattggttgagccagcataaggaggaagattttgtagaaagtagcggaaatgatactacaaatgatgatgatatagaaaatatgctgtcggaaacttttgatcttggcattgaagaagatttcaatcttctagagaatgagtttgagaagttggtgatgtccgacgaagctcaagagtgtccagttatggatgatcctgttgaggaaaaaaaacctcttaatggtgttaacaaagatgctgcagctcttatcaagatattgtcaccaaaggaaaggggtgtcaagtcccctattgggtctccaaagctctttgagaagccagcacaacatgttaacctcaaatgtgcacctcaaagaatccaccaacctcgttaggagaaactttgaatctcagtgataacttgcttgaactgcaagtttcttctgactagagtatgcaatctctgttgaaataacttgtgtacatagaagaaggtgtagtgtctttgtatttttcatgttggttgtcatgtagtgtatttaatggtaggtgagactttcaagtatgaatggctcaaatcttggaatgtttatggtttgatcaaactttatttcatctcattttgaaataaatggttaatgttaggttacatggcataagatagactatggatttaagttttaggtgtgtcttgttcagtgtggcaattggattgaacttttcatgtcttgtaattttatatttgaaagaaaat

SEQ ID NO: 1163 - DNA, 894 bp, Cicer arietinum
gtggtatcaacgcagagtacgcggggaaatatagcattttcatttggttttttcctactcactctctcactcactttgatttttgtgacaacattttcaacacaactgtgcaaaagactcactgatactagttattgtgtttagttgacaagttctgatggcattggtatctaaaagaagttcatctctgaatccaaatgcacctctcttcgtacctgctgctcttcgtcaggtggaggatttttcacctcaatggtgggagcttgtgaaatcttcgacatggtttcgtgattactggttgagccagcacgaggaggaggattttggagaaagtggtggtaatgatactgcaaatgatgatatggagaatacgctgtctgaaacttttgatctaggcattgaagaagaagacttcaattttcttgagaatgagtttgagaagttggtgatgtcgaacgaagctcaagagcatccggttatggatgatcctgttgatgaaagaaagcctcttcatgaaggtgttaacaaggatgcttcagctcttctcaagatcttgtccccaaatgaaaggggtgtcaagtcccctattggttcaaagcagtttgagaagccagcacaatatgttaacctcaagtgtgctcctcaaagaatccaccaacctcgttgagagaaacttaaaagctcatagtaatgatagcttgcttggactgcaagttactgactagagtatgcaaatttctgttgaaataacttgtgtatatagaagatgcagtagtgtctttgtatttttcttgttgatttgtcatgtatatttaatggtaggtgatgagactttaaatttggaatgtttatggttggttaactttatttcatatcattttgaattaaatgata

SEQ ID NO: 1164 - DNA, 737 bp, Medicago truncatula
aaaccaaaagacaaacaactagttctcattttcagtcactgagctaagcaaaaatggaaggcattgtaaaatctctctaccttccaaaaattccaaagtctcaaacatgttctggttctcttctgaattcaccacttttattacactccaatgccacttcagtaactttcaattcagcaacacatcatttgcacaagtgctttctttttcagcaaccaggtggtgttatacatcccaaagcacaggaaaaggtgaacctaggagctatacatgcatcaaaagctacaactccaacaacaactactacacaaagatggattcttgaaccagttggagatggtgattcaaggcatataggcttcaaggttgagaggccaggtgcatatgaaattacttctaatgaagtcactgtaggacgtgttccagagaaagctgatttagtgatcccggttgcaacagtgtcaggtgtgcatgcacgcattcggataaaacaagacaatcttcttgttatagatttggatagcaccaatggaacattcattggtgacaaaaggctgaaacctggagtagttaccactgtatcttctgggagttatattacttttggggacactaatttggctatgttccgtgtgtcgaaaatagaagagaaggctgcagatacagttggagaaccagaaggtgaattagagaatgatggcaaatctgatagtactgaaacaagttacaacttctag

SEQ ID NO: 1165 - DNA, 1200 bp, Trigonella foenum-graecum
ccgcattcatttttctctctcgctttcccttctcttagttaactaacttaaagttgtaaagtcaaaatggaaaacgggcataacttccaggaagtttccaagccaaaatatgattgtctattgtttgatattgatgacacactttatccattgagttctggaatttcagcgcgaacagcaaagaatattgaagagtatatgcttcaaaagcttggaatggaggctgctacggttcccgagttgtgctatacattgtacaagacttatgggacaacaatggctggtcttaaggcaattggctatgactttgactacaatgactttcatagttctgttcatggaagattgccatataatctgctgaaaccggaccctgttctcaagggcattttgcaaagcttgccttacaggaaagtgctttttaccaatgcagacacgggacatgcgattagagtgcttaaaagacttggactggaggactgctttgaaagaattattagctttgataccctgaattccactgacagcatcaaccctcctaatgacaaagatggcagtgaaatatttgatttctgtgagtacacacgccgacctgattctgatacggtgcttccaaagacaccagttatctgcaaaccctttgaagatgcatttgaaaaggctttcaagttagctgacattgaccctcaaagaacattgttcttcgatgacagtctccgcaatttacagacagctaaacgtctgggcctccatacagttgcggtgggtacatccgtgcgcagtacaggagtggatcatgcattagagagtatccataatatcagagaggcatttccagagctatgggaagtcgacgagaagcatgaaatcgtcaactacaaggttgcaattgaaacaacagtaaaagcatagctctgaagtttatccaacatgatttgtttgtggtgtcttaagtatattagtacttatgtaattgttattaaatttatatgtgaattgatattcatagtttggaatttgaaaacaatgtgatttatcaccccaactgtatctcttatactatgcaattccttaaggcattcagcttctaggggtgttgttttggtgttcttagagcaaggtttcttgtctgatcttgtattctcttacagattaactatcttttgcatctatatatcaataaagtgtcaattgaaacac

SEQ ID NO: 1166 - DNA, 1282 bp, Cicer arietinum
aagtattttgtaatattctacgatgttttcaagactcaacccaattgaaacgtcgtcgcttttgagagttaagagtagacaacgcttcttttattccgttcaaacgctgttctatttaaactctcattctccatatattctctacactctccattttccgttaacttctatctttttgtatttcatttctggatctgcatccattgtagtccttcaaattttgcagagttaaagtagtgagtgaagtcacaatggaaaacggccataagttccaggaagtttccaagcctaaatatgattgtctattgtttgatgttgatgataccctttatcctctgagttctggaatatcagcgaatacagcaaaaaatattgaagagtatatgcttcaaaagcttggaatggaggctgctacagttcctgaattgtgctattcattatacaagacttatgggacaacaatggctggtcttagggcaattggctatgactttaactacaatgacttccatagttttgttcatgggagattgccatataatttactgaaaccggaccccattctcaggggcattttgctaagtctgcctattaggaaagtggtttttaccaatgcggacacggggcatgcaattagggtgcttcaaaggcttggactggaggactgttttgaaagaataataagctttgatactctgaattccgttgacaatcctcctaatgacaaagatggcagtgcaattttcgatttctgtaagtacacacgccagcctgattctgatatggtgcttccaaagacacctgttgtatgcaaaccctttgaagatgcatttgaaaaggctttcaagttggctgacattgaccctcaaagaacattgtctttgatgacagtctccgcaatttactgacagctaaacgtttaggcctccatacagttgcggtgggtacatctgtgcgtagtacaggtgtggatcatgcattagcgagtatccataatatcagagaggcatttccagagctatgggaagccgatgagaagcatgaagttgtgaactataaggttgcaattgaaacatcagtagaagcatagctcaaaagtttacctactatgatttgtttgtggtgtctttagtatgttgccacctatgtaattgttattacttattacatttgaaaatgaatctttttattcatagttcgatctacgacaccttgaaaacaatagcgatttgcacctatctatctcttctattatgttaataactagattaaacaatgcgta

SEQ ID NO: 1167 - DNA, 1520 bp, Cicer arietinum
tttaattcatttgtgttgtgttgagaattgtgttagggactaatgggtaattgtcttgattcttctgctaaagttgatgcagctcaaagttctagatccacttctagagcctcaaaaactactccttctagtttaactattccatcatacagtgacaaaagcaatgccttaagtcttcccacaccaagatctgagggtgaaatcttgtcttctcccaatcttaaagcattcacattcaatgagctgaagaatgccacaaggaattttcgtcccgacagtcttctaggtgaaggtggatttggtcatgtttacaagggatggattgatgaacacacttatacagctgcaaaacctggatcaggaatggttgttgctgttaaaaggcttaagcctgaaggttttcaaggtcacaaggagtggttgactgaggttaactaccttggacaacttcaccatcctaatctggtcaaattaattggttactgcttggaaggagacaacaggctattggtatatgagtttatgcccaaagggagcttagagaaccatctttttagaagaggaccacaaccactgtcttggtcaataagaatgaaagtggcaattggtgctgcaagaggactctcttttcttcacaatgccaaatcacaagtcatttaccgcgatttcaaagcttctaacatccttttagacgcggagtttaattcaaaactctctgattttggcttggcaaaggcgggtcctaccggtgatagaactcatgtttctactcaagtaatgggtactcaaggatatgcagcacctgaatatgttgcaactggtcggctgacagccaaaagtgatgtatacagctttggagttgttttgcttgaacttttgtccggaagacgcgcggtcgataaaacaatagccggtgtagaccaaaatctagtagattgggcaaaaccatatttaggcgataaacgaagactattccgaatcatggattcgaaattagaaggccaatatccacaaaaaggagcattcatggcagctacacttgctctacaatgccttaacagagaagccaaggcaagacctccaatgatagaggttttagcaacactagaacatatagaagcacctaaacacgcgagccgaaattctctatcggaacatcaacgagtccatgctccgataagaaagtctcccgcgcgaaaccgaacacctttgaatagtactcctactgcatccccattgccatctgttcgacaatcgcctcgtgcgcgttaggcgctggataatgaacattctgcatgtaaattccttatttttacgaggttgtgtttttgacagcatgtcttgtggcatctacttgaatgcaattttggagtatcttcaataactaaatattggcgagatacatcacatattcatattataactcgatttcgtcgtgaagagttgtctatttataaacttttttcaaccgatgtctctaatcaatgtacaatttgagtttttttttcaaaaattgcttg

SEQ ID NO: 1168 - DNA, 2135 bp, Cajanus cajan
aggcgaatccaaaacgaagtgattcttttcatctctcttctgttccccaccccacaatttctctgctccttctttcttcctctttcttcacccacccaataacttcattgggaactgaaaccatcaatcaaaaccctcacttttttttttcttcttcttcttctctttcacttgaaaagtgttgtgttgggttgagaattgtggcagggcctaatgggtaactgcctagattcttctgccaaagttgatgctgctcagagctccagatccacttctggaatctcaaaaactactccttccagcttatctattccatcatcatacagtgaaaaaagcaatgcctcaagtcttcccacaccaaggtctgagggtgaaatcttgtcttctcccaatctcaaggccttcacattcaatgagctgaagaatgccaccagaaattttcgccctgatagtcttcttggtgaggggggatttggatatgtctacaagggatggattgatgaacacacattcacagcttcaaaacctggatcaggaatggttgttgctgtaaagaggcttaagcctgaaggttttcaaggtcataaggagtggttgactgaggttaactaccttggacaactgcaccatcctaatctggttaaattaattggatactgcttggagggagagaaccggcttttggtctacgagtttatgcccaaaggaagcttagagaaccatctgtttagaagaggaccacaaccactctcttggccagtaaggatgaaagtggccattggtgctgccagaggactctcctttcttcataatgccaaatcacaagtcatataccgtgatttcaaagcttctaacatcctactagatgctgagtttaatgctaaactctcggactttggtttagctaaggcgggtcctactggtgatagaactcatgtgtctactcaagtcatgggaactcaaggatatgcagcacctgaatatgtagccactggtcgcttgacagccaagagtgatgtctacagctttggagttgtgttgcttgaacttttatccggaaggcgtgccgttgataaaacaatagccggtatggagcagaatctggtggattgggcaaaaccttatctaagcgataaacgaagactcttccggatcatggactccaagttggagggccagtaccctcagaagggtgccttcatggctgccacacttgccctacaatgtctcaacagtgaggccaaggcaaggcctccaatgacagaggttttagcaactctgcaacagatagaagcccccaaaactgcaggcagacactcccattcagaacaccacagggtccaaactcctgtgagaaagtctccggcacggcctcggtcaccgttgaatgtaactcctactgcttcccctctgccggctcaccggcaatcgccccgtgtccactgagctgtgaacatacaacgtgtgtatgtaaattccttattttcatctggttgtgtttttgatagcatgcggtgaggcgtgtgtacttagatgcaattttggcatgctttgtagaatagttaacaccatttatccaaatgttatgcaagttattgcagcagtattcatcatgtgttatttacttttgatggaatgtcatgttgatactcacaggtcacaaccagacacattgcttccgtactaaatttaccaaccggtggttgattcgatgttgaaaatcgtacattaattagtaatatgttagataatataagtagagaatattcttcacaagtcgatttataaagttgagtttggtctaaactcttcagataacatgtaacttatttttcttaagtgaggttaaggtcttatgttatcaagcggtacatctctaatttttcttaaataaggtgttagatttgagtcatagtcattggtgtgaaaaagtttcagatgggaagcatagggacaagatatttaataaacctatgactgtaacatacataatgcaagaactttattaatgtgcatggactcatcatgtgaagtaaaggctaaaaagaagagcttaataaacaaaccgactagacttacaacagcatctagctaaatgggtgactaactaactgactttattacacataatgagt

SEQ ID NO: 1169 - DNA, 1823 bp, Glycine max
ttttcatctctctgttgtgttgtgttccccaccccgcattaattcctcaccgtcttctttctttcttctcatcacaaagacacaaactttcttcctcaaccacccaacccaactttttattccactcatcacttccttggaaattgcaaccataaaaaaaattgtttgtttttattccttcattcataataatactttgaaaagtgttgctttttgggttgagaattgagagttgtggcagggtctaatgggtaactgcctagattcttctgccaaagttgatgcagctcagagctccagatccacttctgcatcaggaatctcaaaaactactccttccagtttatctattccatcatacagtgaaaaaagcaatgcctcaagtcttcccacaccaaggtccgagggtgaaatcttgtcttctcccaatcttaagcccttcacattcaatgagctgaagaatgccaccagaaattttcgccccgatagtcttctcggtgaagggggatttggatatgtctacaagggatggattgatgaacacacatttacagcttcaaaacctggatcaggaatggttgttgctgtaaaaaggcttaaacctgaaggttttcaaggtcataaggagtggttgactgaggttaattacctcggacaactgtaccaccctaatctggttaaattaatcgggtactgcttggagggagagaaccggctattggtgtatgagtttatgcctaaagggagcttagagaaccatctatttagaagaggaccgcaaccactctcttggtcggtgaggatgaaagtggctattggtgctgccagaggactctcctttcttcataatgccaaatcacaagtcatataccgtgattttaaagcttctaacatcctgctggatgctgagtttaattcgaaactctctgactttggtttagctaaggcgggtcctactggtgatagaactcatgtgtctactcaagtcatgggtactcaaggatatgcagcacctgaatatgttgcaactggtcggttgacggccaaaagtgatgtctacagcttcggagttgtgttgcttgaacttctatcaggaagacgcgcagttgataaaaccataaccggaatggagcagaatctggtggactgggcaaaaccatatttgagcgataaacgaagactgttcaggattatggataccaagttggagggccagtacccacaaaagggggccttcacggctgccacacttgctctacaatgcctaaacagtgaggccaaggcaaggcctccaatgacagaggttttagcaactctggaacagatagaggcccccaagacagcaggcagaaactcccattcagaacaccatagacttcagactcctgtgagaaagtctcctgcgcgaaaccggtcaccgttaaatctaactcctactgcgtctcctctcccagctcaccggcaatcgcctcgtgtgcactaaagctgtgaacatagaacatctgtatatgtaaattccttaaatttatcaggttgtgttttggacagcatgcgttgaggcatgtgtacttaaatgcaattttgggtcatgcacggtagagtagttaacaccatttatccaaatgctatgcaagttattgcagagcagtattctgcatatatatctcctgttaccaatgtcttgttgataataacaacctgacacattgcttcccttctattatgggtgtccctttatttggttttggcctaaaacaattccaaaacatggagagagagagagggttgttgtatatacttaacatcttgtgtgcaaaatttgt

SEQ ID NO: 1170 - DNA, 1658 bp, Lotus japonicus
ctttaaactggatttcttgtcatcgttctccacttgctgaagctcacagactagttgagaacagcttcatgggtaactgtcttgattcttctgctaaagttgatgctgctcaaagctccagatccacttctgcatcaggaatctcaaaaactactccttccagcatttctatttcctcatacagtgaaaaaagcaatgcctcaagtcttcccacaccgaggtctgagggtgaaatcttgtcttctcccaatcttaaggctttcacattcaatgagctgaaaaacgccaccagaaacttccgtcccgacagtcttcttggtgaagggggatttggttatgtttataaaggatggattgatgaacactcgtttacagctgcaaaacctggttcgggaatggttgttgctgtgaagaggcttaagcctgaaggttttcaaggtcacaaggagtggttgactgaggttaactaccttggacaactctaccatcctaatctcgttaaactaattgggtactgcttggacggagagaaccggctattggtctacgagttcatgcccaaagggagcttggagaatcatctgtttagaaggggaccacaaccactctcttggtcagtgaggatgaaagtggccattggtgctgccagaggactctcgtttcttcataatgccaaatcacaagtcatataccgtgattttaaagcttctaacatccttctggatgctgagttcaatgctaaactttctgattttggcttagctaaggcgggtcctactggtgacagaactcatgtctctactcaagtcatgggtactcaaggttatgctgcccctgaatatgttgcaactggtcggctgacagccaaaagtgacgtatacagcttcggggttgtgttgcttgagcttctatctggaagacgagcagttgacaagacaatagctggtgtggaccagaatctggtggattgggcaagaccatatttgggtgacaaacgaagactcttccggattatggattccaagttggagggacagtatccacaaaaaggagccttcatggctgcaacacttgctctacaatgccttaacaatgaagccaaggcaaggcctccaatgacacaggttttggaaactctggaacagatagaagctcccaaaaatgcaggaagaaactccctagcacaacatcacaacaacagattccagactcctgtgagaaggtctccggcgagaaacaggacacctttgaatctaactcctactgcatcgccattgccatcgccattgccagctcaccgacactctcctcgtgcgcactgagctgtgaacattgaacatatctgtcatttgtatgtaaattccttgtttgttgtatcatgtttgtgcttttgacaccgtgcactgaggcatctacttaaatgcaattttgggttgtgtttcatagaatgtaatagttagaagttagaaccatgcattctctacatactagataggagcagcgttttaaattgaggttgtggttgtgatgtggaattgtagataaataagggttgatgtgattgcaattgcggtcgtgatgccattggaaggactacagttactgccgtaatttacaactctcaaagttaaccacaacaatattggttatgtagggta

SEQ ID NO: 1171 - DNA, 1694 bp, Phaseolus coccineus
tcaccaccttctacttctacttcttctctctctctctctttctatcttcttatcattctctctctctttcaaccacccaacccaacccaacccaacatcttccaataactacctctttggaaattgcgaacttcaaaacctttttttcccttcacccattctctgaaaagtgttgcgtagggttgagaattgtggcagggcctaatgggtaactgcctagattcttctgccaaagttgatgcagctcagagttccagatccacttctggaatctctaaagctacaccttccagtttatctattccatcatacagtgaaaaaagcaacgccttaagtcttcccacaccaaggtctgagggtgaaatcttgtcttctcccaatctcaagtccttcacattcaatgagctgaagaatgccaccagaaattttcggcctgatagtcttctcggtgaagggggatttgggtgcgtctacaaaggatggattgatgaacacacatttacagcttcaaagcctggatcaggaatggttgttgctgtaaagaagctcaaacctgaaggttttcaaggtcataaagagtggttgactgaggttaactaccttggacaactgtaccatcctaatttggtgaaattaattggttactgcttggagggagagaatcggctattggtctatgagtttatgccaaaagggagcttggagaaccatctgtttagaagaggaccccaaccactctcttggtcagtgaggatgaaagtggctattggtgctgctagaggactctcttttcttcataacgccaattcacaagtcatataccgtgattttaaagcctctaatatcctacttgatgcggagttcaatgctaaactttctgactttggtttagctaaggcgggtcctactggtgatagaactcacgtctctactcaagtcatgggtactcaaggatatgcagcacctgaatatgttgcaactggtaggttgacagccaaaagtgatgtctacagctttggagttgtgttgcttgaacttttatctggaagacgtgcagttgataaaacaatatctggtatggagcagaatctggtggactgggcaaagccatatttgagcgacaaacgaagactgttccggatcatggataccaagttggaggggcagtacccgcaaaagggtgccttcatggctgccacactttctctacaatgcctcaacactgaggccaagacaaggcctccaatgacagaggttttagccactctggaacagatagaagcccccaaaactacaaccagaaactctcattcttcagaacaccatagagttcacactcctgtgagaaaatctcctgcccgaaatcggtcacctctaaatctaactcctaccgcatcccctcttcatgctcaccggcaatcgcctcgtgtgcactgagatttgaacataaaacatatctgtatgtaaattccttgtttctatcaggttgtgttttggactgcatgcgttgaggcatgtgtacttacatgcaattttgtcatgctcagtagaatgaatagttaataccatttatccaaatgctatgctgcaagttattgcagctgtgttctgtatattcttctctttttatacctcctattccctcatggaatgtcttgttgataataacataaccagacacgttgcttcccttc

SEQ ID NO: 1172 - DNA, 1674 bp, Arachis hypogaea
gtgggatttgatagaaaatatattattggtctcggtaaacagaagagaagagagacgaaaaacagagagattaacagaacaaaaggaactgatctttcccagttttctgacccacaattcctctgccttttctcaaacgcaaaagttccttcttttctaccacctcactaactcggaaattgcaacttttacccataattcctttctctttttttatattagcttgcgtttctctgtgccacttgcagaaccaagttgattagtccagtgagttggctttagttggttaatattttggaggggttctaatgggtaactgtttagattcttctgcaaaagttgatgcagctcagagttctagaggcaattctgtttcagcaatctcaaaaactccaccctctaccttatcaattccatcacacagcgaaaaaagcaatacttcaactcttcccacgccaaggtccgagggtgaaatcttgtcttcgccaaatcttaaggccttcacattcaatgatctcaagaatgccacccgaaattttcgtccggacagccttctcggggaaggtggattcggctatgtttacaaaggatggatcgaccaacacacattcgtggcttccaaacccggatcaggaatggttgttgctgtaaagaagcttaagcctgaaagttttcagggtcatagggagtggctgactgaggttaactaccttggacaactgcaccatcctaatcttgttaaattgattgggtactgcttggaaggagagaaccggctattggtctatgagtttatgccgaaagggagcttagagaatcatctatttagaagaggaccacaaccactgtcttgggcagtgaggatgaaggtggccattggtgctgccagaggactcacttttcttcacaacgccaaatcacaagtcatataccgtgattttaaagcttctaacatcctgctggatgcggagttcaatgctaaactttctgatttcggcctggccaaggcaggtccaaccggtgatagaactcatgtatctacacaagtcatgggaactcaaggatacgcggcacctgaatatgtagcaactggtcggctaacggcgaaaagtgatgtatatagctttggggttgtgatgttggaactcttgtccgggagacgcgcggttgataaaacaatatccggtatggagcagaatctggtagactgggcaaaaccatatttgggcgataaaagaaggttgtttcggattatggataccaaattggagggacaatacccacagaaggcagccttcatggctgctacgcttgcccttcagtgccttaacagtgaagccaaggcaaggcctgccatgacagaggttttagcaacccttgaacagatagactcccccaaaactgcaggccgccattcccactcggaacatctgagagtccacactcccgtgaggaggtctccagcacgaaatcggtcccctttacatctgactcctgctgcatctccactgccatctcaccggcaatctcttcgagtgcactaagaacccatgtaacatgtctatgtaaattccttcttttttgtttgtcaggttatgtttttaggaaagtgcaaggatatttgttgaggcatgtatcaataacaaaatttaaaaaataagtaaattagtagtt

SEQ ID NO: 1173 - DNA, 1927 bp, Populus trichocarpa
gtaccagttggatcatttggtcatggtgcgtaatgaataattctttttttttcagagaatttggagaatatcgaatgatatcatggatacgaggagtataataaaagcaaggggggagtgccttgctgtgaattacagaggaaggaaagcggaaggaaggtcatggtggcatacacgtcattggtgaacggctcacgcttttgtactgctcgtgtctacaacacaccaagcattagcaagcgggcaccaagggacggactctttcttctctcttcttcttcctccgcagtcctcaataacaacacgtcgtcctcttttccactttccttttgttttataattttttaaggacaagaagaaggcaaggggaaatagcggttgtttgctttgctttggtttaccagatgggcaactgcttagattcttcttctgctaaagtagattccacccagagctcacataatcctggagcctcaagaatttccagcagaaccagccattcttcagttccatctagtctgaccatcccatcatacagtggaaggagcagtgaatgtcttcctacaccaaggagtgaaggtgaaatattgtcatcgccaaatttaaaagctttctcattcaatgagctaaaaaatgctaccagaaacttccgtcccgacagtcttctgggtgaaggtggctttggctatgttttcaaaggatggattgatgaacacactcttactgctgcaaagcctggatcgggaatggttgttgctgtcaagaagcttaaacctgaaggtttccaaggccacaaggagtggttgacagaagttaattatctcggccaacttcatcatccaaatctggttaaattgattggatactgcttggaaggtgagaaccggcttctggtctatgagttcatgcctaaagggagcttagagaatcatctgttcagaagaggaccacagccactttcatgggcgataagaatcaaagtggccataggtgctgccagaggactctcttttcttcatgatgcaaaatcacaagtcatataccgtgacttcaaggcatctaatattctactagatgcggaatttaatgcaaaactttctgattttggtttggccaaggcaggccctactggtgataggactcatgtgtccactcaagttatgggtactcatgggtatgcagcacctgaatacgttgctacaggtcggttgacagccaaaagtgatgtatacagcttcggggttgtattgctggaattcctgtctgggcgacgcgctgttgataaatctaaggtgggtgtggagcagaatctggtagactgggtgaaaccgtatctgggtgacaaaaggaaattattccgaattatggacaccaaattggggggacaatatcctcagaaaggagccttcatggctgctaacctggctttacagtgcctaagcactgaagctaaagtcaggcctcgaatgtcagaagtattagcaacactggagcaaattgaatccccaaaaggtgcagttaaaaacatccaattagagcatcaaacagttcagactcctgtccgacagtccccaatgagacaccatcgctctcctgtgattccaacggccagtgcctccccgctgccatcccaccaccaatctccacgattacgataagcagatagttatttgtaaaattctttttttatttgctcctgtattttgttcttgtaaaatcgaatgtgggtgtgtgcacttttggattagaaacacagatactatcacttgttgtaccgaaagagggtcgtagaaggttttacagccaggcttaaacctggctacatcttgttgttgtagcatagatgtgcgtttctcaccacagtaatccatgtcctattcaactgtaattacttagttattggttatatgagctctttgattgatgc

SEQ ID NO: 1174 - DNA, 1647 bp, Arachis hypogaea
gttacaagtgtgaacacacatagcgttattttgttttcaacaaaagagggtccacctttttgtgtgtctcagaaggaactttcgttacatgttccctgtttttgagggtctctcttcttgttgttcagcttgattatttgtttcttgttacctcaaagcaactcatcatttccctctttcttcaagcattgcagagtccgtgaagttaaacagttggcggctaatagcacagtaatgggtaactgcctagattcctcagcaaaagtggatgctgctcacagttcaaggacttccacttctgggatttcgaaagcgagtcgctcctctgcggcttcaagcttatccatcttgtcacacaatggaaccagtgattcttcatcttcatctgcatccgctcttcccacgccgcgctccgagggcgaaatcttgtcttctccgaatctcaagtccttcgcattcaacgaactgaagagcgccacaaggaactttcgtccggatagtctccttggtgagggaggatttggctatgtttataaggggtggcttgatgaacacacttttacagcttccaaaccaggatcaggaatggttgttgctgtcaagaaacttaagcctgaaggttttcaaggtcataaggagtggttgactgaagttaattacctgggacaacttcaccatcataacctggttaagctaattggctactgcgtggagggggaagatcggctgttggtgtatgagttcatgcccaaagggagcttagagaatcatctgtttagaagaggaccacagccactttcttggtcacttaggatgaaagtggccattggtgctgccagaggtctaacttttcttcacaatgccaaatcacaagtcatataccgcgattttaaagcttcgaatatcctactagatgctgagttcaatacaaaactctctgattttggcttagccaaggctggtcctactggagatagaactcatgtctctactgaagttatgggtactcgtggatatgcagcacctgaatatgtagcaacagggcggttgacagccaaaagtgatgtatatagctttggggttgtattgcttgagcttttgtctggaagacgtgctgttgatagaacaaaagccggtgtcgagcaagaccttgtagactgggcaaaaccgtatctaggtgacaaaagaagactatttaggattatggacaccaagcttgagggtcaatacccacagaaaggagcctacatggctgctactcttgctttaaaatgccttgatcgtgaagccaagttaaggccgccaatgacagaggttttagaaaccctcgagcagatagaagtccccaaaactgcagcgcgaaactctcaatcagggcagaacagagtacatgttcctccaagcccaaggaagtctcctggacagaatctgtcccccatgaatgttactcgaacttcatacccattgccgccttgccgagaatcccctcatgtacactaaaccttatgatcatctgtatataaattcctttatttatgagattgcgtttttgacaggaatataatgaggtattcatttctccaacataaaacttttgtaccaaagaataatatagaaaggaatatgaacaccatatttccattagct

SEQ ID NO: 1175 - DNA, 2013 bp, Glycine max
aaagtgtgattcttttcatctccatgttatgttgcaaccccgcattaaaccctcaccttctttctttcttccttctcatcacaaagacacaagctttcttcctcaactaccctacccaacttcttattccactcatcacttcctttgaaattgaaaccaccaaaattgtttttttttttctccttcactcgtagtaatattttgaaaagtgttgtgctttgggttgagaattgtggcagggcctaatgggtaactgcctagattcttctgccaaggttgatgcagctcagagctccaaatccacttctggttggtcttaattagatcattaccctctttcttcttcttcttcttcttttttcaaggcttgtgattgttatggccttatgggaactgggtttcagagttatgggttgatgatgacataatgttgtaaaaatcatcaggaatctcaaaaactactccttccagtttatctattccatcatacagtgaaaaaagcaatgcctcaagtcttcccacaccaaggtctgagggtgaaatcttgtcttctcccaatcttaagcccttcacattcaatgagctaaagaatgccacccgaaattttcggcccgatagtcttctcggtgaagggggatttggatatgtctacaagggatggattgatgaacacacatttacggcttcaaaacccggatcaggaatggttgttgctgtgaagaggctgaaacctgaaggttttcaaggtcacaaggagtggttgactgaggttaactaccttggacaactgtaccatcctaatctggttaaattaatcgggtactgcttggagggagagaaccggctattggtgtatgagtttatgcctaaagggagcttagagaaccatctatttagaagaggaccacaaccgctgtcttggtcggtgaggatgaaagtggctattggtgctgccagaggactctcctttcttcataacgccaaatcacaagtcatataccgtgattttaaagcttctaacatcctgctggatgctgagtttaattcgaaactttctgactttggtttagctaaggcgggtcctactggcgatagaactcatgtgtccactcaagtaatgggtactcaaggatatgcagcacctgaatatgttgcaactggtcgtttgacggccaaaagtgatgtctacagctttggagttgtgttgcttgaacttctatccggaagacgcgctgttgataaaaccataaccggcatggagcagaatctggtggactgggcaaaaccatatttgagcgataaacgaagactgttccggattatggataccaagttggagggccagtacccacaaaagggggccttcacggctgccacacttgctctacaatgccttaacagtgaggccaaggcaaggcctccaatgacagaggttttagcaactctggaacagatagaggcccccaaaactgcaggcagaaactcccattcagaacaccatagagttcagactcctgtgagaaagtctcctgcacgaaaccggtcaccgttaaatctaactcctactgcgtcccctctcccagctcaccggcaatcgcctcgtgttcactaagctgtgaacatagagcatctgcatgcatgtaaattccttaaatttatcaggttgtgttttggaccgcgtgcgttgaggcatgtgtacttgaatgcaattttgggtacttgaatgcaattttgggtcatgcacggtagaatagttaacaccacatttatccaaatgctatgcaagttattgcatcagtattctgcatgtatatttcctttttccccacgtagaatgtcttgttgataataacaaccagacacattgcttcccttctattatgggtgcctcataatttgggtttttggcctaaaacaattccaaaacatggagagggttgttatgtacttgtaagttgttctattcttgtatatattatttttatcatatcactagttaatagttaatgtgag

SEQ ID NO: 1176 - DNA, 1748 bp, Castanea mollissima
tcttcttcctctacctctctttcttcttcttttttttctcgtcttccttagctctttttcttattcaaaaccccatttttttcctcagtaatctccaccaagttagtgacaaacaaagctagctttaccaggagacttctgggtcattcattttttgcatcattttttcgcttcttccgaggattcataataatccatgatgttttgttgttaaggatagcaagcaaagattgtgtcttgtaaaaaagagagagagaaaatatcctatgggaaattgcttagattcttcagctaaagtagatacagctcagagctctcatgccacttctgggtcggcagtctcaaaattttccagcaaaaccagccgttcgtcagctccttccagcctgaccattcaaactttcagtgagacgagcaatgcttcaagtcttcctactccaaggtctgaaggtgaaatattatcatctccaaatttgaaacccttcactttcaatgagctaaagaacgccaccagaaatttccgcccggacagtcttcttggtgagggaggatttggttatgttttcaaaggatggattgatgaaaacactttttcagctgcaaagccgggatcaggaatggttgttgctgtcaaaaagcttaaatctgagggtttccaaggccacaaggagtggttgactgaagttaattatcttggtcaacttcatcatccaaatctggttaagctaattggctactgtctggagggcgagaaccggcttttggtctatgagttcatgcctaaagggagcttagagaatcatctatttagaagagggccacaaccactttcttgggcaataaggatcaaagttgccactggcgctgctagagggctctgttttcttcatgaggcaaaatcacaagtcatatatcgtgacttcaaggcttctaatattctattggatgcggagttcaattcgaaactttccgattttggtttggcaaaggcgggtcctactggcgataggactcatgtatctactcaagtcatgggcactcatggctatgctgcacctgaatatgttgctacaggtcggctcacagcaaaaagtgatgtctacagctttggagttgtgttgctagaactattatctggacgacgtgctgttgataagtcaaaagttggtattgagcagaatctggtagactgggcaaaaccctatttgggtgacaaaaggaaattgttccggattatggacacaaagttggagggtcagtacccccagaaaggagcctatacagctgccacccttgccttacagtgcctaagcactgaagctaaagtcagacctaaaatggcggaggtattagcaaccctggaacagcttgaaaaccccaaaaatgcaggcagaacctcccaatcagagcagcatacaggtgcacctgtcagaaaatcccctatgcgcccacacaattctcctcgaaatttaacacctggtgcatcaccattaccatcctatcgtcaatctcctcgagtacgttgaacaaagagcattgaatctgtaaattttttatttgcttccatattatgttgttcatatgggatgtagcatggcatatgtctcttggcacaattttgagttatattgaattaatagttaccacttgtagttaccacttgttcatatgggatgtagttggacataaatctgatttttgagttattttgagttatattgaattggtaagcttgtttgctgtgttaa

SEQ ID NO: 1177 - DNA, 1751 bp, Phaseolus coccineus
aacaaacccacataagtaaagggaaaaagtcacctttttgtttatatttcttttaagcaaacacaagtgtagtttgtgacttgagtttctggcaggggaaaatgggtaactgcataggttcttcggctaaagtagaagcagctcacagttccagaaccccttctggaatttcaaagactagtccttcatctgttccttcgaacttatctattcagtcatactgtgaagcaagtgatgtctcaaatcttcccactccaaggtccgagggtgaaattttgtcttcccctaatcttaaggcctttgcctttaatgagctaaggaatgccaccagaaactttcgtcctgacagtcttcttggggaaggaggctttggttatgtttacaaggggtggattgatgaacacacatttacagcttcaaaacctggatcaggaatggtagttgctgttaagaaactcaagcctgaagggttacaaggtcataaagagtggttgactgaagtggactaccttgggcaacttcaccatcagaatttggttaaattgattggatactgcgtggagggagagaaccggttgttggtctatgagtttatgtccaaagggagcttagagaatcatctatttagaagaggaccacagcctctatcttggtcagtgagaatgaaagtggctattggtgctgccagagggctctcttttcttcataatgcccagtctcaagtcatataccgtgattttaaagcatctaatatcctacttgacgcggatttcaatcctaagctctctgattttggcttagcaaaggctggccctacgggtgatagaactcatgtctctactcaagttatgggaactcaaggatatgcagcacctgaatatgttgcaacaggtcggctgacagctaaaagtgatgtatacagctttggtgttgtgttgcttgagctattgtctggtagacgtgccgttgacagaacaaaagctggtgtggagcagaatctagtagagtggacaaaaccatatttgggtgacaaaagaaaactatttcggattatggataccaagttgggaggccaatacccacaaaaaggagcctacatggctgccactcttgcactacaatgcctaaatcgcgaagccaaggcaaggcctccaatgacagaggttttagaaactcttgaacagattgcagcctcaaaaactgctgggagaaactcccaaacagaacaaaagagagtccatgctcctgtaagaaagtctaaagtgaaaatgggtgccctttgaaccatattcctacttcattcattgccatcccagccattatctgcttgtgtgcaacaattttgaacatctgtatatacattccttattttatcaagttggttttgacaggatatatggtgccataccttccttatttttatcaggttgcttttgacagggtatattgtgccatgtacttcaatgaaatttcaattaaatattagcgcatgatttccacatgctatagtagtccgcaaagcagtattctgcatgttcatttattgtttgattatgtctattgagatatttgtttgtaaaactgtctttgacacattgctagccaagagttacatgccgcatcagttgtttttgcatggattgaggattataggcaatcaatcattagtaatcctgtgtgaagcttgtaagaacatgttactcaaaaaaattaaagaaataaacacaagatataaggttagaagaatgcaa

SEQ ID NO: 1178 - DNA, 1421 bp, Phaseolus coccineus
  misc_feature (1393)..(1393): n is a, c, g, or t
ggaaaatgggtaactgcataggttcttcggctaaagtagaagcagctcacagttccagaaccccttctggaatttcaaagactagtccttcatctgttccttcgaacttatctattcagtcatactgtgaagcaagtgatgtctcaaatcttcccactccaaggtccgagggtgaaattttgtcttcccctaatcttaaggcctttgcctttaatgagctaaggaatgccaccagaaactttcgtcccgacagtcttcttggggaaggaggctttggttatgtttacaaggggtggattgatgaacacacatttacagcttcaaaacctggatcaggaatggtagttgctgttaagaaactcaagcctgaagggttacaaggtcataaagagtggttgactgaagtggactaccttgggcaacttcaccatcagaatttggttaaattgattggatactgcgtggagggagagaaccggttgttggtctatgagtttatgtccaaagggagcttagagaatcatctatttagaagaggaccacagcctctatcttggtcagtgagaatgaaagtggctattggtgctgccagagggctctcttttcttcataatgcccagtctcaagtcatataccgtgattttaaagcatctaatatcctacttgacgcggatttcaatcctaagctctctgattttggcttagcaaaggctggccctacgggtgatagaactcatgtctctactcaagttatgggaacccaaggatatgcagcacctgaatatgttgcaacaggtcggctgacagctaaaagtgatgtatacagctttggtgttgtgttgcttgagctattgtctggtagacgtgccgttgacagaacaaaagctggtgtggagcagaatctagtagagtggacaaaaccatatttgggtgacaaaagaaaactatttcggattatggataccaagttgggaggccaatacccacaaaaaggagcctacatggctgccactcttgcactacaatgcctaaatcgcgaagccaaggcaaggcctccaatgacagaggttttagaaactcttgaacagattgcagcctcaaaaactgctgggagaaactcccaaacagaacaaaagagagtccatgctcctgtaagaaagtctaaagtgaaaatgggtgccctttgaaccatattcctacttcattcattgccatcccagccattatctgcttgtgtgcaacaattttgaacatctgtatatacattccttattttatcaagttggttttgacaggatatatggtgccataccttccttatttttatcaggttgcttttgacagggtatattgtgccatgtacttcaatgaaatttcaattaaatattagcgnatgatttccacatgctatagtagtccgc

SEQ ID NO: 1179 - DNA, 2213 bp, Glycine max
ccttgtcaaccaaaatttctttcctttttcttcaagcatttcaattccaatttgcaaactgtaaagtttaaaccaaaccccacataagaaaatagaaaaaaagacattacttttttaatttctccttcttttaagcaaccataaataagtgtagtgtgttggtgtgtgactaggtttctgccagcttaggggctaatgggtaactgcctagattcttcagccaaagtagaagctgctcacagttccagaaccccttctggaatttcaaaaactagtccttcatctgttccttccaacttatctattctgtcatatagtgaagcaagtgatttctcaaatcttccaacaccaaggtctgagggcgaaatcttgtcttccccaaatcttaaggcctttaccttcaatgagctaaagaatgccaccaggaactttcgcccggacagtcttcttggtgaagggggatttggttatgtttacaaggggtggattgatgaacacacatttacagcttcaaaacctggatcaggaatggttgttgctgttaagaaactcaaacctgaagggttacaaggtcataaggagtggttgactgaagtggactaccttggacaactacaccatcagaatctggtaaaattgattggatactgtgcagatggagagaaccggttgttggtatacgagtttatgtccaaagggagcttagagaatcatctgtttagaagaggaccacaacctctttcttggtcagtgaggatgaaagtggccattggtgctgctagaggactttcttttcttcataatgccaaatcacaagtcatataccgtgattttaaagcatccaatatcctactagacgcagagttcaatgctaagctctctgattttggcttagcaaaggctgggcctacgggtgatagaactcatgtctccactcaagtcatgggaactcaaggatatgcagcacctgaatatgttgcaacaggtcggctgacggctaaaagtgatgtatacagctttggagttgtgttgcttgaactattgtccggtagacgagccgttgacagatcaaaagccggtgtagagcagaatctagtagaatgggcaaaaccatatttgggtgacaaaagaagactatttcggatcatggacaccaaattgggaggccaatacccacaaaaaggagcctatatggcggccactcttgctctaaaatgccttaatcgtgaagccaagggaaggcctccgattacagaggttttacaaactcttgaacagattgcagcctcaaaaactgcaggaagaaactcccaattagaacaaaagagagtccatgctcctgtcagaaagtctagtgtgcaaaaggggtcccatttgaatcatactcctactgcattcccataatctgcttgtgtactctgaattttgaacatctgtatatacattccttatttttataaggttggttttgacaaggagaaatgctagggaacacactcttagacatactcttttgaacacatcctctcttgttagttgaaatttattgaaaatgacaaatttttgtgagtcttacatcatgtttaatgatagtttctcttgattttgtaattttcaatcaattttaacaaattagagatagtgtgtttgaaggagtgcattatagagagagttcctactcccagcactcctctttaacaagatataatgtggcatgtacttagatgaaatttcaatcgaatattaccacattatttctgtatatactttctttatttttataggcttggtttgacaaggaaaaatgctaggaaacacactctcaaacatacttttctgaacacatcctctcttgttagttgaaatttattaaaaatgtcaaatttttcttgttagttgaaatttattaaaaatgtcaaatttttgtgggtcctacatcatgtttaatgataatttgtcttgattttatagttttcaatcaattttaacaaattagagataatgcgtttgaaggagtgcattacacatgagtgttcctactttccagcactcctctttaacaagatataatgtggcatatacttagatgaaatttcaattgaatattaccacattatttccccaagctatagaagttccacagagcagtattctgcatgttcgtttgttggttgattatggctattgagatatttgtacaactgttatggaca

SEQ ID NO: 1180 - DNA, 1711 bp, Fagus grandifolia
tgatcaaaacccattttttctcatttattttcacctaatttttcacttatcttcgcgaagttagtgacaaaccaaaactagcttcacgtaaagacttctgggtcattcaactgtctgcttcatttttcttttcttgttaagatttataataatccatgatgttttgctaagattagcaagcaaattgtcaagtgtgcttcttgtaaacagagtctctttggagaaaatatcctatgggcaactgcttagattcttcagctaaagtagatacagctcagagctcccatgccacttctggatcaggaatctcaaaattttccagcaaaaccagccgttcatcagctccttccagcctgaccattcagactttcagtgagaagagcaatgcttcaagtcttcctaatccaaggtctgaaggtgaaatattatcgtctccaaatttgaaatccttctcattcaatgagctaaagaacgccaccagaaatttccgccctgacagtcttcttggcgagggaggatttggttatgttttcaaaggatggattgatgaacattcgttttcagctgcaaagcccggatcgggaatggttgttgctgtcaaaaagcttaaatctgagggcttccaagggcacaaggagtggttgactgaagttaattatcttggtcaacttcatcatccaaatctggttaagctaattgggtactgtctggagggtgagaaccggcttttggtctatgagttcatgcctaaagggagcttagagaatcatctgtttagaagagggccacaaccactttcttgggcaataaggatcaaagtggccactggtgctgctagagggctctgttttcttcatgatgctaaatcacaagtcatatatcgtgacttcaaggcttctaatatcctattggatgcggagttcaatgctaagctttctgattttggtttggcaaaggcgggtcctactggtgataggactcatgtatctactcaagtcatgggcactcatggctatgccgcacctgaatatgttgctacaggtcggctgacagcaaaaagtgatgtctacagctttggggttgtgttgttggaactattatctggaagacgtgctgttgataagacaaaagttgttattgagcagaatctggtagactgggcaaaaccatatttgggtgataaacgaaaattgttccggattatggacacaaagttggagggccagtacccccagaaaggagcctacacggctgccacccttgctttacaatgcctaagcaatgaagctaaaggcaggcctcgaatggcagaggtattagcaacactggaacaacttgacaaccccaaaaatgcaggcagaccctcccaatcagagcagcagacagttgcacctgtcagaaaatccccaatgcgtccacaccattctcctcgaaatctaacacctggtgcatccccattgccagcctaccgccaatctcctcgagtacgttgaacaaagaaaattaaatctgtaaattttgtatttccatattatgttgttcatatgggatgtagtatggacatatatctttgcacaattttgagtcatattgaattggtattaccacttgtatatcctgaagctatgcagcttatttgttgtgttaatttgcttgtttaacaatgtcaggggtgcactgcttctttaaaaatgagaatttatgtccttgt

SEQ ID NO: 1181 - DNA, 1795 bp, Prunus persica
aaaatttcttctctgtttccatttccgcaccttcaccgctctttcttcttcgtcttcttctcccctcatattatttttattttcttaggaagtagcacaatcatataaaacccagaacaagtcagctacagtttcttcttccctctttgcaatgacttgctgattgtttaccaacaaaaccttgtgttcgtgagacgtcgtgaagagactaaaaagagagtgcctttgggctttggagtagcaaatgggaaactgcttagattcttcagctaaagtagacacagcacagagctcctttggtactttgggatcaggggtttccaaaatttccagcaaaaccagcccttcctcagcttcccccagcttgaccatcccatcatctggtgaaaggagcaatggttcaagtcttcctaccccaagaactgaaggtgaaatattgtcgtctccaaatttgaaagccttctcattcaatgagctaaagaatgccaccagaaactttcgccctgacagtcttctcggtgaaggaggatttggttacgttttcaaaggatggattaatgaacacacattgacagctgcaaaaccagggtccggaatggttgttgctgtcaagaagctcaaacctgaaggtttccaaggccacaaggagtggttgacagaagtaaattatcttggccaactgtaccatccaaatctggttaagctaatcgggtactgcttggagggtgagaaccgtcttttagtgtatgagttcatgccgaaaggaagcttagagaatcatctgtttagaagagggccgcaaccactttcatgggcaacaagaatgaaagtggccataggtgctgccaggggcctcagttttcttcatgaggccgaatcacaagtcatatatcgggactttaaggcttccaatatcttactagattcagaattcaatgcgaagctttctgattttggcttagctaaggcgggccccactggtgacaggactcatgtatctactcaagtcatgggtactcaaggctatgcagcacctgaatatgttgctacaggtagattgactgctaaaagtgatgtgtatagttttggtgttgtattactggaactattgtctggacggcgagctgtcgataaaacaaaagttggtgtcgagcagaatcttgtagactggacaaaaccatatttgggtgacagaagaaaactatttcggattatggacaccaagttggagggccaatatccccagaaagcagcctttacagctgctactcttgcttcacaatgcctatgcgcagaatctaaacttaggccaacaatgtcagtggtattagctacgctggaacaacttgaagccccaaaaactgcagccagaaactctcaatcagaacagcagacgctttctgttcctcaccggaagtcaccaatgcgacaacaccattctcctctcaatataacaccaagtgcatccccattgctatcccaccggcaatctccacgtgtgcgttgatggagagtctcctttatgtaaattacttatttgactccatattttgtttacgtagcatcaagtttgggcgtgtaatttgacacaattttgagttattccgaggttacttccacctgtaattccagaagctgtgtagctattttgtagtggtaatctgcttgatgtttgtagtgtataaagttagccatctatcagtatatataattttgccgggtgacagacattcattatcccgtcacaactgctggtgtcaaattatcttgttgccaatttaatccgttcaagtac

SEQ ID NO: 1182 - DNA, 2028 bp, Populus trichocarpa
gtctacacacagtcacgcaccaagcaagcaccacggggagggactctgtcttctcttttctaattctccctcctctcctctccaacaacacgtcctttgttttctattattaccacttccaagaactagtataatataatttcttgcttctccatcggtattctatcaaaatattatagtgatattttcttttttgtatttgtacttgaccaaacccaaaaacaaacagcctacaagtcttcgtctttatcttattatcatgtgacagggtggtttcttcttgatttctctcactaagacaccagaagaagaagaagaaggtaggattccaatagcggttgctttgctttggtttgccaaatgggaaactgcttagattcttctgctgctagagtagattctactcagagttcacatactcctggagcctcaagaatttccagcagaaccagccgttcttcagttccttctagtctgaccatcccatcatacagtgggaagagcagttctgactgttttcctacaccaaggagtgaaggtgaaatattgtcatctccaaatttaaaggccttctcgttcaatgaactaaaaagtgccaccagaaacttccgtcccgatagtcttcttggtgaaggtggctttggttgtgttttcaaaggatggattgatgaaaacacgttgactgcttcgaagcctggatcaggaatggttgtggcagtcaagaagcttaaacctgaaggtttccaaggccacaaggagtggttgacagaagttaattatcttggccaacttcatcatccaaatctggttaaattgattgggtactgcgtggaaggtgagaaccgacttctggtctatgagttcatgcctaaagggagcttggagaatcatctgttcagaagaggaccacagccactttcatgggcagtaagggtcaaagtggctataggtgctgccagagggctctcttttcttcatgatgcgaaatcacaagtcatataccgtgacttcaaggcatctaatattctactagatgcggaatttaatgcaaaactttctgattttggtctggccaaggcaggccctactggtgataggacccacgtgtccactcaagttatgggtactcatgggtatgcagcacctgaatacgttgctacaggtcggttgacagccaaaagtgatgtatacagctttggggttgtgttgcttgaattattgtctgggcgacgggctgttgataaaactaaggtgggtgtggagcagaacctggcagactgggcgaaaccatatcttggtgacaagaggaaattattccgaattatggacaccaagttggggggacaatatcctcagaagggagcctttatggctgcaaatctggctttacagtgcctaagcaatgaagctaaagtcaggcctcgaatgtcagaggtattagcaacgctggagaacattgaatccccaaaaggtgctgcaaaaaactcccgatcagagcagcaaacagttcagacacctgtccgacagtccccaatgagacatcatcacgctcctgggactccaccagccagtgcctccccactgccatcccaccaccaatctccacgattacgatgagcagtagacaatcacttgtagattccatattatttgcttttgtatttagttgtaaaatctatgatatggttgtgtatctcgatgcaattttggattagagaaacagatatgatcacttattgtaccgaaggagggtcgtgggaggttaacaagctggctcttccccttagtcatttcttgttgtagtaacatagatgaacgtttcttgtttcagtaatctttgtgctctccatctgtaattactcctcgtttctgatgaactctttgattgatgcaatctgagtagatgttttattgtcatcaaacatgtcgatccacaggagccagccgtctgtatttctctatgtttgaataaatttctctcttgtaccaaagaataaaaaataaaagtaaaatccataatgataatga

SEQ ID NO: 1183 - DNA, 2018 bp, Cajanus cajan
atccttgcaaatttaaaccatcacaaaatactaaaaactatcacttcttttttcttcttctccttcttctttttagcaataagaagtgtcctagtgtgacgagagttttggcaggggttgatgggtaactgcctagattcttcagctaaagtagaagcagctcacacttccaggaccccttctggaatttcaaaaactagtccttcatctgttccttccaacttatctattgtgtcattcagtgaagcaagtgatgcctcaaatcttcccacaccaaggtctgagggtgaaatcttgtcttccccaaatcttaaggcctttaccttcgctgagctaaggaatgccacccgaaactttcgccctgacagtcttcttggtgagggaggatttggttatgtttacaaggggtggattgatgaacacacatttacagcttcaaaaccaggatcaggaatggtcgttgcggttaaaaaacttaaacatgatggcttacaaggtcataaggagtggttgactgaagtggactaccttgggcaacttcaccatcagaatctggttaaattgattggatactgcgttgagggagagaaccggttgttggtatatgaatttatgtccaaagggagcttagagaatcatttgtttagaagaggaccacaacctctctcttgggcagtgaggatgaaagtggccataggtgctgccagaggactctgtttccttcataatgccaaatcacaagtcatataccgtgattttaaagcatctaatatcctcctggacgcagatttcaatgctaaactatctgattttggcttagcaaaggctggccctacgggtgataaaactcatgtctctactgaagtcatgggtactcaaggatatgcagcacctgaatatgttgcaacaggtcgtttgacagctaaaagtgatgtatatagctttggggttgttttgcttgaactattgtctggtagacgtgctgttgacagaaccaaagctggtgtagagcagaatctggtagagtggacaaaaccatatttgggtgacaaaagaagactatttcggattatggacaccaagttgggaggccaatacccacaaaaaggagcatacatggctgctacacttgctctaaagtgccttaatcgggaagccaaggcaaggcctccaatgacagaggttttagaaactcttgaaaagattgaggtctcaaaaactgcagggagaacctcccaattattagaacacaagagagtccatgctcctgccagaaagtcaactgtgcgaaatggtcccctttgaatcttattcctactgcattcccattgcaatctcatccacaatctgcttgtgtacactaaattttgaacatttgtatatatgttccttatttttatcaggttggttgatcttctctggatgtaatgtggtatgtgcctagatgcaatttgaattgaatatttacacattatttcaacaagctatagaaattgttcaaactcaaaagcagtattctgcatattcatttgttggttgattacagtaatgggatatttgtacaactgttatggacacattgctagccaagagttacattgaaactgtttgcatcagttgtttttacatggactgtgatcgatcataggcaatcaatcagtcattagtaatacagtatgtgaagccagtggaaaaaggttgttacttgttacacataaattattgaagaaataaacacacaacatacatataaggttagaagaatgcgagtactttttctcatccttcttttccctccatctatccttattgatgaatttatggggcactatgtaggagccatgttgaagtcactcaaatgctacactgtaatctctaactattcattcccacctttagtttcacctagttaaacacaacttgggccattgttggtctattcttttgaactgcaacagatacagcaaaatattattgtagctaattccaggcttgtattactaaaatgatgcttatta

SEQ ID NO: 1184 - DNA, 2005 bp, Cajanus cajan
aaaccatcacaaaatactaaaaactatcacttcttttttcttcttctccttcttctttttagcaataagaagtgtcctagtgtgacgagagttttggcaggggttgatgggtaactgcctagattcttcagctaaagtagaagcagctcacacttccaggaccccttctggaatttcaaaaactagtccttcatctgttccttccaacttatctattgtgtcattcagtgaagcaagtgatgcctcaaatcttcccacaccaaggtctgagggtgaaatcttgtcttccccaaatcttaaggcctttaccttcgctgagctaaggaatgccacccgaaactttcgccctgacagtcttcttggtgagggaggatttggttatgtttacaaggggtggattgatgaacacacatttacagcttcaaaaccaggatcaggaatggtcgttgcggttaaaaaacttaaacatgatggcttacaaggtcataaggagtggttgactgaagtggactaccttgggcaacttcaccatcagaatctggttaaattgattggatactgcgttgagggagagaaccggttgttggtatatgaatttatgtccaaagggagcttagagaatcatttgtttagaagaggaccacaacctctctcttgggcagtgaggatgaaagtggccataggtgctgccagaggactctgtttccttcataatgccaaatcacaagtcatataccgtgattttaaagcatctaatatcctcctggacgcagatttcaatgctaaactatctgattttggcttagcaaaggctggccctacgggtgataaaactcatgtctctactgaagtcatgggtactcaaggatatgcagcacctgaatatgttgcaacaggtcgtttgacagctaaaagtgatgtatatagctttggggttgttttgcttgaactattgtctggtagacgtgctgttgacagaaccaaagctggtgtagagcagaatctggtagagtggacaaaaccatatttgggtgacaaaagaagactatttcggattatggacaccaagttgggaggccaatacccacaaaaaggagcatacatggctgctacacttgctctaaagtgccttaatcgggaagccaaggcaaggcctccaatgacagaggttttagaaactcttgaaaagattgaggtctcaaaaactgcagggagaacctcccaattattagaacacaagagagtccatgctcctgccagaaagtcaactgtgcgaaatggtcccctttgaatcttattcctactgcattcccattgcaatctcatccacaatctgcttgtgtacactaaattttgaacatttgtatatatgttccttatttttatcaggttggttgatcttctctggatgtaatgtggtatgtgcctagatgcaatttgaattgaatatttacacattatttcaacaagctatagaaattgttcaaactcaaaagcagtattctgcatattcatttgttggttgattacagtaatgggatatttgtacaactgttatggacacattgctagccaagagttacattgaaactgtttgcatcagttgtttttacatggactgtgatcgatcataggcaatcaatcagtcattagtaatacagtatgtgaagccagtggaaaaaggttgttacttgttacacataaattattgaagaaataaacacacaacatacatataaggttagaagaatgcgagtactttttctcatccttcttttccctccatctatccttattgatgaatttatggggcactatgtaggagccatgttgaagtcactcaaatgctacactgtaatctctaactattcattcccacctttagtttcacctagttaaacacaacttgggccattgttggtctattcttttgaactgcaacagatacagcaaaaatattattgtagctaattccaggcttgtattactaaaatgatgcttatta

SEQ ID NO: 1185 - DNA, 2075 bp, Glycine max
aatcgcgcaatgtcttatgtcattcacatgtactttctcctctctttccgttccctctttttttcctttcttgtcaaccaatatttaattcctttttcttcaagcatttcaattgcaatttgcaaactttaaaccaaaacccacataagaaaatataaaaaagagcattacttttttaatttctccttcttttatgcaaccagaagtgtagtgtgttgtgtgtgactaggtttctgccagccctggggataatgggtaattgtctagattcttcagctaaagtagaagcagctcacagttccagaaccccttctggaatttcaaaaactagtccttcatctgttccttccaacttatctattctgtcatatagtgaagcaagtgatttctcaaatcttcccacaccgaggtccgagggtgaaatcttgtcttccccaaatcttaaggcctttacctttaacgagctaaagaatgccaccaggaactttcgccccgacagccttcttggtgaaggaggatttggttttgtttacaaggggtggattgatgaacacacacttacagcttcaaaacctggatcaggaatggttgttgctgttaagaaactcaagcctgaagggttacagggtcataaggagtggctgactgaagtggactaccttggacaacttcaccatcagaatctggtaaaattgattggatattgcgtggagggagagaatcggctgttggtatatgagtttatgtccaaagggagcttagagaatcatctgtttagaagaggaccacaacctctttcttggtcagtgaggatgaaagtagccattggtgctgccagaggactttcttttcttcataatgccaaatcacaagttatataccgtgattttaaagcatccaatatcctactagacgcagagttcaatgctaaactctctgattttggcttagcaaaggctggccctacgggtgatagaactcatgtctctactcaagtcatgggaactcaaggatacgcagcacctgaatatgttgcaacaggtcggctgacagctaaaagtgatgtatacagctttggggttgtgttgcttgaactattgtccggtagacgtgccgttgacagatcaaaagccggtgaagagcagaatctagtagaatgggcaaaaccatatttgggtgacaaaagaagactatttcggattatggacaccaagttgggtggccaatacccacaaaaaggagcctacatggctgccactcttgctctaaaatgccttaatcgcgaagctaaggcaaggcctccaatgacagaggttttagaaacccttgaactgattgcaacctcaaaacctgcaggaagaaactgccaattagaacaaaagagagtccatgctcctgacagaaagtctagtgtgcaaaaagggtcccatttgaatcatactcctactgcattcccataatctgcttgcgtactctaaattttgaacatctgtatatacattccttatttttataaggttggtttttacaaggagaaatgctaggaacacactattttgaacacttcctctcttgtttgttgaaatttattgaagatgacaaaattttgttggtcctacatgatgtttaatgatcttttctcttgattttgttgtttttaatcaattttaaccaattagagataatgcatttgaaggagtgtggtagaaagtgtgttcctagcactcctctttgacaagatataatgtggcatgtacatgtacttagatgaaatttcaactgaatattagcacattatttccccaaactatagaagttccgcaaagcagtattctgcatgttcattttttggttgattatggctattgagatatttgtacaactgttatgtacacattgttagccaagagttgcattaaaactgttcacatcatttgtttttgcatggactgaagttcataagaaatcaatcattagtaatatagtatgtgaagaccaagagggacactgtgaacgagccatgttaaaatcagtcagatgctcccatgtaatatatgattatgcagtccaaaatg

SEQ ID NO: 1186 - DNA, 1907 bp, Quercus alba
tggtggtgaacaccatcaattacaaaaacaaacaaagaccccacgcgcttctcgcgtctacaacgacactcaaaaccaaaagccaaaaccaaccttctttctctgcgttttctcctcagtttccttcctcgactcttcctcctctgcctctctttcttcttctcctcctcttctttaattctttttcctattcaaaaccccatttttttttctcagtaatctccaccaagttagtgacaaacaaagctagctttacaaggagacttctgggtcattcattttttcgtttcttccgaggattcataataatctatgatgttttgttgttgaggatagcaagcaaagattgtgtcttgtaagagagggagagagagagaaaatattctatgggaaactgcttagattcttcagctaaagtagatacagctcagagctctcatgccacttctgggtcagcagtctcaaaattatcaagcaaaaccagccgttcatcaggtccttccagtctgaccattcaaactttcagtgagacgagcaatgcttcaagtcttcctactccaaggtctgaaggtgaaatattatcatctccaaatttgaaacccttcactttcaatgagctaaagaacgccaccagaaatttccgcccggacagtcttctcggtgagggaggatttggttatgttttcaaaggatggattgatgaacacactttttcagctgcaaagccgggatcaggaatggttgttgcagtcaaaaagcttaaatctgagggtttccaaggccataaggagtggttgactgaagttaattatcttggccaacttcatcatccaaatctggttaagctaattgggtactgtctggagggcgagaaccggcttttggtctatgagttcatgcctaaagggagcttagagaatcatctatttagaagagggccacaaccactttcttgggcaataaggatcaaagttgccactggcgctgctagagggctctgttttcttcatgaggcaaaatcacaagtcatatatcgtgacttcaaggcttctaatattctattggatgcggagttcaattcgaagctttctgattttggtttggcaaaggcgggtcctactggtgataggactcatgtatactcatggctatgctgcacctgaatatgttgctacaggtcggctcacagcaaaaagtgatgtctatagctttggagttgtgttgctagaactattatctggacgacgtgctgtcgataagtcaaaagttggtattgagcagaatctggtagactgggcaaaaccctatttgggtgacaaacggaaattgttccggattatggacacaaagttggagggccagtacccccagaaaggagcctatacagctgccacccttgccttacagtgcctaagcactgaagctaaagtcagacctaaaatggcagaggtattagcaaccctagaacagcttgaaaactccaaaaatgcaggcagaacctcccaatcagagcagcatacaggtgcacctgtcagaaaatcccctatgcgcccacacaattctcctcgaaatttaacacctggtgcatcaccattaccatcctatcgtcaatctcctcgagtacgttgaacaaagagcattgaatctgtaaattttttatgtgcttccatattatgttgttcatatgggatgtagtacgggcatgtctcttggcacaattttgagttatattgaattaatagttaccacttgtagttaccacttgttcatatgggatgtagtaggacataaatctgatttttgagtaatttgagttatattgaattggtagcttgtttgttgtgttaacgtacttaagtttaaaaaaagtaaaaaaactctagcgttgataccactagcttatacgt

SEQ ID NO: 1187 - DNA, 1834 bp, Malus domestica
atttcttctcagttgccatttctcgcattgacacgctctttctccttcttcttctcctcacatttttctgatttaattttttccaacaaggtcagctcgatcgaagaaaacccagaagaagaagaagtcagctgcagtttcttatacggattgaaatttgtttgcaatgacttgctgattgttcggctggtgtttgataaaagtcagtaaaagaagagcgcctttgagcttttggagtggcaaatgggcaactgtttagattcttctgctaaagtcgacaccgcacagagctcccttggaacttggggatcaggggcttccaaagtttccaacaaaactagcccttcctcagctccctccactttgaccgtcccgtcatataatggaaggagcagtggttcaagtcttcctaccccaaggactgaaggagaaatattgtcatctccaaatttgaaagccttctcattcaatgagctaaagaatgccacccgaaacttccgccctgacagtcttctcggtgaaggaggatttggttatgttttcaaaggatggattaatgagaacacgtggacagctgcaaaaccagggtccggaatggttgttgctgtcaagaagctcaaacctgagggtttccaaggccacaaggagtggttgacagaagtaaattatcttggtcaactccatcatccaaatctggttaagcttatcgggtactgcttggagggtgagaaccgccttttggtgtatgagttcatgccgaaaggaagcttagagaatcatctgtttagaagagggccgcaaccactttcatgggcaacaagaatgaaagtagccataggcgctgcaagggggctcagttttcttcacgaggcggaatcacaagtcatatatcgtgattttaaggcttccaatattttactagattcggaattcaacgcgaagctttctgattttggcttggccaaggctggtcccactggtgacaggactcatgtgtctactcaagtcatgggtactcaaggctatgctgcacccgaatatgtagctacaggtaggttgactgctaaaagtgatgtctatagttttggggttgtactgctggaactattgtctggaaggcgagctgttgataaaacaaaagttggtgtggagcagaatctggtagattggacgaaaccatatttgggtgataaaagaaaactatttcggattatggataccaagttggagggccaatatccccagaaagcagcttatacagctgctactcttgcttcacaatgcctatgcaccgaatctaaactcaggcctacaatgtcagtggtattagccacgctggaacaacttgaatccccaaagactgcagccagaaactctcaatcagaacagcacacacttcctgttcctcggaagtcgccaatgcgacaacaccattctcctctcaatatgccaccaaatgcatccccattggcatcccaaaggcaatctgtacgtgttcgttaacagagatggtgtctttctgtaaattacttgtctcttgatcccatattatgttcacagaatcgagtttgggcatgtatttttctcagttttgagtcattctgaagaggttactaccgcctgtaatatctgaagctatgtagctattttgtattggtaatctgcttgatggtatagtgtaaaaagttggctatcagtttaattctgcaggatgaccgacgttcttgtcctgtcacaactgccggcgtcaaattatcctggcgccaatacatgctagtctcgcgctagtaaatattgtgttatctgtaattatagtttgctaattcatgaacaa

SEQ ID NO: 1188 - DNA, 1993 bp, Theobroma cacao
attcattcgtccaccagcaccaagccaaagccaagccgagtccatttgcctttcgtggggtgtacacgtagtagctgaggccaagtccccgctcacgcgtttgtcgtgtcgtgtctcgtctctctcccacatcctcctcaaagccaaaagagacgccaactccagtttcttctctgaggtttccttctctctgtttcttttttttttaaaatttttttctgcttattttcagctaagaatttagttctctttccaacttgaaacttttcaaacagcttaaccgacaaaaccaaaccaaaccaaagctccacgtaagggaaacaaaattccaatccaacgagagccgtttttaagttccctttcttctcttaaaggatctgagaaattatcatggctcgttaaattggatagctcatataaaagaaaaagaaagaagaaagagagtggtattggatttgttttttttctttgggtttcattttcgtgaagtattaatctctctctgtgatgggcaactgcttattttcttctactagagtcgattccagccaaagcccccatgcaacttctgcatcaggtggctcaagaatttccagcaaaaccagtcgttcttcagctccttcaagcctgacaatcccatctttcagtgatacaagcagttctggatgtcttcctacaccaaggactgaaggagaaatattgtcatcccccaatttgaaacctttctccttcaatgagttgaagaatgccaccagaaactttcgtcctgacagtcttcttggtgaaggtggttttggttatgtttttaaaggatggattgatgaacacacattatctgctgcaaagccgggatcaggaatggttgttgctgtcaagaagcttaaacctgaagggtttcaaggccacaaagagtggttgacggaagttgattatcttggccaacttcatcatccaaatctggttaagttgattggatattgcttggagggtgagaaccgacttttggtctatgagttcatgcctaaaggaagcttagagaatcatctttttagaagagggccacagccactttcttgggcagtaaggcttaaggttgccataggtgctgctagagggctttctttccttcatgatttaaaatcccaagtcatatatcgcgatttcaaagcttctaatattctactagatgcggaattcaatgctaaactttctgattttggattggccaaggcagggcctactggtgataggactcatgtgtcgactcaggtcatgggtactcatggctatgcagcccctgaatatgttgctacaggtcgattgactgctaagagtgatgtatacagctttggagttgtgctgcttgaactattgtctggacgacgtgctgttgataaaacaaaagttggtgtggagcagaatctagtagactgggcaaaaccatatttgggtgacaaaagaaaattatttcgaattatggacactaagttggggggccagtacccccagaaaggtgcttatacagctgctacccttgctttacagtgtctaagtagtgaagctaaactcaggcctcgaatgtcagtggttttggcggcactggagcagcttgaagcccctaaaaatgtatccaaacactctcattcagaacagcagcctgttccacttcctgttcggaaatctccaatgagacatcatcgttctcctatgaatattacacccattgcatctccattaccggctcataggcaatctccacgagtatattgattccatctgtaaatttcctatgtgtatgtatattttttttgttgctgataaaaatgtaattttgagcttgcttttttgatgcaatttttgcatttcatataacaccacctccttttgtttcgtgaggattagagtttctcattgtggtagtcagcttctttcattattgtatcagtaccttcctttcagtgatgcatattaatctaaaccttattccattcca

SEQ ID NO: 1189 - DNA, 2879 bp, Ricinus communis
caaaactccaaagagaaacagaaaaaaaaaaaaaaaagaaaattctcttcccctgttctcttctcagaaattctctgctttttcttttctcaatttcattttcctcttacttctcttttttcttttctttcccttcacgacatcacagctttatagctttcttcctttctttgtttctttcttttacttgatactgaaaagctcaatttttaatagtggttattgataataatctttagtggaaacttggaaagataacaagaggtttaacattgcgtgcctgatttgaagaggtagttttgttgtgcccatatgggaaactgtttagattcttctgctgccaaagtggatacaactcaaggttcacatactccttctggagcctcaagaatttccagcagaaccagccgttcttcagttccttctagtctgactatcccatcttacagtgaaaggagcagttctgagtgtcttcctacaccaaggactgaaggtgaaatattgtcatccccaaatttaaaagcattctgttttaacgaactaaagaatgccaccagaaattttcgtcccgatagtctgctgggtgaaggtgggtttggttatgttttcaaaggttggattgatgagcacacattgagcgctgcaaggcctggttcaggaatggttgtggcagtcaagaagcttaaacctgagggtttccagggccacaaggagtggttgacagaagttaggtatcttggccagcttcatcatccaaatctggtcaaactgattggttactgcttggagggtgagaaccggctattggtctatgagtttatgccgaaagggagcttggagaatcatctgttcagaagaggaccgcaaccactatcatgggcggtgcgaataaaagtggccgtaggtgctgccagaggactttctttccttcatgatgcaaaatcacaagtcatataccgggatttcaaggcttctaatattttactggacgcggaattcaatgccaaactgtctgattttggtttggccaaggaagggcccactggtgatagaactcatgtgtcgactcaagtcatgggtactcatggctatgcagcacctgaatatgttgctacaggtaggctgacagcaaagagtgatgtatacagctttggggttgtgttgcttgaactactgtctgggagacgtgctgttgataaaaccaaggttggtatagagcagaatctggtggactgggcaaaaccctatcttagtgacaaaagaaaattattccgaataatggacaccaagttggggggacaatatcctcagaaaagtgcccatatggctgctaatcttgccttgcaatgtctaagcactgaagccaaagctaggcctcgaatgtcagaggtgttggcaacactggagcaaattgaatccccaaaaactgcaggcagattatcccactcagagcatccgtcaattcagatacctgtccggaagtccccaatgagacaacaccattctcctctaaatctaacgccaagcgcttccccattgccatcccatcggcaatctcctcgagtacgttgagtaaaaacatctcagtaaatttttcagttgcatattttcctgttgctgtaatatctaatttgggcgtgtatctcaatgccatttttgattccactagaacagattatcatcacctgacacctgtacttctcttagcattttcctttgggtaatctgcatcaagtcatttgtaattatatctctgtagtcaatatcatttttgcttcggctgatctatatctaattgtttaaccagtattggtcggagtagcaagaatatcactcgtttctgggaattttagttgacaaattttattttatttttttacttggaaagtactgaatgctcaagggactgttatcttacggaaagcgtataaagtcctgttaacgataagcattgtagtgtgattggtgggttatgcgcattttagaagttccaacttctatcagcatgtcaaccagaagggcaagaagttatccacagcaaattaatctactatggctgatatgtcaagttccgaaattaacttacaggatgtgatattcaaggaacgaacctattgaaagatctcatcttcttgtacgtagatattgcaagtcagctgcattatggctatccatgctttgttgcagtagctctagatcagctacaacttctgtcattgttggccgggtcttagggttggagctgaggcatcgaagaattattgcagcaaaatctcgagcttcctccattgggatgctcctgagcttcttgtctataacatggtgtagttccagcttgttgctaagatgtggtttagcccattgagcaaaactccccggcaagccatctgaatgtttcttgaccgcgcaacctgataagatctctaggagtaccactccaaatctgaacacatcagcttttagggtcaaacgacctgtaaaagcacaaaaatcttttaggcaatctccaaacagcaatagagctacaaatgtcatgctgagacactatatgaatcgagtacctgttgcaacatattcaggagcgaagtagcctctagtgccaagtactctggtagtaacgtggctttcttcaccttggggtccagacttggccaatccaaaatctgaaagcttggcactaaagtcctgcaatgccacccttagcgtaaataacaattcagaaagaagaaagttcaaattaatgaactacaagtcgacagatgtacaaaaatgaccagttatatgtaaatacataattatatatatatgtgtgtgtgtgtgtgtgtgtgtgtgtgtatacaaatattaatttcagtaacaggttttgataatttcattga

SEQ ID NO: 1190 - DNA, 2931 bp, Gossypium raimondii
gcaacattacacgataggtggatttatatcacatgtagagaaaaaggaggtcatgcttttgcttgccacccaaaccaagcttagtgagagttggcatggtttgatttgcctttgttttcgggagagggtgcttacgtcatagctaacgccacgccaagtgtcccctttgcccctctcgacacttcccacgcgtttgtcgtgtttcgttcggcacatccaaaaaaacctccccaaagacgagaaaaatgaccacccaacttcagtttctgctataagaatttagttcctgaacctccgtagcttgaccgaccgaaccaacccaacccaaaggtctatgtaagagaaacaatttccaaatccgagagagagccgttttccagtttcctttcttctttttaggatcctagaaattacctgccttgttgaattgtataacttttatctcttataaaagaatagtgaacaaagaagagaaaactattttttcttgttgaagcattagtttctctctgatgggcaactgcttgttttcttccactagagtcgattctacccaaagcccccaaccaacttctggtaatcatttctttctttccatgggtattttttgttttggttgattattgcttcttttttttcatttgttatgatcttttagctataaaggtttaaacttttatgtcggatttgactttctttttgggggtttggtaaggtttatttttagctttctgaaagagtatacctagaaattacattcattttatactttctgatattcataaccctggttcttgatatttcttcaatttcttgagtttgagctgtgtgggggaatagatcctgttcacttgaaactatttttgattttggatagtgccctttttcaatcaaaatgagtttcaatgtccaaacttgaagaaagtgtaagcatgagttgcaggcttctgttgtagtgctcggtgtgttcatatatacttgaatacgcaagattcttgtgtggggaaaaacatctacgaatttatatttggaagggaatacgaaatggtatgcataggatagagtggtgcttgcttggagtgctatgacccttgcataactgtgattttataactaatgattgttgcaaacctcaattgaaacaaattttttcgattaatcctacgattgtttcttcaccatctgttataagtcagacttaaaaggagtttgcttcgaagaattaagggaaaggtatttatggaaatacaataatgcattttctcatactaaatgctccatgaatgaaaaaatctactgatttgggtggtttcaggatgcataacactctcatgcgaagaccatagatgttagataagtttaagtttgaattcctcttgcattttgatactttgctatgtaatcaatttaacaactggaccaaggaacttgttttgcttttcagcatcaggaggctcaagaatttctagcaaaaccagtcgatcttcagctccttcaagcttgactcttccatctttcagtgatacaagtagtagtaatggatgtcttccaacaccaaggactgaaggagaaatattggcatcccccaatttgaaacctttctcgttcaatgagttgaagaatgccaccagaaactttcgtcccgacagtcttcttggtgaaggtggctttggttatgtctttaaaggatggattgatgaacacacattagctgctgcaaggcctggctcaggaatggttattgctgtcaagaagcttaaacccgaaggatttcaaggccacaaagagtggctgactgaagttgattatctcgggcaacttcatcatccaaatctagttaagctaatcggatattgttcagagggtgagaaccgtcttttggtctacgagttcatgcctaaaggaagcttggagaaccatctttttagaagagggccgcagccactctcttgggcagtgaggcttaaggtcgccatcggtgccgctagagggctctctttccttcatgatttgaagtcccaagtcatatatcgtgatttcaaagcttctaatattctactagatgcggaattcaatgcaaaactttctgatttcggattggccaaggcagggcctactggcgatagaactcatgtatcgactcaggttatgggaactcaaggctatgcagcacctgaatatgtcgccacaggtcgattgacggctaagagcgatgtgtacagctttggagttgttttgcttgaactactgtctggacggcgtgctgttgataaaacaaaagttggcgtggagcagagtctagtagactgggcaaaaccatatttgggtgacaaaagaaaattattccgaatcatggacacaaagttgggcggccagtacccccagaaaggtgcttttacggcagctacccttgctttacagtgcctaaatagtgaagctaaactcaggcctcgaatgtcagaagttttggcagcactggagcagctagaagcccccaaaactgcatccaaacacagtcaagcagaacagcatgctgttccacttcctgttcggaaatccccaatgcgacaccatcgatcacctatgcatctaacacccagtgcatctccattaccatctcacagacaatccccgcgggtacattgagattccatctgtaaattttctagatgtatttatatctttttggttgcttagaaagcaattttttgagcgtgtagtatttttttttgcagttttgcatagcacaccttttgtttagagtttgtggtcagtgtaatagcaaccttcatctctatgatgcatattaatcataaccttccattctatgaattctatcattgtatttatgaaacactgtaatggaacccatcatttatctgtggtgtgaatatgaatttcaatgcgcagaggcttagggcttgaatcaac

SEQ ID NO: 1191 - DNA, 1756 bp, Gossypium hirsutum
gaccgaccgaaccaacccaacccaaaggtctatgtaagagaaacaatttccaaatccgagagagagccgttttccagtttcctttcttctttttaggatcctagaaattacctgccttgttgaattgtataacttttatctcttataaaagaatagtgaacaaagaagagaaaactattttttcttgttgaagcattagtttctctctgatgggcaactgcttgttttcttccactagagtcgattctacccaaagcccccaaccaacttctgcatcaggaggctcaagaatttctagcaaaaccagtcgatcttcagctccttcaagcttgactcttccatctttcagtgatacaagtagtattaatggatgtcttccaacaccaaggactgaaggagaaatattggcatcccccaatttgaaacctttctcgttcaatgagttgaagaatgccaccagaaactttcgtcccgacagtcttcttggtgaaggtggctttggttatgtctttaaaggatggattgatgaacacacattagctgctgcaaggcctggctcaggaatggttattgctgtcaagaagcttaaacccgaaggttttcaaggccacaaagagtggctgactgaagttgattatctcgggcaacttcatcatccaaatctagttaagttaatcggatattgttcagagggtgagaaccgtcttttggtctacgagttcatgcctaaaggaagcttggagaaccatctttttagaagagggccgcagccactctcttgggcagtgaggcttaaggtcgccatcggtgccgctagagggctctctttccttcatgatttgaagtcccaagtcatatatcgtgatttcaaagcttctaatattctactagatgcggaattcaatgcaaaactttctgatttcggattggccaaggcagggcctactggcgataggactcatgtatcgactcaggttatgggaactcaaggctatgcagcacctgaatatgtcgccacaggtcgattgacggctaagagcgatgtgtacagctttggagttgttttgcttgaactactgtctggacggcgtgctgttgataaaacaaaagttggcgtggagcagagtctagtagactgggcaaaaccatatttgggtgacaaaagaaaattattccgaatcatggacacaaagttgggcggccagtacccccagaaaggtgcttttacggcagctacccttgctttacagtgcctaaatagtgaagctaaactcaggcctcgaatgtcagaagttttggcagcactggagcagctagaagcccccaaaactgcatccaaacacagtcaagcagaacagcatgctgttccacttcctgttcggaaatccccaatgcgacaccatcgatcacctatgcatctaacacccagtgcatctccattaccatctcacagacaatccccgcgggtacattgagattccatctgtaaattttctagatgtatttatatctttttggttgcttagaaagcaattttttgagcgtgtagtattttttttatgcagttttgcatagcacaccttttgtttagagtttgtggtcagtgtaatagcaaccttcatctctatgatgcatattaatcataaccttccattctatgaattctatcattgtatttatgaaacactgtaatggaacccatcatttatctgtggtgcgaatatgaatttcaatgcgcagaggcttagggcttgaa

SEQ ID NO: 1192 - DNA, 2527 bp, Vitis vinifera
ggacaacagcagcatatagggggcaggttgttccttctctgcgttttctgctcttcttcctgcgtcctcttcttagtcatacccttcgttttggcccccaaagctctattttttcttcttcttattgttcaagggaaaaagtagtccatccatttatccttgatagatatactgtttgcgaaccgctttatcagagtttgggatttgaggtcttttgggaataatcatgatgatggcttatgaatagctactgataacagacaaagtctgtaaagagagtcccaaatgggtaactgcctagattcttcggccagagtggatagcacccagagctcccataccacttctgcttcaggagcctcaaaagttgtcagcaaaaccagcaattcttctgctccttcgaccctgacagtcccatcttacagtgaaaggagtactgctgaaagttttcccactccaagatcagaaggtgaaatattgccatctccaagtttgaaagccttctcatttaatgacctaaagaatgctaccagaaacttccgtccggacagtctactcggtgaaggaggatttggttatgttttcaaaggatggattgatgaacaaacacttgctgctgtaaagcctggatccggaatggttattgctgttaagaagcttaaacctgaaggttttcaaggccacaaggagtggttgacagaagttaactatcttggccaacttcatcatccaaacttggttaaacttattgggtactgcttggagggtgagaaccggcttttggtctatgagttcatgcctaaagggagcttggagaatcatctctttagaagaggaccacagccactttcttgggcagtaaggatcagagtggctataggtgctgcaagaggtctctcttttctgcacgatgctgaatctcaagtcatatatcgtgactttaaggcttctaacatcctactagatgcggaattcaatgcaaagctttcagattttggtttggctaaagcggggccaactggtgacaggactcatgtgtccactcaagttatgggtacacatggctatgcagcacctgaatatgttgctacaggtcggctgacagcaaagagtgatgtttacagctttggggttgtgttgttagaactattgtctggacgtcgtgctgtcgataaaacaaaaattggtgtagagcagaacctggtagactgggccaaaccatatttgggtgacaaaaggagattgttccgaattatggacaccaagttggagggccagtacccccagaaaggagccttcatggctgctacccttgccttacagtgccttaacactgaagctaaagtcaggccacgaatgtcggaggttttagcaacactggaacagatccaatccccaaaaaatgcagcaaaacacatccagtcagaacagcatacagtttccattcctgtccagaagtccccattgagacaacagcattctccactgaatctgacgccacgggcatccccattgccatcctacagacaatcccctcgtgtacgttgaatggaggaacatttgattctgttgggtattatactcctttgcatccataggttgtttatattggaatgtaatgagcatgtatttttccagaatgttgtgccataaacacgtgattcatcctctgttttgtgaaaatatgctagtttttttgggtagtaattagctagttttatttattgtatcaatagagcagatatcaacaccttcggaaagaaagttatgtccttgatttagtcatgaaaagacaggtatattttacagatttgcctggcatgtaatatagcttttattttcagctccttgttaattggaacaaaagcatttggaatgcatctgaattacagggagttaaacttcagtcatacttttctgttgtggacatgacagcaaggaaaaaattagctcacaggattttccttgatgtctctgtggaagttaagtgggaggaccttctggggtgcagcaagtccgcgtaagttatgtttgctgctgtccctgtgttgctctagttgctccagggaagacaagacctcggtcatggtcggccgactattggcatctgaatttagacattgaaggattatctcagccaactcttgagcttcttccatgctgaaattgctcccaagtcttttgtcaataacatgaggcagtcgcagcttattgctcagatatggtttagcatgatcagccagattctctaacattccatttgagaatctatccactgcagaagagccggataagatctctagtagcactactccaaagctgtacacgtcggatttcaatgtgagatgccctgtaggacggggagtggagggatatcactctctgtaatctgtgtagagctgagtagctttcttgataaataaatattagttgatggggaggcaaagctgtcttatttttagcaaatatgaagatgcaacttaatggtttactgtacaattggttcctggacatagatcttattgat

SEQ ID NO: 1193 - DNA, 1783 bp, Fragaria vesca
cctcttctacctccccaaactaaacccagattttgtgaatcactgtttgattctagttgagcagcagcaaatgggcaactgtctgggttcttctgctagggttgatacagctcagagcacccttggtacttcagcgtcggggacttccaaatcttccagcaaaaccagcccttcatcagctgctccccccagcttgaccatttcatcatatagtgaaaagagcaatagttcaagtcttcctacaccaaggacggaaggtgaaatattgtcatctccaaatctaaacccgttctcattcaatgagctaaggaatgccaccaggaactttcgccctgacagtcttctcggcgagggaggattcggttatgttttcaaaggatggattaatgaaaccacgtttacagcagcaaagccagggtcaggaatggttgtagccgtcaagaagctcaaacctgaaggtttccaaggtcacaaggagtggttgacagaagttaattatcttggccagctctatcatccaaatctagttaagcttattgggtactgcttggaaggtgaaaaccgtctattggtgtatgagttcatgccaaaaggaagcttagagaatcatcttttcagaagagggccgcaaccactttcatgggcaacaagaatgaaagtagccataggtgctgccagggggctaagttttcttcatgaagccgaatcacaagttatttatcgtgatttcaaggcttccaatattttacttgatgcggaattcaatgcaaaactttctgattttggcctggccaaggcgggtcccactggtgaccggacccatgtttctactcaagtcatgggcactcagggctatgcagcacctgaatatgttgctacaggtcgattaactgctaaaagtgacgtttatagttttggggttgtattgttggaacttttgtctggacggcgagctgtcgataaaacaaaggttggcgtcgagcagaatcttgtagactggacaaaaccatatttaggtgacaaaagaaaactatttcgaattatggacaccaagttggagggtcaatatcctcagaaatcagcctatacagctgctactctggctttacagtgcctaagcccagaatctaaacaaaggcctacaatgtcaacagttgtagcaacactggaacaacttgatgcccccaaaacacctgccagaatctctcaatcagagcagcagggagttcctcttcatcaccgtaggtcccccatgcaacatcaccgttctcctttaaatttaacgcccagtgcatctccattgccatcctaccggccatctgcttttgttcattgaacacagttttcttaatggagattactcatttgattccaatttgtttatatagaatcaagtttgggtctgtatttatcacacttttcaattagaggaggtatcatggtgcctgtaattctatgaatatatgcttagcctttttgtggtggtatctgtgtctgagttatagttctgtaaaaagttagctgtgagtattagtttgcactctttactattgccccttcagtttatcgattctttattgggtatgatactccactccaggagcagcaatgttagagatcatatggatctttttcgtcgtgtttttatgcgattctgttcaagtattaagacacttctcatgtatgctgtttcctttagttgtacgaaatttctgcttgtacattgattcaaacaggaactatttcaattgcttacattcattctggacatacacagcattat

SEQ ID NO: 1194 - DNA, 2139 bp, Cicer arietinum
tttcttcctatttattaacacaaacacacttcatttcattcattcatatatgcaccccccatctttttctttgactccttcattttgagagttgaaggaaaccaagtaataattaacaacaacccttaacggcgaagatgaataataatcattcactattcatcatcgccttcttcttcttcatttcatctctattctccaccgttagatctgattcctcagatcaccgtttcaaagaaggagatctcgttcctctcttcgctaacaaagttggtccttttcataatccgagtgagacatatcgttattttgatctgccattctgtataccagatcatttgaaagagaagaaggaagcgttgggcgaagtgttgaatggggatcgtttggttagtgctccttatcagcttgagtatcgacgagacaaggagtcggtgtcagtttgcaagaagaaacttacgaaagaagatgtggggaagtttcgatctgccgttcgtaaggactactactttcagatgtattatgatgatttgcctatttggggtttcatagggaaggttgataaggaagggaaggaccctagtgattatagatactacctttacaagcacattcactttgatatcttttataacaaggatcgtgttattgagatcaatgtgcgtaccgatccgaatgcccttgtggatgttacggaggataatgaagttgatgtggagtttttctatactgtgaaatggaaggagactaacactcccttcgataagagaatggacaagtactctcagtcgtcctcactgccccatcatttggaaattcactggttctcgattatcaattcgtgcgtcacagtcctcctcttgactggttttcttgcaactattttgatgcgggtccttaagaacgattttgtcaagtatgcacatgacgaggaggttgcagacgatcaggaagagactggctggaaatacatccacggtgacgtgtttaggtttccgaagttcaagtctgtatttgcagctgctcttggatctggtacccaactgtttacccttacggtgtttatattcatattggcactcgttggtgtattttatccgtacaaccgaggggctctatttactgcacttgttgtcatatatgcactcacttctggaattgctggctacactgcaacctcattctattgtcaactggaaggaacaaactgggttaggaatcttctattgactggatgccttttctgtggacctctatttctgacattttgctttctgaacactgttgcaattgtctacaatgctactgctgccctcccattcggcacaattgtcgttatagttctcatatggacacttgttacgtctcctctacttgtattaggaggcattgctgggaagaacagcaaggctgaattccaagctcccgttcgcacaacgaaatatccaagggagattccgcctttgccatggtatcgcggaacaattcctcagatggcgatggcaggatttttgcctttcagcgctatatacatcgaactttattatatatttgccagtgtttggggtcacagaatttacacaatctacagtattctgtttattgtcttcatcattctcttgattgttactgctttcattactgtggcattgacatacttccagcttgctgctgaggatcatgaatggtggtggagatcattcctatgcggcggttcaactggattatttatctatgcctattgtctgtattactactatgcacgctccgatatgtctggattcatgcagacctcatttttctttggttacatggcctgcatatgctatggtttcttcttgatgcttggaactgttggattccgtgcagcgttgttctttgttcgtcacatataccgatccataaagtgcgagtaggcattttgtcctctcaaagtcctctagagctattgtcttcatttcataggcatcatgtagaaaattatagtaattttgcagtacttctgtgtactataagggagaagctaggttgggtgggttcctagcttccagagcaaattgttagaacacaaagggttcttttggagataacttttgtactaccatgtctttaaccaaactcttgaaatactttaatttt

SEQ ID NO: 1195 - DNA, 2251 bp, Glycine max
tgtttctttccctcttccgtttattaacactcataccgcaccctcttcttcttcctctctttctctcttcttcgtcgctggccttgcctttcaagatccaaacctcttcccaatgaggaacctctctttcttcttcttcttcttcttcaccttcttcgccgccgtcagatctgatccctcagatcaccgctacaaagaaggcgaccccgtccctctctacgccaacaaagttggccccttccacaaccctagcgaaacctaccgttacttcgaccttcccttttgtgaaccaggtgatttgaaagagaagaaggaggcgctcggggaggtgctgaatggggaccgtttggttagcgcgccatacaagctggagttccagcgcgacaaggagttggtttccgtgtgcgacaggaagctctccaaacaggacgtggctcggttcagatccgcggtgaggaaggactactacttccagatgtactacgacgaccttcctatttggggcttcatagggaaggttgacaaggaagggaaggaccccagtgattataggtacttcctgtataagcacattcacttcgacgtcttctacaacaaggacagggtcattgagatcaatgtgcgcaccgatcccaatgcgctggtggatctcaccgaggatgctgaggttcaggccgagtttttgtacacggttaagtggaaggagactaacacgccattcgagaagaggatggacaagtactcgcagtcttcatcgctgccgcatcatttggaaatccactggttctcgattatcaactcctgtgtgacggtgttgctcttgaccgggttcctcgccaccattttgatgagggtgctcaagaatgattttgtcaagtatgcacatgatgaggagtctgcagaggatcaggaagagactgggtggaaatatatccatggggatgtgtttaggttccccaagtttaagtctctgtttgcggctgcgcttggatctggcactcagttgtttacccttacggtgttcatattcatattggcgcttgttggtgtgttttatccatacaatcgaggggcgctgtttactgcacttgttgtcatatatgcacttacttcagggattgctggatacactgcaacttcattctattgtcagttggaaggaacaaactgggttaggaatctgctgttgactggatgccttttctgtggacctctgtttctgactttctgctttctgaacactgttgcaattgcttacaaagctactgctgctcttccatttgggacgattgtggttatagttctcatatggtcacttgttacgtctcctttgcttgtattgggaggcattgccgggaagaatagcaaggctgaatttcaagctcctgttcggacaactaaatatccaagggagattccacctctgccttggtatcgtggaacaattcctcagatggcgatggcaggatttttgcctttcagtgctatatacattgaactttactatatatttgccagtgtttggggccacagaatttacaccatctacagcatcctgttcattgtcttcatcattctcttgattgttactgctttcatcactgtggcattgacatacttccagcttgctgctgaggatcatgagtggtggtggagatcattcctatgtggtggttcaactgggttatttatctatgcctactgtctgtattactactatgcacgctccgacatgtctggattcatgcagacctcatttttcttcggatacatggcctgtatatgctacggtttcttcttaatgcttggaactgttggattccgtgctgctttgctctttgtccgccacatttatcgatccattaagtgtgagtaggcattttgtcctctcaagtccactagagcaattgtcttcatttcatagggaattctgtagaaaaattatagtaattttgcagttcttttgtgtactataagggaagctgggttgggtgggtttctggcttccagagcaacttgttagatggcaaagggtgcttttggggataacgtctgtgtactaccatctctttaaccaaactcttgcaatactttttggtccttatgaacattcttcaacatgtcaattttctaccggtgtcaacatttaagttttccataaagattattgcaaatccaaattgtaacacatctggggcatctctacattaaaagtgttggaaatcttatcagatattacctgcgagtacct

SEQ ID NO: 1196 - DNA, 2160 bp, Cajanus cajan
ttaggattcaagatccaatgaatcccctctcactctcactctttttcctcgtcactaccctcgccaccaccgtcagatccgactcctccgaccaccgctacaaggacggcgaccccgtccccctctacgccaacaaggtcggccccttccacaaccccagcgagacctaccgctacttcgacctccccttctgcctcccagggcacttgaaggagaagaaggaggcgctgggcgaggtgctgaatggggaccgtttggtgagcgcgccgtaccagctggaattccagcgcgacaaggaggccatctccgtgtgcaagaagacgctgagcaaagacgaggttgcccggttcagatcggcggtgcggaaggactactacttccagatgtactacgacgacctccccatttggggcttcatcgggaaggtcgacaaggacggcagggaccccagcgactaccgctacttcctctacaagcacgtccacttcgacgtcttctacaacaaggaccgcgtcatcgagatcaacgtccgcaccgaccccaacgccctcgtcgatctcaccgacgacgccgaggtccacgccgagttcctttacaccgtcaagtggaaggagaccaacacgcccttcgacaagcgcatggacaagtactcccagtcctcctcgctgccgcaccatctcgaaatccactggttctccatcatcaactcctgcgtcaccgtcctgctcttgactggcttcctcgccaccatcctcatgcgggtgctcaagaacgattttgtcaagtatgcgcatgatgaggagattgcagaggatcaggaagagactggatggaaatatatccatggggatgtgtttaggtttcccaagtttaagtctctgtttgcggctgcacttggatctggcactcagttgtttactcttacggtgttcatattcatattggcgcttgttggtgtgttttatccatacaatcgaggggcgctctttactgcacttgttgtcatatatgcacttacttcaggaattgccggatatactgcaacttcattctattgtcagttggaaggaacaaactgggttaggaatcttctgttgactggatgccttttctgtggacctctgtttctgacgttctgctttctgaacactgttgcaattgcttacaaggctactgctgctctaccatttgggacaattgtggttatagttctcatatggacacttgttacatctcccttgcttgtattgggagggattgctgggaagaatagcaaggctgaatttcaagctccctgtcgcacaactaaatatccaagggagattccacctctgccatggtatcgtggaacaattcctcagatggcgatggcaggatttttgcctttcagtgctatatacattgaactttactatatattcgccagtgtttggggccacaggatttacaccatctacagcatcttgttcattgtcttcatcattcttttgattgttactgctttcatcactgtggcattgacatacttccagcttgcagctgaggatcatgagtggtggtggagatcattcctatgtggtggttcaacggggttatttatctatgcctactgtctgtattactactatgctcgctccgacatgtctggattcatgcagacctcatttttcttcggatacatggcctgtatttgctatggtttcttcttaatgcttggaactgttggattccgtgctgctttgctctttgtccgtcacatttatcgatccatcaagtgtgagtaggtattttgtcctctcagtccactagagctattattgtcttcatttcatagggcattctgtagagaattatagtaattttgcagttcttctgtgtactataagggaagctgggttgggtgggtttctagcttccagagcaacttgttagatggcagagggtgcttttggggataacgtctttgtactaccatctctttaaccaaacttttgcaatactttttgatccttttcaacgttcttcatcatgtcaattttcaagctgtgtcaaaacaattaagttctatagaaattatgacaaatccaaattggaacacatttgggctgtctctacatgagtaatgtcagatatcgtattagatattatcagcgattacct

SEQ ID NO: 1197 - DNA, 2075 bp, Prunus persica
gtttgtctgtctctgcagagattagagagagagtgacaatggggaagaccatggcggtgggagtgccagtcatcatcgccttgctaattctctgcggtgtggatctggtcaggtcagacgcgtcggatcatcggtacaaggaaggagatttagtccctttgtatgccaacaaggtgggccccttccacaaccccagcgaaacgtaccgatattttgatctcccattctgctcaccagataaggtgaaagagaagaaggaagctctgggtgaagtattaaatggggatcgtttagtcagtgccccttacaaactagagttccaaaagcataaagattcagaagtagcttgcaaaagaacaataaaaaaggaagaagtggcccggttcagatctgctgtcaacaaggactattactttcagatgtattatgatgacttgcccatttggggtttcatagggaaggttgacaaggaaggcaaagacccgagcgaatacaagacctacctgtataagcatattcattttgatatctcttacaacaaggaccgtgtgattgaaatcaatgttcgaacagatccaaatgcattggttgaccttacagaggataaagaaattgatgtcgaattcatgtatactgtaaaatggaaggaaacaaccactccttttgataagaggatggataagtattctcagtcctcatcgctgccgcatcatttggagatccattggttctcgattataaattcatgtgtgacagttctcctgttgaccgggtttcttgccacaattctcatgcgagtgcttaagaatgattttgtcaaatatgcccatgatgaagaagcagctgaagaccaggaagagactggatggaaatacattcatggagatgtatttagatttcccaaatacaagtctctgtttgcagcagctctgggttcaggcacccaactatttacccttacgatattcatttttatacttgctcttgttggcgtgttttatccatacaaccgaggggctctatttactgctctggttgtcatttatgcactcacatcaggaattgcagggtatactgctacttcattttattgccagctagagggaacaaactgggttaggaatctattgttgacgggatgcctcttctgtggacctctgttccttacattctgctttttgaatactgttgcaattgcttatacggccactgctgcgcttccctttggcacaattgtggttatagttctaatttggacgcttgtaacatcacctttgctagtgttaggagggattgccgggaagaacagcaaagctgagttccaagctcctgttcgcacgactaaatatcccagagaaattccacctttaccttggtaccgggcaacaatccctcaaatggcaatggctggttttctgcctttcagtgctatatacattgaactgtactacatttttgccagtgtgtggggtcacaggatttacaccatttacagcatcttgtttattgtgtttatcattcttctgatagtcactgctttcattactgtggcgttgacatatttccaacttgctgctgaggaccatgagtggtggtggagatctttcctctgcggtggatctactggcatatttatctatgcctattgtttgtattactactacgcacgctcagatatgtcaggatttatgcaaacgtcattcttctttggttacatggcatgcatctgctatggtttcttcctcatgcttggaactgtaggcttccgtgcagctttgctttttgttcgtcacatataccgatccatcaagtgtgagtagctagttgttctccaagaatcaatcatcatgggagatgtactttctggtgtttttaatctcataggcacctacctccttgtagagaagtttcctcaaaattaattttgtagtgcctcctcgtgtcctaaagcagtgtcatgagatatcttgctttccagagcaatgtgttagatcacaatatggtcgactattcatagagacagtttgtatcattacctttcaagctttgcaatacattctttaaatatcttcctc

SEQ ID NO: 1198 - DNA, 2461 bp, Phaseolus coccineus
gaagcgagtcaaaatagaagaaaaaaacaaagagtgtaccaaactgagaacccaaacaatgggtggttaaagcagcgtttgggcagagagaaatagaagaaggaattgtgtgcgtgaggtaaaacatcaaacgttacagtgtggcggtgagtctacgtcacttgataatactcattcgcgttttccgtttattagcactcaaaccgcacctcttctccttcgtctcttctcttctcttcttcgtcggtggggttggatttcgagatccaaacctcttcccaatgaggaacctcttctcttcctcctcttccttctgcctcctcctcttcaccgccttcgccgcgctctccgccgtcagatctgactcctcagatcaccgctacaaacaaggcgacatcgtccctctctacgccaacaaagtcggccccttccacaaccctagtgaaacctaccgttatttcgaccttcctttctgtcctccagttgatttgaaagaaaagaaggaggcgcttggggaggtgctgaatggggaccgtttggttagcgcgccatacgttctagaatttcaacgtgacaaggagtcggttcatgtttgcgacgctaagctatcgaaaaaggatgtggcgaggttcagatctgctgtccgtaaggactactacttccagatgtactatgacgaccttcccatttgggggttcattgggaaggtggacaaggaagggaaggaccctagtgagtataggtatttcctgtataagcacattcactttgatgtgttctacaacaaggacagggtcatcgagatcaatgtacgcactgatcccaatgccctcgtggatctcactgaggatgctgaggtgaatgccgagtttcagtatacggtgaagtggaaggagaccaacacgccctttgagaagaggatggataagtactcacagtcgtcatcgctgcctcatcatttggaaatccactggttctcaattatcaactcatgtgtcacggtgcttctcttgactgggttcctcaccaccattttgatgagggtgctcaagaacgattttgtcaagtatgcacatgatgaggagactgcagaggatcaggaagagactggctggaaatatatccatggggatgtgtttaggtttcccaagttcaagtctctatttgcagctgcgcttggatctggcactcagttgtttacccttactttgttcatattcatattggcacttgttggagtgttttatccatacaatcgaggagcgttatttactgcacttgttgtcatatatgcacttacttccgggattgccgggtatactgcaacttcattctattgtcagctggaaggaacaaactgggttaggaatctgctgttgacaggatgccttttctgtggtcctctgtttctgacgttctgctttttgaacactgttgcaattgcttacaaggcgactgctgccctcccatttgggacaattgtggttatagttctgatatggacacttgttacatctcctttgcttgtattgggagggatagctgggaagaacagcaaggttgaatttcaagctcctgttcgcacaactaaatatccaagggagattccacctctgccatggtatcgtggaccaattcctcagatggcgatggcaggatttttgccttttagtgctatatacattgaactttactatatatttgccagtgtttggggccacagaatttataccatctacagcatcctgttcattgtcttcatcattctcttgattgttactgctttcattactgtggcattgacatacttccagcttgctgctgaggatcatgagtggtggtggagatcattcctttgtggtggttcaactgggttatttatctatgcctactgtctgtattactactatgcacgctccgacatgtctggattcatgcagacctcattttttttcggatacatggcctgcatatgttatggtttcttcttgatgctgggaactgtaggattccgtgctgcattgctctttgtccgccacatttatcgatccatcaagtgtgagtaggcattttgtcctctcgagtccactagagctattgtcttaatttcatagggcattctgtagaaaattatagtaattttgcagttctttctcgtgtactataagggaagctgggttgggtgggtttctagcttccagagcaactttttaaatggcaaagggtgcttttgggataacgtctgtgtactaccatatctttaaccaaactcttgcaatactttttggtccttttgaacgaacgttcttcttcatgtcaattttctacctttgtcaaaacatttaagttttccttagagattatggtaaatccatgttgtaacacgtttctctacgtgaaaagatttagaaatcttatcagatattattttatctcccagtacctatttttagatagaaaa

SEQ ID NO: 1199 - DNA, 2182 bp, Linum usitatissimum
tttatcctcttcctgctctcttcttccatctccacgtcggcggtagcggtggcggacaaaaacggcggcccttgtgtgtcatagtgtggtctgaacagtaatggcggggaagaagatggtggcgctcctattcgtcgccgttttggtggtcgtcttcggagcagatcaggtgagatctgacgcctccgatcaccggtacaaagacggagatcaggttcctctctatgctaacaaagttggaccgtttcacaacccgagtgaaacgtaccgttattttgaccttccattctgctttccagcacacatgaaggaaaaaaaggaggctctcggtgaagtactcaatggggatcggttagttagtgctccataccagcttgacttcctccgtgagaaggattctgaagttgtttgtaagaagaggctttcaaaggaagaagtggaccagttcagagctgctgttaagaaagattactatttccagatgtattatgatgacttacccatctgggggttcatagggaaggttgacaaggaaggcaaagaccccagcgactataaatattatcttttcaagcacattcactttgatatcttttacaacaaagaccgtgtgattgaaatcaatgtccgaactgatcctaatgcactggtggatgttactgaggataaggaggtagatgtggagttcttatatacggtgaagtggaaggaaaccaatactccttttgataaaaggatggacaagtactcacagtcttcttcattgccccatcatttggaaatccactggttctcaatcataaattcttgtgtgacagttctgcttcttactggctttttggctactatcctcatgcgggtgcttaagaatgattttgtcaagtacgctcatgatgaggaagctgctgaagaccaggaagagacaggttggaagtatattcacggagacgtgtttagatatccaaaatacaaatccctatttgccgcatctctcggttctggaacccaattattcactctgaccattttcatttttattctggcattggttggggtgttttatccatacaaccggggagccctattcactgcattagtcgtcatatatgctcttacatcaggaatcgctggatacactgcaacttccttttactgtcagcttgaaggaactaactgggttaggaatctgctgttgactggatgcctcttctgcgggcctcttttcctaaccttctgtttccttaacactgttgcaatcgtctacactgctactgccgctcttcctttcggtacaattgttgtgattgtgctcatatggacacttgtgacttctccactacttgttttgggtggaattgccggtaagaatagcaaggctgagttccaagctccttgccgcaccaccaaatatcccagggagattccgcccttgccatggtacaggggaaccatccctcagatggccatggctggatttcttccattcagtgctatctacatcgagctctactacatctttgcgagtgtgtggggtcacaggatctatactatctacagcatcttgttcatcgtattcatcattctccttatagtcactgctttcattactgtggcattgacctatttccaactcgctgctgaggatcatgagtggtggtggaggtcgttcctatgcggtggatctacggggctatttatctacgcttactgcctgtactactactatgcacgctcggatatgtctggtttcatgcaaacatccttcttcttcgggtacatggcctgcatctgctacggcttcttcctcatgctcggaagcgtagggttccgtgctgccctgcttttcgtccgtcacatctaccgatcgatcaagtgcgagtagagaaaggaaaggcagagtgtagtagttgggaaatccggagtaatgtcattgttaactggaaagagtggcgggggacacaacgaatgtgtagagagaagattttggtcagaatgggatttttagggtttgttgtaggctctccccacctctcttgtacgaagtaatcaaatgcagacttcattcgttgtctctgctgctagagaagtttgtttcagtaggttaaaaagtatgtgtcttttggttactatcagaaagtttgtatcctcacattatatcttggactcctcttcaatacaaatt

SEQ ID NO: 1200 - DNA, 2407 bp, Eucalyptus grandis
gttgaagcatcgctcctcccgacgggcgccccatctctctccctcaaatctgaccattcattcaacgaaaaccccctcattattacgccattatttcctcctcgaaacctttaattaataaaatcgatatttttttttgtgtttatttttatttattttttgtatttttcgtataactcaccaaacagcccaagctctcttccaaatccgacgtacgtacattgccatatttcccccagataaaaacagcaccgaaccagagaaccagcccgagatctccccccctctctctctctctctctctctctatcactgggtgtctctggtaagtcgtcggcgagaaggggagaggcaatggggaagccaatggcggtgctggccgtcgccgtcctgatggcgtcgctttgctctccggcgagatcggacggttccgatcaccggtacaaggacggagacccggtccctctctacgccaacaaggtcgggccgtttcacaatcccagtgaaacttaccgctatttcgatcttccattctgcattccagctcatttgaaagagaaaaaggaggcccttggtgaagtactaaacggggatcgccttgtcagtgcaccctacaagctagacttcatgaaggataaggagtctgaggtcatttgcaagaaaaaactctcgaaagaagaagtggcccaattcagatctgcggtcattaaggactattactttcagatgtattatgatgacttgcctatctggggtttcatagggaaagttgacaaggaaggcaaagatcccagcgagtacaagtacttcttgtacaagcatattcattttgacatcttttacaacaaggaccgtgttatcgagatcaatgtccgtacagaccctaatgcccttgtagatcttacagaggataaacaaactcaggttgaattcatgtatacggtcaagtggaaagagaccaatactccttttgacaagaggatggataagtactcgcagtcatcttctttacctcatcatctagagatacactggttttcgattataaattcatgcgtgactgtgcttctgttgactggatttcttgccacaatactcatgcgagttctcaagaatgatttcgtcaaatatgcccacgatgaagaatcagttgaagatgctgaggagactggatggaaatacattcatggagatgtattcaggtacccgagattccagtctctgtttgcagctgcacttggttctggtacccagctgtttactctcacggtgttcatctttatactggcattagttggtgtattttatccttacaaccgaggggctctgtttactgcactggttgtcatttatgcactgacgtctggaattgctggctacacttctacctcattttattgtcagctggaaggaactaactgggtcaggaacctattgttgactggatgccttttctgtgggcctcttttcctcacattctgcttcttaaacactgttgcaattgtttacacagcaacagctgctcttccatttggcaccattgtggtgatagtcctcatatggacacttgtgacgtcgcctttgctggtattaggtgggatcgctgggaagaacagcaaagctgagttccaggctccttgtcgcaccaccaaatatcccagagagattccaccattgccatggtatagggggacgatccctcagatggcaatggcaggattcttaccattcagtgccatatacattgaactttattatatctttgccagtgtttggggtcataggatctacactatatacagcatcttgttcatcgtctttattattctcctgatagtcactgctttcatcactgtggcattgacgtacttccaacttgctgctgaagaccatgaatggtggtggagatcttttctctgcggtggatcgacgggcttatttatctatgcctattgcctctactactattatgccagatccgacatgtctggcttcatgcaaacttcgttcttcttcggctacatggcgtgcatctgctatggattcttcctcatgctgggaatggtaggtttccgtgcggctttgcttttcgtgcgccacatataccgctccatcaagtgcgagtagaggcagccgcttcatcaccagatcgttgaggacgcgattccttttccatgcgtaggtgcaacgtagagagaatttccttaccctaattttgtagcgcctgtatgtctcaaaagtcaaagcaacaagcaggttcccttttctaaattttgcatcaaagagagactgttcctagaatattgtgtgcttactttactgctcacaaaattgagtttgtataatttctttctctagcaaaactatgcgatacacacattttttcatggcgcctctctctctcgac

SEQ ID NO: 1201 - DNA, 2075 bp, Malus domestica
acgtggttgtcttatctctgcagaggttagagagagagagagaatgaggaagaccatgactgtaggagtacactgcatcatcgctttgctaattctgtccggtgcggatctagtcaggtccgacgggtcggatcatcgctacaaggaaggagatttagtccctctgtatgccaacaaggtcggcccgtttcacaatcccagtgaaacgtaccgctactttgatctcccattctgctcaccaggtgcggtgaaagagaaaaaggaagctcttggtgaagtattaaatggggatcgtttagtcagtgccccttacaaacttgagttcctaaagcataaagataccgacgtagcttgcaagacaaaactcaaaaaggaagaagtggcccagttcagatctgctgtcaacaaggactattacttccagatgtattatgatgacttgccgatttggggtttcatagggaaggttgacaaggaaggcaaagacccgagcgagtacaagacctacctttataagcacattcattttgatctctattataacaaggaccgcgtgattgaagtcaatgttcgtacagatccaaatgcattggttgaccttacagaggataaagaagttgatgttgaattcatgtatactgtagagtggaaggaaacagccactccttttgagaagaggatggataagtattctcagtcctcatcgttgcctcatcatttggagatccattggttctcaattataaattcatgcgtgacagttctcctcttgactgggtttcttgctacaattctcatgcgagtgcttaagaatgattttgtcaaatatgcccatgatgaagaagcagctgaagaccaggaagagactggatggaaatacattcacggcgatgtatttaggttccccaaatacaagtccctgtttgcagcagctcttggttcgggaacccaactttttactcttacggtgttcattttcatactcgcgcttgttggtgtgttttatccatacaaccgaggggctttatttactgctctggtagtcatttatgcactcacttcaggaattgcgggctatactgctacttcattttattgtcagctagagggatcaaactgggttaggaatctattgctgacgggatgcctcttctgtggacctctgttccttacattctgctttttgaatactgttgcaattgcttatacggctactgctgcccttccattcggcacgattgtagttatagttctgatatggacacttgtaacatcacctttactggtgttaggtgggattgctgggaagaacagcaaagctgagttccaagcccctgttcgcaccactaaatatccgagagagattccaccattaccttggtaccgggcaacaatccctcaaatggcaatggccggttttctgcccttcagtgctatatacattgaactgtattacatatttgcaagtgtatggggtcacaggatttacaccatttacagcatcttgtttattgtgtttatcattcttctgatcgtcactgctttcattaccgtggcattgacatatttccaacttgctgccgaggaccatgagtggtggtggaggtctttcctctgtggtgggtctactggactatttatctatacctattgtttgtattactactacgcacgctcggatatgtcgggattcatgcaaacatcattcttctttggttacatggcatgcatctgctacggtttcttcctcatgcttggaactgtaggcttccgtgcagctttgctttttgtccgtcacatataccggtcgatcaagtgtgagtagtagcttgttctccatgaatcatcggatatggtttctcgtgtttttggagtcacaggcacccctgtagagaatttggtcaaattaattttgttagtgcttggtgtactaaagctgtagtcgtgagatatgtatgcttccggagcaatatgttagatcacaatatgggcgactatattcagagacaagtttgtatctttacctttgaatcttttgcaatacattcttcaaatatattctctctccttacata

SEQ ID NO: 1202 - DNA, 2341 bp, Cucumis melo
acagtgggtcaggctcaggctcagcaaacaaacccccggctaagccttaaccggctaacccaaccccctcgacatccgaccttaaaacgccctcttcccccgtcattttttctaaaccccccttattatcgcaatcccatcccattcccctcttcccatttccccccttcttctctgtccactccctgtctctatctctctgcttccttcacaatgggaagatttggggcggtgcctttcatcgccttacttgttctcctctgcggatctgttccggtgagatctgatggatccgaccatcgctacaaagatggagatcctgttccgctctatgctaacaaagttggcccatttcataatcccagtgaaacttaccgctacttcgatctcccattctgcgtaccagatgacgtgaaggagaaaaaggaggctcttggtgaagtattaaatggagatcgtttagttagtgccccatacaaacttgacttcttgcaagagaaggattcttctagtgtttgccagaaaaaactttcaaaggaagacgttgctagatttcgtgctgcggtagacaaggactactactttcagatgtattatgatgatttgccaatttggggtttcatagggaaggttgacaaggaagggaaagatcctagtgatttcaaatattacctatacaaacatatccattttgatatattttataacaaggatcgggttattgaaataaatgtcagaacagaccccaatgcccttgttgatctcacagaggataaggaagttgatgttgaatttttatacactgtaaaatggaaggagacaaccaccccatttgagaataggatggataagtactcccagtcatcgtcactgcctcatcatttggaaattcattggttctcaattataaactcatgtgtaactgtcctcctccttactggatttcttgccaccattcttatgcgagtactgaaaaatgactttgtcaaatatgcccacgatgaagaatcggctgaggaccaggaagagactgggtggaaatacatacatggtgatgtatttaggtacccgaaacacaagtctctttttgcagcttgtcttggttctggtacccaactgttcacacttacagtgttcattttcatacttgcgcttgttggagtgttttatccgtacaaccgaggggctttatttactgcactagttgtaatctacgcccttacatctgggattgctggctatgtcgcaacttccttttactgccagctcgagggaacaaactgggtaaggaatctgctgttgactggatgcctcttctgcgggcctctttttctgacattttgctttctaaatactgtcgcaattgcctatacagcaactgcggcccttccttttggtactattgttgtaatagtcctcatatggactcttgtaacatcacctttgctggtgttgggtgggattgctggtaaaaacagcaaggctgaatttcaagctccagttcgaaccactaaatatcctagagagattccacctttgccttggtaccgtgggacgattccacagatggcaatggcagggtttctgcctttcagtgccatatatattgagttatactatatatttgccagcgtgtggggtcacaggatttacaccatatacagcatcttgtttattgtgttcatcattctccttatagttacggcattcattactgtggcattaacatactttcaacttgctgccgaggaccatgaatggtggtggagatcttttctttgcggtggttcaactggcttatttatctacgcttattgtttgtactactactacgctcgatcagatatgtctgggtttatgcaaacatcatttttcttcggctacatggcttgtgtctgctatggcttcttcctgatgcttggagctattggttttcgagcagctttgctttttgtgcgccacatatatcggtctatcaagtgcgagtagtcctgggtattcatcactcaatactgagaagtcgagttgtgtttctttttcaaattcataggtttctatgtagaaaagttacctgcagcagtcctttatttgttcttttttggtgatatgtcttaaaaagggaacagcaatttctttagatattatatgctctaagagcagggcagcggtatggtggcaggatggatgaccgtgccaggcacgaacttggggaacggagtttgtaccattacattagttgcaacacttttgttttaatctgaactttgttcaacacattattgttcttcctctcaagtgtctaacacccgcttatgatgaaatactggtcagctctggaatt

SEQ ID NO: 1203 - DNA, 2407 bp, Citrullus lanatus
ggctcaggctcaggcccagcaaacaaaccccagccttaacccaacccctcaccgacttccgaccttaaaacgcccctcttccctcgtcatttttctaaaccccccattatcgcaatctcatcaaatccccttcttcccatttccccttcttccctgaccactccctgcttctacctctctgcttccttcacaatgggaagatttggggcggtggttttcatcgccttactttttctcctctgcggatctcttcgggtgagatctgatggatccgatcatcgctataaagatggagattccgttcctctctatgctaacaaagttggcccatttcataatccgagtgagacttaccgctacttcgatctcccattctgcgtaccagatgacgtgaaggagaaaaaggaggctcttggggaagtattaaatggagatcgtttagttagtgccccatacaaactcgacttcttgcaagagaaggattctattactgtttgcaagaaaacactttcaaaggaagacgttgctagatttcgggctgcagtagacaaggactactactttcaaatgtattatgatgatttgccaatttggggtttcatagggaaggttgacaaggaaggaaaagaaccaagtgatttcaaatattacctatacaagcatatccattttgatatattttataacaaggatcgtgttattgaaataaatgtcagaacagaccccaatgcccttgttgatctcacagaggataaggaagttgatgtcgaatttctatacactgtaaaatggaaggagacaaccaccccatttgagaataggatggataagtactcccagtcctcgtcactacctcatcatttggaaattcattggttctcaattataaactcatgtgtaactgtcctcctccttactggatttcttgccaccattcttatgcgagtacttaaaaatgactttgtcaaatatgcccatgatgaggaatcggctgaggaccaggaagagactggatggaaatacatacatggtgatgtatttaggtacccgaaacacaaatctctttttgcagcctgtcttggttctggtacccaactgtttacacttacagtgttcattttcatacttgcgcttgttggagtgttttatccatacaaccgaggggctttatttactgcactagttgtaatctatgctctcacatctgggattgctggctatatcgcaacttccttttactgccagcttgagggaacaaattgggttaggaatctactgttgacgggatgccttttctgtgggcctttgtttcttacattttgctttttaaataccgttgcaattgcctatacagcaactgctgctcttccttttggtactattgttgtaatagtcctgatatggactcttgtaacatcgcctttgctggtgttgggtggaattgctggtaaaaacagcaaggctgaatttcaagctccagttcgtaccactaaatatcctagagagattccacctctgccttggtaccgtgggacgattccacagatggcaatggctggattcctgcctttcagtgccatatatattgagttatactacatatttgccagtgtgtggggccacaggatttacaccatatacagcatcttgtttattgtgttcatcattctccttatagttacggcattcattactgtggcattaacatacttccaacttgctgccgaggaccatgaatggtggtggagatcttttctttgcggtgggtcaactggcttatttatctatgcgtattgtttgtactactactatgctcgctcagatatgtctgggtttatgcaaacatcatttttcttcggctacatggcttgtgtctgctatggcttcttcctgatgcttggagctattggttttcgagcagctttgctttttgttcgccacatatatcggtccatcaagtgcgagtagtactgggtactcatcagtccatcactcaatactgagaagacgagttatgtttcttttaacttttcatattcgtaggtttctatgtagaaaagttacctgcagcagtcttttttgttctttttggtgatatgtcttgaaaagggaacagcaatttctttagatattacgctctaagagcagagcagcagcatggtggcaggatggatgaccgtgtcaggcacgaacttggggaacggagtttgtaccattacattagtttcaacacttttgttttaatctgaactttatccaatacattattgttcttcctctcaactgtctaacacccttttatgatgaaatacttgtccaccccagaaattcaattcgtttgctctgtccgttcctcaatttttatttaaaccagaaataagtcactcgaacaaaattcacgctcaaa

SEQ ID NO: 1204 - DNA, 2357 bp, Cucumis sativus
agtggctcaggctcaggctcagcaaaaaaaacccaggctaagccttaatcggctaacccaaccccctcgacatccgaccttaaaacgcccccttccccgtcattttttctaaacccccccttattatcgcaatcccatcccattcccctcttcccattttccgctcttcttctctgtccactccctttctctatctctctgcttccttcacaatgagaagatttggggcggtgcctttcatcgccttacttgttctcctctgcggatctgttccggtgagatctgatggatccgatcatcgctacaaagatggagatcctgttcctctctatgctaacaaagttggcccatttcataatcccagtgaaacttaccgctacttcgatctcccattctgcgtaccagatgacgtgaaggagaaaagggaggctcttggtgaagtattaaatggagatcgtttagttagtgccccgtacaaacttgacttcttgcaagagaaggattcttctagtgtttgccagaaaaaactttcaaaggaagatgttggtagatttcgtgctgcggtagacaaggactactactttcaaatgtattatgatgatttgccaatttggggtttcatagggaaggttgacaaggaaggaaaagatcctagtgatttcaaatattacctatacaagcatatccattttgatatattttataacaaggatcgggttattgaaataaatgtcagaacagaccccaatgcccttgtcgatctcacagaggataaggaagttgatgtcgaatttttatacactgtaaaatggaaggagacaaccaccccatttgagaatagaatggataagtactcccagtcatcgtcactacctcatcatttggaaattcattggttctcaattataaactcatgtgtaactgtcctcctccttactggatttcttgccaccattcttatgcgagtacttaaaaatgactttgtcaaatatgcccacgatgaggaatcagctgaggaccaggaagagactgggtggaaatacatacatggcgatgtatttaggtacccgaaacataagtctctttttgcagcctgtcttggttctggtacccaactgttcacacttacagtgttcattttcatacttgcgcttgttggagtgttttatccatacaaccgaggggctttatttactgcactagttgtaatctatgctcttacatctgggattgctggctatgtcgcaacttccttttactgccagctcgagggaacaaactgggtaaggaatctgctattgactggatgcctcttctgcgggcctctttttctgacattttgctttctaaatactgtcgcaattgcctatacagcaactgcggcccttccttttggtactattgttgtaatagtcctcatatggactcttgtaacatcacctttgctggtgttgggagggattgctggtaaaaatagcaaggctgaatttcaagctccagttcgaaccactaaatatcctagagagattccacctttgccttggtaccgtgggacgattccacagatggcaatggcaggatttctgcctttcagtgccatatatattgagttatactacatatttgccagtgtgtggggccacaggatttacaccatatacagcatcttgtttattgtgttcatcattctccttatagttacggcattcattactgtggcattaacatacttccaacttgctgccgaggaccatgaatggtggtggagatcttttctttgtggtggttcaactggcttatttatctacgcttactgtttgtactactactacgctcgctcagatatgtctgggtttatgcaaacatcatttttcttcggctacatggcttgtgtctgctatggcttcttcctgatgcttggagctattggttttcgagcagctttgctttttgtgcgccacatatatcggtctatcaagtgcgagtagttctgggtattcatcactcaatactgagaagtcgagttgtgtttctttttcaaattcataggtttctatgtagaaaagttacctgcagctttatttgttcttttttggtgacatgtcttaaaaagggaacagcaatttctttaggtattatatgctctaaaagcagggcagcggtatggtggcaggatggatgactgtgccaggcacgaacttggggaacggagtttgtaccattacattagttgcaacacttttgttttaatctgaactttgttcaacacattattgttcttcctctcaagtatctgacacccgcttatggtgaaatactcgtcagctccggaattcaattcgtttgcttagtctgtt

SEQ ID NO: 1205 - DNA, 2056 bp, Malus domestica
ggttgtcttttctctccagagattagagagagagagaatgaggaagaccatggcggtgggagtacactgcatcgtcgccttgctaattctttccggtgcggatctagtcaggtccgacgggtcggatcatcggtacaaggaaggagattttgtccctctgtatgccaacaaggtcggcccgtttcacaaccccagtgaaacgtaccgatactttgatctcccattctgctcacgagatgcggtgaaagagaaaagggaagctcttggtgaagtattgaatggagatcgtttagtcagtgccccttacaaacttgagttcctaaggcataaagataccgaagtagcttgcaagaaatcactcacaaaggaagaagtagcccggttcagatctgctgtcaacaaggactattacttccagatgtattatgatgacttgcccatttggggtttcatagggaaggttgacaaggaaggcaaagacccgagcgagtacaagacctacctttataagcacattcattttgatctctattataacaaggaccgcgtgattgaagtgaatgttcgaacagatccaaatgcactggttgaccttacagaggataaagaagttgatgttgaattcatgtatactgtggagtggaaggaaacaaccactcctttcgataagaggatggataagtattctcagtcctcatccttgcctcatcatttggagatccattggttctcaattataaattcatgcgtgacagttctcctcttgaccgggtttcttgctacaattctcatgcgagtacttaagaatgattttgtcaaatatgcccatgatgaagaagcagctgaagaccaggaagagactggatggaaatacatccacggagatgtatttaggttccccaaatacaagtccctgtttgcagcagctctaggttcaggaacccaactatttactcttacggtgttcattttcatactcgcacttgttggtgtgttttatccatacaaccgaggggctttatttactgctctggttgtcatttatgcactcacttcaggaattgcgggctatactgctacgtcattttattgtcagctagagggatcaaactgggttaggaatctattgttgacgggttgcctcttctgtggacctctgttcctcacattctgctttttgaatactgttgcaattgcttatacggccactgctgcccttccattcggcacaattgtggttatagttctgatatggacacttgtaacatcacctttactggtgttaggtgggattgctgggaagaacagcaaagctgagttccaagcccctgttcgcaccactaaatatcccagagagattccacctttaccttggtaccgggcaacaatccctcaaatggcaatggccggttttctgcctttcagtgctatatacattgaactgtactacatatttgccagtgtatggggtcacaggatttacaccatttacagcatcttgtttattgtgtttatcattcttctgatcgttactgctttcattactgtggcattgacatatttccaacttgctgccgaggaccatgagtggtggtggaggtctttcctctgtggtgggtctactggactatttatctatgcctattgtttgtattactactacgcacgctcggatatgtcaggattcatgcaaacatcattcttctttggttacatggcatgcatctgctacggtttcttcctcatgctggggactgtaggcttccgtgcagctttgctctttgtccgtcacatataccggtccatcaagtgtgaatagtagcctgttccccaagaatcatcggacgtggtttctcgtgtttttcgacgcacaggcacctttgtagagaagtttggtcaaattaattttgtaagtgcctcgtgtactaaagctgtagtcatgacatatgtatgcatccggagcaatatgttagatcacaatttgggcgactatattcacagtgacaagtttgtatcactacatttgaatctttttgcaatacattctttaaatata

SEQ ID NO: 1206 - DNA, 2210 bp, Fragaria vesca
aaccttcaaatcgaaccaaaaacgtggctgtatctgggagaaacgcagagcaagaccaaagagaatggccaagactatggcggtgggaggaggaggagttccggtcatcttcatcatcgcctttctgatcctctgcggcgccgcagatctggtttcctccgacgcctccaatcaccgttacaaagaaggagatgtagtcccgctctatgccaacaaggtcgggcccttccacaaccccagtgaaacctacaggtactttgatctcccgttctgctcgccagatgcggttaaagagaaaaaggaagctcttggtgaagtattgaatggggatcgtttagtgagtgctccttacaaactcgagttcctgaaacataaagattcagaacaagtttgcaaaaagagtctcacgaaggaagaagtggccaagttcagatctgctgtgaacaaggattattactttcaaatgtattatgatgacttgcccatctggggcttcatagggaaggttgacaaggagaacaaagacccaagcgagtacaagacctacctctataagcacattcattttgatatcttgtacaacaaggatcgtgtgatcgaaatcaacgttcaaacagatcctcacgctctagttgaccttactgaggataaggaagttgatgttgagtttttgtatacagtgaaatggagggagacaaacactcctttcgataagaggatggataagtattctcactcctcatcactgcctcatcatttagagatccattggttctccattatcaactcatgtgtcacggttctactcttgactgggtttcttgccaccattctcatgcgagtgcttaagaacgattttgtcaaatacgcccatgacgaggaagcagctgaagaccaagaagagactggatggaagtacatccatggagatgtatttaggtttcccaaacacaaatctctgtttgcagcagctcttggttctggcacccaactatttacacttacgatcttcatcttcatacttgctcttgttggtgtcttttatccatacaaccggggggctttatttaccgctctagttgtaatttatgccctcacatcgggaatcgcaggctatactgcaacttcattttattgccagctagaggggacgaactgggttaggaatctgttgttgacgggatgcctcttctgtggacctttgtttctcacattttgctttttgaatactgtcgcaattgcttacacagccactgcagcacttccatttggcacaattgtggttatagttctaatatggacacttgttacatcacctttattggtattgggtgggattgctggaaagaacagtaaagctgagttccaagctcctgttcgaaccaccaagtatcccagagagattccacctttaccttggtaccgggcaacagtccctcaaatggcaatggctggttttctgcctttcagtgctatttatattgaactgtactacatctttgccagtgtctggggacacaggatttacaccatttatagcatcttgtttatcgtgttcatcattcttctgatagtcaccgctttcattactgtggcattgacatatttccaactagctgctgaggaccatgagtggtggtggagatcttttctctgtggtggatcgacgggcatatttatctatgcctactgtttgtattactactacgcccgctctgatatgtctggatttatgcaaacatccttcttctttggttacatggcatgtatctgctatggtttcttcctcatgcttggatctgtaggcttccgggcagctttgctttttgtccgtcacatataccgatccattaagtgcgagtaagctagttctccaagaatcgaagaaaggtttcttgtgttttccatcttataggcacccttgtagaggaatttcatcaaattaattttgtagtgcctcctgtattaagcaaaagccccaagtgctttgaccgcaatatgttagatcactatatggcaactattcatagagacagtctgtatcactactttccaaaactttgcaatacattctttaaatatcttctattgtgatacccggttcttctcttcccttggatctgatggtctgatatgttcctggttttctgtgatcgcgaattcgtgattttaaaacacaatgcaatgcaagtctctcccaagttttaagt

SEQ ID NO: 1207 - DNA, 2384 bp, Theobroma cacao
gattaaatcttaatctaatctaatttatatcaaatttagaaatacataaaataaattaatattcataaaaatatttataacagtgattatttatttagttatcttggttactccatacatccacctctctattcccttcatccatttttctacacttccctttcccttactctcttcgtccacccaaaaatgaaaaacctcggcaattgtccgacgtttctaatcctcggagttttattcttctgttgtctttcccatgttagatccgacgcctccgaccaccgttacaaagacggtgatcctgtcccgctctacgccaataaggtcggcccgttccacaaccccagtgaaacctatcgctactttgatctgcccttctgttctccagatcatttaaaggagaagaaagaagcgttaggtgaggtcttgaatggtgatagactcgtaaacgcgccttataaacttaactttagagaggaaagagattcttatgttgtttgtaagacgaagctttcaaaagatgaggttgccattttccgtaaggcggttgacaaggattattatttccaaatgtactatgatgatttacctatctggggttttattggaaaagttgataaggagggaaaagctgatccgagcgagtacaagtatttcctttacaagcatatccagttcgatatactttataacaaggatcgcgtaattgagatcagtgctaggatggatcctcattcgcttgtggacttgactgaggataaggaagttgatgctgagtttatgtatactgtgaaatggaaggagactgagactcctttcgagaagaggatggacaagtactccatgtcttcttctttgccacatcatttggagattcattggttttctatcatcaactcttgtgtgacggtgctccttttaacgggtttccttgcaacgattctcatgcgggtcttgaagaatgatttcattaagtatggtcaagatgaagaagcagctgatgaccaagaagagactggatggaagtatattcatggagatgtattccgattcccaaagttcaaatctttgtttgctgctgctcttggatctggaacacagctgttcactttaacggttttcatttttatgcttgcattggttggtgtcttctatccgtacaatcgcggtgctctgtttactgccctagtggtcatatatgcacttacatcagggattgcaggatatacagctacttctttctactgtcagcttgaaggaaagaactgggttaggaatctgttattgactggctgccttttctgtggacccttatttctcacattctgcttccttaacacggttgctattgcatacagcgcaactgctgcactgccttttggaactattgtagtaatagtcctcatatggacactagtgacatctcccttgcttgttctgggtggtattgctggaaaaaatagcaaggctgagttccaagctccctgccgcaccacaaagtatcctcgagagattccaccattgccttggtacaggagtgcaattcctcagatggcaatggctggatttcttccatttagtgctatttacattgagctttactacatatttgccagtgtctggggccacaggatctataccatatacagcatcttgtttattgtcttcatcatcctgctgattgtcactgcttttataactgtggctttgacatatttccaacttgcagccgaagatcatgaatggtggtggaggtctttcctttgcggtggatcaactggcctctttatctatgcctattgcttgtattattactatgcacgatcagatatgtctggttttatgcaaacctcgttcttctttggttacatggcttgcatctgctatggattcttcctgatgctcgggacagtgggtttccgtgcctcgctgctctttgttcgtcacatatacaggtccatcaagtgtgagtagagggtttagttgtcccttaacatttccatcaatgctgtcatagagaagtctatgattatgatctttgttagaaattagctggaagattgccctaattgtcatgagcaaatggggatgctatactatgcctaaagggatatctgtaagatctgcacgtgggtggctaggcattggagaacttttaggcatcatgtgtttattattaatatttgctttgtatgtaaccatgagacggatttgtgtaggatgctgttattttttatacctctctaccgggaaaaaaagatgctcaattagttttcttttaccgactgttttgagttgactttaaaagattgcgttgcaaaataaatgattattttccgacttctgcagtgtaataaggccaatccctagttgacatttaggat

SEQ ID NO: 1208 - DNA, 2123 bp, Euonymus alatus
aagaattaggccccctatatctttctcttcacactgcaagtgcgtgcgtgcgtgaaatcaatttcggactgaattcacaacatctccgtttcgtcgttaaagagggagggaaggagagtgaccaaatcatcgtttcaccgtgagagagagtgagatagaggaatggtggagaaaatggtggcgatgctattcgtcgccgttttgatgctgatggcggcggatcaggtgaggtctgacgcatcgaaccaccggtacaaggagggggaccaagtgcctctctatgccaataaggtcggcccgtttcacaatccaagcgaaacctaccgatactatgatcttcctttctgcttgccagatgacttgaaagagaagtcagaagctcttggtgaagtgttgaatggagatcgattggtcagtgctccctacaaacttgacttcctacgtgaaaaagactctgagcgtgtttgcaagaagaaaatcacaaaggaagaagtgttccagttccgatctgccgtgaagaaagactattactttcagatgttttatgatgacttacccatttggggattcatagggagggttgacaaggaaggcaaggatcccagtgactacaagtattaccttttcaagcatatccattttgatatctcttacaataaggaccgcgtgattgaaatcaatgtgcgaacagacaccaatgcagttgctgaccttacagaggataaagaaattgatgtagaattctattataccgtcaaatggaaggaaacaaacatcccttttgagaagagaatggacaaatactcgcagtcatcttcattgcctcatcatttggagatccattggttttcaattataaattcgtgtgtgaccgttctccttctaacagggttccttgctacaatcctcatgcgagtactcaagaatgactttgtcaaatatgcccatgatgaggagtcagctgaagaccaggaagagagtggttggaaatatattcatggagatgtatttaggtacccaaaatacaagtctctatttgcagctgctcttggttctggtacccaattatttacccttacaattttcatcttcgtactggcattagttggtgtgttttatccatacaaccgaggggctctattcactgcattggttgtcatatatgcactcacatctggaattgcaggttacactgcaatttccttttattgtcaactggaaggaaccaactgggtcaggaatctgttactgacagggtgtctcttctgtgggcctctgttcctcacattctgcttcctaaatacagttgcaattgcttacactgccactgcagctcttccatttggcacaattgtggttattgtactcatatggacacttgtgacttcacctttgttggtgttgggtgggattgctggaaagaatagcaaggctgagtttcaagctccttgccgcactgctaaatatcccagggaaattcctcctttgccatggtaccgtggaacaattcctcagatggctatggcagggtttcttcccttcagtgctatatatattgaactttactacatattcgccagtgtttgggggcacaggatttatactatctacagtatcttgtttattgtttttattatcctcctgatagtaactgctttcattactgtggcattgacttacttccaacttgctgccgaggatcatgagtggtggtggagatctttcctctgtggcggatcaaccggcttatttatctatgcctattgcttgtattattactatgcgcgctcagacatgtctggcttcatgcagacctcatttttctttggctacatggcttgtatctgctacggcttcttcctcatgcttggaactgtaggtttccgtgcatccttactctttgttcgtcacatatataggtctattaagtgtgagtaggtagtttgcctttctttaaagaagttgtcaggtgtttttctgttgtttctcgacccagaggtgccatgtaaaaagtgttcgacagtaattttgtagtgttgcttgtatttaaaggtggaatgaatgctcaattgatatggaaaagtattttatattacaatttggattactatggggaaaaaata

SEQ ID NO: 1209 - DNA, 2145 bp, Euonymus alatus
atccctttcacttcactctgtgtgaacggtgaaatcaattttggattagtcacttccagtcttccatttcgttggtaaagactaaagagggagggagcgagagcgagagagagagagagagagagatggcggacacaatggtggcgaccctattcgtcgccgttttgatgctgatggcggcggatcaggtgaggtctgacgcatcgaaccaccggtacaaggagggggaccaagtgcctctctatgccaacaaggtcggtccgtttcacaatccaagcgaaacctacagatactatgatcttcctttctgcttgccagatgacttcaaagagaagtcagaagcttttggcgaagtgttgaatggagatcgattagtcagtgccccctaccaactcgacttcttacgtgaaaaagagtctgagcgtgtttgcaagaaaacactgacaaaggaacaagtatcccagttccgatctgctgtgaaaaaagactattactttcagatgttttatgatgacttacccatttggggattcatagggagggttgacaaggaaggcaaggatcccagtgactacaagtattaccttttcaagcatatctattttgatatcttttacaataaggaccgcgtgatcgaaatcaatgtgcgaacggacaccaatgcagttgctgaccttacagaggataaagaagttgatgtagaattctattatactgtgaagtggaaggaaacaaacaccccttttgagaagagaatggacaaatactcacagtcatcttcattgcctcatcatttggagatccattggttttcaatcataaattcatgcgtgactgttctccttctaacggggttccttgctacaatcctcatgcgagtacttaagaatgactttgtcaaatatgccactgatgaggaatcagctgaagaccaggaagagacaggttggaaatatatccatggagacgtatttaggtaccctaaatacaagtctctatttgccgctgctcttggttctggtacccaattatttactcttatgatattcatcttcatactggcattggtaggcgtgttttatccatacaaccgaggggctctattcactgcattggttgtcgtatatgcactcacatctggaattgcaggttacactgcaacttccttttattgtcaactggaaggaactaactgggtcaggaatctgttactgacgggatgtctcttttgtgggcctctgtttctcacattctgcttcctaaatacagttgcaattgcttacaccgccactgctgctcttccatttggcacaattgttgttattgtgcttatatggacacttgtgacgtcacctttgttggtgttgggtgggattgctggaaagaatagcaagactgagtttcaagctccttgccgcactactaaatatcccagggaaattcctcttttgccttggtaccgtggaacaattcctcagatggctatggcagggtttctacccttcagtgctatatatatcgaactttactacatatttgctagcgtttgggggcacaggatttatactatctacagtatattgtttattgttttcattatcctcctgatagtaactgctttcattactgtggctttgacctacttccaacttgctgccgaggatcatgattggtggtggagatctttcctctgtggcggatcaactggcttatttatctatgcctattgcttatattattaccatgcacgctcggatatgtctggcttcatgcagacctcatttttctttggctacatggcttgtatctgctatggcttcttccttatgcttggaactgtaggtttccgcgcagctttactttttgttcgtcacatatataggtctgtcaagtgtgagtaggtagtttgtctttcgttaaagaagtcgtctggtatttttattttgtttctcgaccaagaggtgccatgtagagaagtggtttgacagaaatttcgtaacgtagcgtagcttgtatcaaaaggtggaatgaatgttcatttggtattttttttctgaagaagtattttagattacaatttggattactttggtagatacttttatcatgacttggctatatatttatatataaaatatttgttct

SEQ ID NO: 1210 - DNA, 2150 bp, Castanea mollissima
ttttattattaattaagtaaaacctctttgccgattggatctcaaaaacaaaaccaaaaccaaacgagatctatctctctttctgaaagggtttagaaagaaagagagagagatagatatggagaagagtgtggcggtggtagtgttgttaatggtgctgcttggtgcggatcaggtgaggtcgagtgcatccgatcaccgttacaaggaaggagaagcagtgcctctctatgccaacaaggtcggcccctttcacaatcccagtgaaacgtaccggtattttgatctcccgttctgctctccagaaaatgtgaaagagaaaaaggaagctcttggtgaagtgctaaatggcgatcgtttagtgagtgctccctacaaacttgatttccgaattgagaaagattcagagctcgtttgcaagaaaacactctcaaaggaagaggtggcccgtttccgagatgcggttaacaaggactactactttcagatgtactacgatgacttacccctttggggtttcattggcaaggtcgaaaaagaaggcagagacccaagcgactacagatattctctctataagcacattcagtttaacatcttttacaacaaagaccgcgtcatcgaaatcaatgttcaaacagacgcacgcaacgttgtcgaccttactgatgacaacaaagactctgttgacgtcgattttttatatactgtcaaatggaaagaaacgagcgtcccttatgagaagaggatggataagtactcgcagtcttcttctcttcctcatcatctcgagatccattggttctccattataaattcatgtgtcactgtgcttcttctaactggctttcttgccaccattctcatgcgagtccttaaaaatgattttgttaaatatgcccatgatgaggaaacagctgaagaccaggaagagactggatggaaatacatccatggagatgtattcaggtatcccaaatacaagtctatatttgcagctgcccttggttctggtacccaactatttacccttacggtattcatttttatactagcacttgttggtgtattttatccatacaaccgaggagctctttttactgcactggttgtcatatatgctctcacatcaggaattgcgggctatattgcaacctccttttactgtcagctagagggaacaaactgggttaggaatctaatgttgacgggatgcctcttttgcggacccctgtttcttatgttctgcttcctgaatactgtagcaattgcttataatgccactgctgctctcccatttggcacaattgtggtgatagttcttatatggacacttgtaacatcacctctgctggtgttgggtgggattgctgggaagaatagcaaggctgaattccaagctcctgtccgcaccaccaagtatcccagagagattccaactttgccatggtaccggggaacgattccgcaaatggcaatggcaggctttctgcctttcagtgctatatacattgaactttactacatatttgccagtgtatggggtcacaggatttataccatatacagcatcttgtttattgtcttcatcattctcctgatagttactgctttcattactgtggcactgacatactttcaacttgctgctgaggaccatgaatggtggtggagatcttttctatgtggtggatcaactggcatctttatctatgcctattgcctgtactactactatgcacgctcagatatgtccgggtttatgcaaacctcatttttctttggttacatggcttgcatctgctatggtttcttcctcatgcttggaactgtaggtttccgtgcagctttactatttgtgcgtcacatttatcgatccatcaagtgtgagtagatggttgatcctcgtcaagagtcgtttgccatgttttttcctcttttatataggcaatgtagagaaattaagttccaaaggtaattttgtagcgcctcatgtattaaaaccagaagcaaggttcgataatttcttgcttgagcagcatgttggataacaaacaagtatgcttttgacagtacggcaaaaaagtttgtatcattactcaaatcaagactttgcaatatattcttttaatatcttctacctctgttta

SEQ ID NO: 1211 - DNA, 1985 bp, Silene vulgaris
ccctgatttctcctttgatttcaatcaattaattaaaacaaggtggtttaattaattaattcaatcatggagaaattaagggccacatttatggtggccattcttgttgttgttattaatctgattggagtgagatctgatggttctgatcatcgttacaaagctggtgatcaagtccctctttatgctaataaagttggtccctttcacaatcccagtgaaacataccgctattttgatctgccattttgttctccagatcaagtgaaagagaaaagggaagctctcggtgaagtattgaatggggatcgtttggttagtgctccttacaaactagatttcctggttgacaaggattcagaagtcatttgcaagaaaaagttatcaaaggaagaagtagttaaatttagagatgcagtatcaaaggattattacttccaaatgtattatgatgatttgccaatatggggtttcctaggaaaagttgacaaggaaggcaaactagacccaagcgagtacaaatactatctttataagcatattcattttgacatactttacaacaaggatcgagttattgaaattaatgtaaggactgaccccaacactttagtggacattactgaagataaagatgttgaggtggaatttatgtacaccgtgaattggaaggagacagacaccccttttgacaaaagaatggataaatattcacagtcatcttctcttccacatcatctagaaatccattggttctccatcataaactcatgtgtcactgtactacttttgactggattccttgccacaattctgatgcgagttctcaagaatgattttgttaagtatgcacatgatgaggaaacagctgaagaccaggaagaaaccggttggaagtatatccatggggatgtatttaggtttccgaagtacaagtcattgcttgcagcttctcttgggtctggcacacagctatttactcttacggtgttcatatttctacttgctctagttggagtgttttacccctataatcgaggtgccttgttcactgcccttgttgtcatttacgctctcacctcgggaatcgctggctatacggcaacctctttttactgccaactggaaggatcaaactgggtgaggaacctgttgttgacaggttgcctgttttgtgggccactgcttctgacattttgtttcctaaacacggtcgcaattggatacaatgccactgctgctctgcctttcggaacaatagtcgtgattctacttatctggactctagtgacatcgccattgcttgtattgggtggaattgctggaaagaacagcaaggctgagttccaagctccttgtcgtactacaaaataccctagagaaattcctcctctcccatggtacaggggaagccttcctcagatggcgatggctggttttctgccattcagtgcaatatacatagaactttactatatatttgccagtgtctggggtcacaggatttataccatatacagcatcttgttcatcgtctttattatattgattatagttactgctttcattactgtggcgttgacatacttccaacttgctgctgaagatcatgaatggtggtggaggtcgttcctatgcggtggttccacggggttgttcatctatggctattgcttatattactactatgcacgctcagatatgtcgggtttcatgcaaacatccttcttctttggctacatggcgtgcatttgctacggcttcttcctcatgctcgggactgttggtttccgtgcatcgctacttttcgttcgccatatctaccgatcaatcaaatgtgagtagatagaaggctctccaatattgatgtgtacggtaatgacatcctccgtcagaacagaaagatagaggataaaagtctgagattagggaaattacgccatgttatgtagtactagtatatcattttttcagatattctttgg

SEQ ID NO: 1212 - DNA, 2097 bp, Tripterygium wilfordii
tatctctttcgcttcactctgtgtgaatggtgaaatcgattttggactaaattaatcacacctccgtttcgttgttaaagagggagcgaaggagagaaaccaaaacatcgacgtgaaagagggagaggaatggcggagaaaatggtggcgatcatattcgtcgccgttttgatgctgatggcggcggatcaggtgaggtctgactcatcgaaccaccggtacaaggagggggatcaagtgcctctctatgccaacaaggtcggcccgttccaaaatccaagcgaaacgtaccgatactatgatcttcctttctgcttgccagatgacttgaaagagaagtcagaagctcttggcgaagtgttgaacggagatcgattagtcagtgccccctacaaacttgacttccttcgtgaaaaagagtctgagcgtgtttgcaagaaaacactaacaaaggaacaagtgtctcagttccgatctgccgtgaaaaaagactattactttcagatgttttatgatgacttacccatttggggattcataggaagggttgacaaggaaggcaaggatcccagtgactacaagtattaccttttcaagcatatctactttgatatcttttacaataaggaccgcatgatcgaaatcaatgtgcgaacagacaccaatgcagttgctgaccttacagaggataaagaagttgatgtggaattctattataccgtgaaatggaaggcaacaaaaaccccttttgagaagagaatggaaaaatactcgcagtcatcttcatcgcctcatcatttggagatccattggttttcaattataaattcatgcgtgacagttctccttctaacagggttccttgctacaatccttatgcgagtacttaagaatgactttgtcaaatatgccaatgatgaggaatcagctgaagaccaggaagagactggttggaaatatatccatggagatgtatttaggtaccctaaatacaagtctctatttgctgctgctcttggttccggtacccaattatttactcttacgatattcatcttcatacttgcattgattggtgtgttttatccatacaaccgaggggctctattcactgcattggttgtcatatatgcacttacatctggaattgcaggttacactgcaacttccttctattgtcaactggaaggaatcaactgggtcaggaatctgttactgacaggatgtctcttctgtgggcctctgtttctcacattctgcttcctaaatacagttgcaattgcttacaatgccactgctgctcttccatttggcacaattgtggttattgtacttatatggacacttgtgacgtcacctttgttggtgttgggtgggattgctggaaagaatagcaagcctgagtttcaagctccttgccgcactactaaatatcccagggaaattcctcatttgccatggtaccgtggaacaattcctcagatggctatggcagggtttcttcccttcagtgctatatatattgaactttactacatattcgctagtgtttgggggcacaggatttatactatatacagtatcttgtttattgttttcattatcctcctgatagtaactgctttcattaccgtggctttgacttatttccaacttgctgctgaggaccatgagtggtggtggagatctttcctctgtggcggatcaaccggcttatttatctatgcctattgcttatattattaccatgcgcgctccgatatgtctggcttcatgcagacctcatttttctttggttacatggcttgcatctgctatggcttctttctcatgcttggcgctgtaggtttccgtgcagctttactttttgttcgtcacatatataggtctatcaagtgtgagtaggtagtttgtctttcattaaagaagtcgcccagaggcgccatgtgtagagaagtgtgtgacagtaattttgtagcgtagcttgtatcaaaaggtggaatgaatgttcatttgatgtctttcttttgaaaaagtattttagattacaatttggattactatggggtaaaagtatgtcaccattactttatcaaa

SEQ ID NO: 1213 - DNA, 2625 bp, Quercus alba
taacaactgagatttgagagaccagtccctctctctctctctttgtctggttctcgttttattattaattaattaaaaacctctttgccgattggatctcaaaaacaaaaccaaaaacaaacgagatctgtctctctttctgaaagggttttagagagaaagagagatatggagaagagtgtggcggtggtattgttgttaatggtgctgtttggtgcggatcaggtgtggtcgagtgcatccgatcaccgttacaaggaaggagaagcagtgcctctctatgccaacaaggtcggcccctttcacaatcccagtgaaacataccggtattttgatctcccattctgctctccagaaaatgtgaaagacaaaaaggaagctctcggtgaagtgctaaacggcgatcgtttagtgagtgctccctacaaacttgatttccgaattgagaaagattcagagcctgtttgcaagaaaacactctcgaaggaagaggtggctcgtttccgagatgccgtgaacaaggactactactttcagatgtattacgatgacttacccctttggggttttattggcaaggtcgaaaaagaaggcaaagagccaagcgactacagatattttctctataagcacattcagttcaacatcttttacaacaaagaccgcgtcatcgagatcaatgttcaaacagacgcacgcaatgtcgtcgacctcactgatgacaataaagacgaggtcgacgtcgatttcttatacactgtcaaatggaaagaaacaagcgtcccttatgagaagaggatggataagtactcacagtcttcttctcttcctcatcacctcgagatccattggttctccattataaattcttgtgtcacagtgcttcttctaactggctttcttgccaccatactcatgcgagtccttaaaaatgattttgttaaatatgcccatgatgaggaaacagctgaagaccaggaagagactggatggaaatacatccatggagatgtattcaggtatcccaagtacaagtctatatttgcagctgcccttggttctggtacccaactatttacccttacggtattcatttttgtactagcacttgttggtgtattttacccatacaaccgaggagctctatttactgcactggttgtcatatatgctctcacatcaggaattgcgggctatattgcgacctccttttactgtcagctagagggaacaaactgggttaggaatctaatgttgacgggatgcctcttttgcggacctctgtttcttatgttctgcttcctgaatactgtagcaattgcttataatgccactgctgctctcccatttggcacaattgtggtgatagttcttatatggacacttgtaacatcgcctttgctggtgttgggtgggattgctgggaggaatagcaaggctgaattccaagctcctgtccgcaccaccaagtatcccagagagattccacctttgccatggtaccggggaacgattccgcaaatggcaatggcaggctttctgcctttcagtgctatctacattgaactttactacatatttgccagtgtatggggtcacaggatttataccatatacagcatcttgtttattgtcttcatcattctcctgatagttactgctttcattactgtggcactgacatacttccaacttgctgctgaggaccatgaatggtggtggagatcttttctatgtggtggatcaactggcatctttatctatgcctattgcctgtactactactatgcacgctcagatatgtccgggtttatgcaaacctcatttttctttggttacatggcttgcatctgctatggtttcttcctcatgcttggaactgtaggtttccgtgcagctttactatttgtgcgtcacatttatcgatccatcaagtgtgagtagatggttgatcctcgtcaagagtcgtttgccatgtttttcccacttttatataggcaatgaagagaaattaagttccaaaggtaattttgtagcgcctcatgtattaaaagcagaagcaaggttcgttagatttcttgcttccgaagcagcatattggataacaagtgtgcttttgacagtacggcaaaaaagtttgtatcattactcaaatcaagactttgcaatacattcttttaatatcttctacccgtttattctaataatatctcactgggcgtgcaagtgctcccaatataggcagatttgactggttaatagtcttgcatatgctgttatcttctagttctagagttggaagtgattggcaaatggtaatttgtggtatgtatttggtttgattcctacctcacccccctctctatctatacctgactgaaaaaagaaacacgagatttctcaatttagtgagatgacaaattctcctttgtgtaatattactttcgtttaatcccataactgatactatttttattatcataaaatagatactccatagcatcaactacaagatcattatacgtttgaaattttctcaacttctgttattaatgtaacgtcatacattattttgtctcagttaattgcatcaactactatcttaatattctcacctagaacctt

SEQ ID NO: 1214 - DNA, 1990 bp, Arachis hypogaea
gtgagacatatcgatatttttgtatctaccattctgcctgccagatgatttgaaggagaagaaagaagctcttggtgaggtcttaaacggtgaccgtttagttagtgctccttacaagttagagttccagcaggataaggactccgtgccagtttgcaagaagacactgaagaaggaagatgtcgccaagttccgagcagcagttcgcaaagactactacttccagatgtactatgatgacttgcccatttggggtttcattggaaaagttgataaggagggaaaggatccaagtgattacaagtactacctgtacaagcacattcactttgacatatattataacaatgatcgcgtcattgagatcaatgtgcgaacggatccaaatgcacttgtggatgtcacagaggataatgaggttgaggtggagttcttgtatactgtgaagtggaaggagactaacacccccttcgagaagcggatggataagtactcacaatcatcatcgctaccccatcatttggaaatccactggttctcgattatcaactcatgtgtgacggtcctgctgctgactggtttccttgcaacaattctgatgcgggtccttaagaatgactttgtcaagtatgcccatgatgaggaagctgctgaggaccaagaagagactggttggaaatatattcatggagatgtatttagatttccaaaatacaagtctctatttgcagctgcccttggatctggtacccaattgtttacccttacggtattcatattcatcttggcacttgttggagtcttttacccatacaaccgaggtgctctgtttaccgcacttgttgtcatttatgctctcacttcaggaattgctggctatacagcaacatctttctactgtcaattagaaggatcaaactgggttaggaatcttctattgactgggtgcctcttctgtggaccattgtttctcacattttgcttcctgaacactgttgcaattgtttacaatgctactgcggccctcccatttggtacaattgtggttatagttctgatatggacactggtcacatctccattgcttgtgttgggtgggattgctgggaagaatagcaaggctgaatttcaggctccctgccgtacaaccaagtatccaagggagattccacctttgccatggtatcggggaacaattccccagatggcaatggccgggtttttgcccttcagtgcaatatacattgaactatactatatatttgccagtgtttggggtcacaggatttacaccatctacagtatactgttcattgtcttcatcattctcttgattgttactgctttcattactgtggcattgacttacttccagcttgctgctgaggatcacgagtggtggtggagatcattcctctgtggtggttcaactggcttatttatctatgcctactgtctgtattactactatgctcgctcggacatgtctggattcatgcagacgtcatttttctttggatacatggcatgcatatgctatggtttcttcttgatgcttggaactgtcggattccgtgcggctttactctttgtccgccacatatatcgatccatcaagtgcgagtaaggcattttgtcctgaccggtcatcatcacaggtcctttagaagagctgttgtcttcatttcataggcattctgtagaaaattatagtaattttggtgttcttttctgtactataaggggaagctgggttgggttgggttggttcggggttgtttctagcttccagggaaacttgttagatcaccacaaagggtgcttttggaaaaaacgtctgtactaccatatctttaaccaaacacttgcaataccttcattttcctctattttcgaacttttgcttcatatctccagttttttaatgcgtaaacacaactcagtttgataaatttgattatgttgaatccagaatacgttacttgtgaac

SEQ ID NO: 1215 - DNA, 2425 bp, Vitis vinifera
ctcccaaacgcaccccaaggcatataaaatagaaagaaattagccatctgcggtcgtttccctatcatctctgttcggttcagttgaaatctgaaatctcaaagaaatggagagggctatggcgattctggtggtcgccgttctgatcttactttgtggaagccaagtgagatccgatgcttccagtcatcgctacaaagctggagaggccgttccgctctacgccaacaaggtcggccccttccacaaccccagcgaaacctaccggtatttcgatcttccattctgcgtgccagctcatcttaaagagaagaaagaagctcttggtgaggtgttgaatggagatcgtcttgtcagtgctccatacaaacttgacttcctaagagagaaagactctgaagttgtttgcaaaaagaagcttaaaaaagaagaagttgctcagttccgagctgcagttgctaaggactattacttccaaatgtactatgatgacttgccaatatggggttttattggaaaggttgacaaggagggcaaagctgacccaagcgagtacaagtatttcttgtacaagcacattcaatttgatattcgttataacaaggatcgtgtgattgagatcaacgcccgaaccgaccctcattctatggttgacgtgacagatgataaggatgttgatgtggagttcatgtacactgtcaaatggacagaaactgatgctccttttgagaagaggatggagaagtactctcaaacttcttcaatgccacatcacttggagattcattggttctcaattataaactcttgcgtgacagtactcctcttaaccgggtttcttgcgacgattctcatgcgagtccttaagaatgattttattaagtatgctcatgatgaagaatcagccgatgaccaagaagaaactggatggaagtacattcatggtgatgtattccggtacccaaagtacaaatccttgtttgctgctgctcttggatctggcacccagttatttacacttacggtgttcatttttatacttgcattagtgggtgtattttatccatacaaccgaggagcacttttcactgcactggtggtcatctatgctcttacatctggcatagcaggatacacagcaacttctttctattgtcagcttgaaggaaccaactgggttaggaatctgctgctgacaggatgccttttctgtgctcctctgttccttacattctgcttccttaacactgttgcaattatttacagtgcaactgcagcactcccctttggcacaattgtggtaattgtccttatatggacattagtgacatcaccattgcttgtgttgggtgggattgctgggaaaaatagcaaggccgaattccaagctccttgccgcactacaaagtatccccgagagattccggcactgccttggtacaggagcactattcctcagatggcaatggcagggtttttgccttttagtgccatctacattgagctttactacatatttgctagtgtatggggtcacaggatctacaccatatacagcatcctgtttatcgtcttcattattcttctgatagtcacagcttttattactgtggctctgacatactttcaacttgctgctgaagatcatgaatggtggtggaggtcttttctttgtggtggatcaacaggcttgtttatctatggctactgcttgtattattactatgcacggtcagatatgtcaggtttcatgcaaacttcgttcttctttgggtatatggcttgcatctgctatggcttcttcctcatgcttggaactgtaggttttcgtgcatcattgctctttgttcgtcatatatacaggtctatcaagtgtgagtagtggtaggtggtattccaggcaaattcttctgtctttatattctatataaattgtcgtagagaaaggtctatgatttttgttattagaaggtagtttggagagtgcctcagatttcagaagaagctaatgtgataatgaagaatactttcgcaaatgggcctcctaaatccatgtccaagtgtttgcttggcttcctgaaagctgttgcacaataaagggatcagttgatgttagtgtggtatctgtaatctgagacaattttatttggggtagatgtttgtatcatcatcacttacaccttcaaactgcaaaatgaattctctcttttttttttttttttctttttctttgttctttttatataaattaagtcttactgacgaaacctgaatagcttgaattccttctcactaagacatatgattggtcaaatggctgggtttcatacacgcatggatggaacaattgatttggcagctataaaatatatgcactgacacccacaggttggcttctggtgtatttgtagtgttagcatgcagt

SEQ ID NO: 1216 - DNA, 2072 bp, Euphorbia peplus
cacacacagagagaagtctggttgagcaatgaaagcttaagtataccttacttgcattcttccctaagcaatgcccttttctacttaacctatttcctcctccacagatttctattttcatttcaaccaatcggaatgaatcttcataacgccgttaccattctcctcctctcccttcttatctcccacgtcacttccgacggctccgatcaccgttacaaggactccgattctgttcctctttacgccaataaggtcggcccctttcataaccccagtgagacgtatcgctattatgatctccccttctgtattccagatcacttgaaagagaaaaaagaagcacttggtgaggttttgaatggggatcgtttggttagtgctccctacaagctcaattttcgagaagataaagacactgcagttgtttgtcagaagaaacttactaaggaagaagttgctaagttccgatctgcagttgacaaagattattactttcagatgtactatgatgatttgcctatttgggggttcattgggaaggctgagaaggaaggcaaagatgatcctagtgaatataagtacttcctctataagcacatccagttcgatatcctttacaataaggaccgcgtgattgaaataaatacccggatggatccacatacgttgttggatttgactgaggacaaggaagtcgatgtggagttcgtttatactgtgaaatggaaggaaactgaaactccctttgagaagagaatggagaagtactcactgtcgtcttcgttgcctcatcacctggaaattcattggttctcgattataaactcgtgtgtgactgtacttcttttgactggttttcttgctaccattcttatgcgtgtcctaaagaatgactttatgagatatgctcaagatgaggaagcatctgatgaccaggaggagactggatggaaatacatccatggtgatgtgtttaggttcccaaagtacaagtctttgtttgcagctgcccttggttctggaacccagttgttcactctaactttatttattttcatgcttgctttggttggcgtgttttatccctacaatcgaggagctctttttacggcactggtggtcatatatgcacttacttcaggaattgctggatatattgctacctccttctattgtcaacttgaaggaaagaactgggtgaggaatcttttgctgacaggatgccttttctgcgctcccttgttcctcactttttgcttcctcaacactgttgccattgcttacagtgcaactgctgcattgccttttggtaccattgtggtaatagttctcatctggacattagtaacatcacccttgcttgtattgggtggtattgctggcaaaaatagcaagactgagtttcaagccccttgccgaaccacaaaatatcctcgtgagataccacaattgccttggtacagaagtgctctgcctcagatggcaatggctggatttttacctttcagtgctatctacattgagctatattacatattcgctagcgtttggggtcacaggatttacaccatctacagcatcctttttattgtcttcattatccttctgattgtcacagcttttataactgttgctttgacatacttccaacttgctgctgaagatcatgaatggtggtggaggtcttttctgtgtggtggatcaactgggttgtttatctatgcctactgcttgtattactactacgcacggtcagatatgtcgggcttcatgcaaacctctttcttcttcgggtacatggcttgtgtatgctatggctttttcctgatgcttggcacagtgggcttccatgcttccctgttttttgttcgccacatatacagatcgattaagtgtgagtagatatagcatgactggttctttgtattttgattctgctaaattgtatgagagctaagatgtaggatttttgttctataagaccaataaaggctaggctaagaccttgtattaaatcaaatcaatccgcttgtcctggcctttcatattaccatccaacagccttttta

SEQ ID NO: 1217 - DNA, 2123 bp, Papaver somniferum
gactatgggtttcttcaccgttactactgttctgataataatttcaactttagctgttcaagtaagatctgatggttctgatcaccgttacaaagctagagatccagttcctctctatgctaacaaggtcggcccattccataatcccagtgaaacgtatcggttttttgatctaccattttgttcaccatctcatgtaactgagaagaaagaagctttaggtgaagtgttgaatggggatcgtttagttagtgcaccttataaacttgatttcttagttgagaaggaatctgaagttgtatgtaagaagaaattaacaaaagaagaagtaatacagtttagaaatgcagttacaaaagattattactttcagatgtattatgatgatctaccgatctggggttttattgggaaagttgaaaaggatagtaaatctgatcctagtgagttcaaatattatctctataaacatattaattttgaaatcctatacaataaagacagggttattgaaattaatgttagaacggatccaaatgctttggttgatctcactgaggataaacctgttgatgctgaattcatgtataccgtgaagtggaaagaaaccgccactccttttgacaagagaatggataaatattcacaatcttcttctttacctcatcatttggagatccattggttctcaattataaactcctgcgtaactgttcttcttcttactgggtttcttgccactattcttatgcgggttcttaagaatgattttgtcaaatatgcacatgatgaggaagcagcagatgaccaagaagagactggatggaaatacattcacggtgacgtatttagataccctaaggggaagtctttgtttgctgcagctcttggttcgggcacccagctgtttgctcttaccatcttcattttcatacttgctcttgttggagtattttacccatacaaccgaggtgccctcttcactgctcttgtcgtgatatatgcacttacatctgggattgctggttacaccgccacctctttctattgtcagctggaaggaacaaactgggtgaggaatctgttattgacagggtgtctcttttgcggtcctttgttcctgaccttctgcttcctcaacacagtagctattgcctatagtgccactgctgcacttccattcggaacgattgtggttatagttctcatctggactctagtaacttcacctctgctggtattgggtggaattgcgggaaagaacagcaagtctgagtttcaagcgcccgttcgcaccacaaagtatcccagggaaattccaccattgccttggtaccgcagtactattccacagatggcaatggcagggtttttgccattcagtgctatttacattgagctatactacatatttgccagtgtttggggtcacagaatttacactatttacagcatcctcttcatcgtcttcattatcctcttaattgtcaccgctttcattactgtggcattgacatacttccaactagctgctgaagaccacgaatggtggtggaggtctttcttgtgcggtggatctactggcttatttatctatggttactgcttgtactactactacgcacgatcagatatgtccggcttcatgcaaacttcattcttctttggttacatggcttgcatctgttacggtttctttctcatgcttggcaccatcggtttccgcgcatctttactatttgtccgccacatatatcgatctatcaagtgcgagtagactggtgtcgtgaaaagaacgaacaaaaaagaaagtcagcttatcttgttagaaaatcaagtatggcgctttttctttctttctttttgttctccatataggttgtttctgttatagagaaggaaggaggttatatgatttttgttaaagggtagtctggaatggtactctgatcttggaaagcagaagagaattagggttttgaattgagaacatgttgtcatgagaggagaatattgtgtgttgacccgtcagaatgtctagttgatatatgggtatgtgggtgggtggtgccggtatgtaatccgggaaagacaaacaaggggactgtcctcttttagaagaa

SEQ ID NO: 1218 - DNA, 2359 bp, Solanum lycopersicum
ttcaaaagtcgacgttttgtttgaggttcaccctctacaaaaagcgcgtgaagtaaaatccaactccctctcctcctccatatctatttccccatttcatttctcagggaaatcgagatctgtgctcacacccccaccccctctaaaccccctacccctacccctacaaaattcatatatacaacattgatgtgcacaaaattcgtgaaggaaatggagaagatggcgttgtacgtcgtcgttttgctaatcatctgctatgcatcgccggcgagatcagacggttccgatcataagtataaatccggagatcaggttccactttatgctaataaagtcggtcctttccataatccgagtgaaacataccgcttctttgaccttcctttttgtactccagatcatgtaaaagagaagaaggaagcccttggtgaggtcttgaatggtgaccgattggtcagtgccccttacaagcttgactttttgtacgataaggactcagaaatagtttgcaagaagaagttgtccaaggaagaagtttctcaattccgcagcgctgttgctaaagactactacttccaaatgtattacgatgacctgcccatttggggtttcttagggaaagttgacaaggaaggaaagtctgaccccagcgagtacaaatactacttgtttaaacatcttcattttgagatcttttacaacgatgatcgtgtgattgagatcaatgcacgaactgatcctaatgccctggtagatattacagaggataaggaggttgatgttgacttcatgtatactgtaaaatggaaagagacaaaaacaccttttgataagaggatggagaagtactcacagtcttcctcgttgccgcatcacttggaaatccattggttctcaattatcaattcttgtgtgacagttcttctcttaactggttttcttgccacaattcttatgcgggtccttaagaatgactttgtcaagtatgcacatgatgaggaggcggctgatgaccaagaagaaactgggtggaaatacatccatggtgatgtgtttaggtacccaagtcacaaatccttgatggctgcagcacttgggagtggcacacagttattcacattgaccatctttattttccttctctcacttgttggtgttttctatccatacaaccgtggagctttattcacggcactggtcgtcatatatgctctcacatctggtattgcaggctatactgctgcctctttctattgccagctagaagggacaaactgggtcaggaatttgatattgaccggagccttgttttgtggacccctgtttctcacgttctgtttccttaacagcgtagcaattgcatacagtgctactgctgcactgccttttggaaccattgtggtcatctttctcatatgggctcttgtgacatcacctttacttgtattgggagggatagctggaaagaacagcagggctgagttccaagctccttgtcgaaccaccaaatacccaagagagatcccaccattaccttggtaccgcggaactctacctcagatggcaatggctgggtttttgcctttcagtgccatatatatcgaactttactatatatttgcaagtgtttggggtcacagaatttacaccatatacagcatcttatttatagtcttcatcattcttataattgtcactgcttttattaccgtggccttgacatactttcaacttgctgctgaagatcatgaatggtggtggagggctttcctttgtggtggatcgactggacttttcatctatggctactgcttgtattactattatgcccgttccgatatgtctggcttcatgcaaacctcattcttctttggatacatggcttgcatctgctatggtttcttcctcatgctggggactgtgggtttccgtgcagccctattttttgtccgtcatatataccggtcaatcaagtgcgagtaggaagctggtacgacgatcgtacagaatgctttacagatgtggtagggcaatgtggtatcccagaagaccttgtaggatctcttgagaatgatgaagcatgtattatcttacaccggaaagttaagaactttttgccatttttcatttacatctcagcaatttatatcgattaataggggtatattagagtttctgttccatattgcaacacaattatcctaatcttgtctagtattattcctttttactgcattggacaaactttgagctataaattgtactggtcccaagttccagaagattgtatcaaaaatgtgtcattcatttattttatgttctaaatctcgctttcaacttcaacgtattatttttt

SEQ ID NO: 1219 - DNA, 2308 bp, Papaver somniferum
gaagaaaatagaaagaaagaactaatgggtttcttcaccgttactactgttctgataataatttcaactttagctgttcaagtaagatctgatggttctgatcaccgttacaaagctagagatacagttcctctctatgctaacaaggtcggcccattccataatcccagtgaaacgtatcggttttttgatctaccattttgttcaccatctcatgtaactgagaagaaagaagctctaggtgaagtgttgaatggggatcgtttagttagtgcaccttataaactcgatttcttagttgagaaggaatcagaagttgtatgtaagaagaaattaacaaaagaagaagtaatacagtttagaaatgcagttacaaaagattattactttcagatgtattatgatgatctaccgatctggggttttattgggaaagttgaaaaggatagtaaatctgatcctagtgagttcaaatattatctctataaacatattaattttgaaatcctatataataaagacagggttattgaaattaatgttagaacggatccaaatgctttggttgatctcactgaggataaacctgttgatgctgaattcatgtataccgtgaagtggaaagaaaccgctactccttttgacaagagaatggataaatattcacaatcttcttctttacctcatcatttggagatccattggttttcaattataaactcctgtgtaactgttcttcttcttactgggtttcttgccactattcttatgcgggttcttaagaatgattttgtcaaatatgcacatgatgaggaagcagcagatgaccaagaagagactggatggaaatacattcacggtgacgtatttagataccctaaggggaagtctttgtttgctgcggctcttggttcgggcacccagctgtttgctcttaccatcttcattttcatacttgctcttgttggagtattttatccatacaaccgaggtgccctcttcactgctcttgtcgtgatatatgcacttacatctgggattgctggttacaccgccacctctttctattgtcagctggaaggaacaaactgggtgaggaatctgttattgacagggtgtctcttttgcggtcctttgttcctgaccttctgcttcctcaacacagttgctattgcctatagtgccactgctgcacttccatttggaacgattgtggttatagttctcatctggactctagtaacttcacctttgctggtattgggtggaattgcaggaaagaacagcaagtctgagtttcaagcgcctgttcgcaccacaaagtatcccagagaaattccaccattgccttggtatcgcagtactattccacagatggcaatggcagggtttttgccattcagtgctatttacattgagctatactacatatttgccagtgtttggggtcacagaatttacactatttacagcatcctcttcattgtctttatcattctcttaattgtcaccgctttcattactgtggcattgacatatttccaactagctgctgaagaccatgaatggtggtggaggtctatcttgtgcggaggatcaactggcttatttatttatggttactgcttgtactactactacgcacgatcagatatgtcaggtttcatgcaaacttcattcttctttggttacatggcttgcatctgttacggtttctttctcatgctcggcaccatcggtttccgtgcatctttactctttgtccgccacatataccgatctatcaagtgcgagtagactggtgtcatgaaaagaacgaacaaaaaaaaaggtctgcttatcttgttacaacaacagatatggcactttttttcttctttctttttgttctccatataggttgtttctgttatagagaaggaaggttatatgatttttgttaaagggtagtttggaaaggtaccctctgatcttagaaagcagaagagaattagggttttgaattaagaacatgttgtcaatgagaggtgaatattatgtgttgccccatcagaatgtttagttgatcattgtgtaatctggaaaagacaaacaaggggacggccctctttgagaagaagattttttttttttatcattctgtaactgcactcactgcaagacaatatttctatttctctttatatgtagcatatacggccatacggtctttccttttaattgattacctttacttttaccccaagtgttttgtaatttgtttgaaactcggtgttattgtagtttcctagtattaccaagccaatcc

SEQ ID NO: 1220 - DNA, 2079 bp, Brassica napus
agtcatcaccttttccgaaaggccttggaggactcacgtcaccggctccggagtcccacctcgacccacgcgtccgcccacgcgtgcggatctcacgtttgtccccttcgcagaaccaccatgagaataccgacgacgctgctcctcttcatcggagctctcatcttatccggcgccggaaatgtcagacccgacgcctccgatcaccgttacaaggaaggcgactccgttccgctctacgccaacaaggtcggcccgtttcacaatcccagtgagacgtatcggtatttcgatctgcctttctgtattccagagggtgtgaaagataagaaggaagctctaggtgaggttttgaacggcgacaggctcgttagtgctccatacaagctcaacttcagagatgagaaagactccgagacatactgcaaaaagaagcttagcagagaagaggtcgaacagtttcgaagagccgttgagaaagactattacttccagatgtactatgatgatttgcctatatggggattcattgggaaggttgacaaagatggcaaaccggatcccagcgagttcaagtatttcctctacaagcatattcagtttgagattttgtataatgaagaccgtgtgattgagatcaatgctagaatggatcctcattcccttgtggatgttactgaggataaggaagttgatgctgagtttatgtatactgtgaagtggaaggaaacagagactccttttgagaagaggatggataagtacgccatgtcttcttctcttccacatcacttggagattcattggttctctattatcaactcatgcgtcactgtcctgcttctgactggtttccttgcacaatcttgatgcgggtcctcaagaatgatttcatgaagtatgctcaagacgaggaagctgctgatgatcaagaggaaactggatggaagtacattcacggagacgtgttccggttcccaaaatacaaatctgtctttgctgcatctctcggtagcggtactcaactgttcactcttactatattcatcttcatgctttcacttgttggagtgttctatccatacaacagaggagcgctcttcacagctttggtcgttatctacgctctcacgtctggaatcgccggatacacagcctcctctttctactgtcaactcgaaggaaagaactgggtgagaaacttgttgctcactggaggtctcttctgtggcccgctcttcctcacattctgcttcctaaacactgtggcaatcgcctacagcgcaaccgctgctcttcccttcggaacgattgttgtgattgtccttatatggacactagtgacgtcacctttgcttgtactaggcggtatcgctggtaaaaacagcaaagcagagttccaagctccagtccgcaccactaagtatcccagggagatcccgcaactcccatggtacaggagtgctatacctcagatggccatggcaggttttcttcctttcagtgccatctacatcgagctgtactacatctttgccagtgtctggggtcaccggatctacaccatttacagcatcctcttcatcgtattcatcatcctcttgatcgttactgcttttataaccgttgcacttacttacttccaacttgccgctgaagatcacgaatggtggtggagatcattcctatgcggtggatcgactggtttattcatctacgcgtactgcttatactattactacgcgagatcagacatgtctggtttcatgcaaacatccttcttcttcggttacatggcttgcatttgttacggtttcttcctcatgcttggaactgttggcttccgcgcctctctctttttcgtccgccacatttaccggtcgattaaatgcgagtaaaagatgttgctaccaaccacagttcctcaaaaagcttcacttgcgagatttttttttggtagaacgaagaagagatcgttccttttggtagataaagacttattttacggtaacttgtgttgtttagtcgagtcgctcttttctctgcttatactatagtgttttctctctttgtgggtaa

SEQ ID NO: 1221 - DNA, 2243 bp, Elaeis guineensis
tcacgtcgagtggagagagagagagagagagagatgggaaagaaggccatgtctccggcggcggtggcggctctgctgctgtttttgggaatcgctggagtcgtgtcggacgcctccgatcaccggtacaagcctgaggatccggtccccctctacgccaacaaggttggccccttccaaaaccctagcgagacctatcggtactttgatctgcccttctgcaccccagaacacgtgaccgagaaaaaagaagatcttggtgaggttttgaatggggaccgcctggttgttgccccatacaagcttgattttcgtgtggatcaagattcccaagtggtctgcaagaaacagctcacaaaagaagatgtagccaagttcaggaatgcagtcatcaaggattactattttcagatgtattatgatgacctccctatttggggattcattgggaaggttgacaaggaaggaagggacccaagtgagtacaagtacttcctttacaagcatatccactttgacattctctacaacaatgaccgtgtgatcgagattaatgtccatacggatcccaatgcactggtggatgtcacggaggatagggatattgaagtagagtttctatattctgtgaagtggaaagagacaaccacacccttcagcaagagaatggataagtactcgcagtcctcttcgctgccacaccacttggagatacattggttctcaataataaattcatgtgtcacagttcttctcttgactggctttcttgccacaattctgatgcgagtgctgaagaatgatttcgtcaagtatgctcatgatgaggagtcagcagatgaccaggaagagactgggtggaagtatatccatggggatgtctttaggttcccaaagaacaagtcactttttgctgcttgtcttggttctggcactcagttatttgctctcacggtttttatttttattcttgcactggttggggtattctacccttacaatcgtggagctctttttactgctctggtggtcatctatgcacttacgtcaggcgttgctggttacactgctacctctttctattttcagcttgaagggacaaactgggtgaggaatttgcttttgacaggatgcctgttctgtgggcctctcttcctgatgttttgcttcctgaatactgttgccattgtttatagtgctactgcagcattaccatttggcacaattgttgttattgctctcatatggacactggtgactgctcctttgcttgttttgggtggaattgctggtaaaaacagcaagacagagttccaagctccttgtcgtaccaccaagtatcctagagagattccaccattgccatggtatcgaggaactatcccacagatggcaatggctggctttctgccattcagcgccatctacattgagctttactatatatttgccagtgtgtggggccacaggatttacaccatctatagcattctctttatagttttcatcattctcctcgttgtcactgctttcattaccatagctttgacctactttcaactggctgctgaggatcatgaatggtggtggagggcattcctttgtggaggatcaaccggcttgtttatttacggatactgcttgtactactactatgctcgctcagatatgtcaggtttcatgcaaacttctttcttctttgggtatatggcgtgcatctgctatggtttcttcttaatgcttgggatggtgggcttccgtgctgccttgctgtttgtccgtcacatataccggtccatcaagtgcgagtagcctattcccgattgagatcaatacatgcatctctttttggttatgtaagctttgcttatagagaagaaaggcatatctgatgtgttaaagcctgaatttacatgcaaatcggaaccagcagcagcagcaacagttttagtaggatcattttttaggtacttaggcggtgaatcataatttttggtgggattgcccttcgatctgttctttttcctgcttccttttctctcctgtatcttgctggaaagtttgtatcaattcaagtacctgaatgtttcctgaaaaagtttccttctgatacccggatcgatgtagaggtcgtaattttgacgaacttatgtttgcatggattattctgtttgatgtactagctactagttacatttcaaagctactcgatgagaatcttataaatgggtctgtcaatttag

SEQ ID NO: 1222 - DNA, 1962 bp, Arabidopsis lyrata
aaactcagatctcacgattttcttccttcacataaacacaccatcatgagattaccaacgtcgctgctcctctttatcggagctctcatcttctccggcgccggaaatgtcagatccgatgcctcagaccaccgttacaaggacggcgactccgttcctctctacgccaacaaagtcggtccgtttcacaatcccagtgagacgtatcgctatttcgatctcccattttgtattccagatggtgtgaaagataagaaggaagctcttggtgaggttttgaatggggataggcttgttagtgctccatacaagcttaactttagagaggagaaagactcagatgtttactgccgaaagaagcttagcagagaacaagtcgaacagtttcgaagagctgttgaaaaagattattactttcagatgtattatgatgatttgcctatctggggattcattggaaaggttgacaaagagagcaaatctgatccgagcgagttcaaatatttcctctacaagcacatccaatttgagattttgtataacaaggatagagtgattgaaatcaatgctagaatggatcctcattcgcttgtggatcttactgaggataaggaagtcgatgctgagtttatgtacactgtgaaatggaaggaaactgagactccttttgagaaaagaatggacaagtatgctatgtcttcttctcttccacatcacttggaaatccactggttctccattattaactcctgcgtcactgtcctccttttgactggtttccttgcaaccatcttgatgcgggttctcaagaatgatttcatgaagtatgctcaagatgaggaagctgctgatgatcaagaggaaactggatggaaatacattcacggagatgtcttccgtttcccaaagcacaaatctctctttgctgcatctctcggcagcggtacccagttgttcactctgaccatcttcattttcatgctttcacttgttggagtgttctatccatacaaccgtggagcactcttcaccgctttggtcgtgatctacgctctcacatctggaattgccggatacactgcctcctctttctactgtcaactcgaaggaaagaattgggtgagaaatttgctgcttacgggaggtctcttctgtggcccactattcctcaccttctgtttcctaaacacagttgcaattgcctacagtgcaactgccgctcttccctttggaaccattgtagtgatcgtcctcatatggacactagtcacttcacctttacttgtgttgggtggtattgccggtaaaaacagcaaagctgagttccaagctccagtccgcaccactaagtatcctcgggagatcccgccactcccatggtacaggagtgctatacctcagatggccatggccggatttcttcctttcagtgccatctacatcgagctatattacatctttgccagtgtttggggccatcgtatctacaccatttacagcatcctcttcatcgtcttcatcatcctgttgatcgtcactgcttttataacagttgcccttacttacttccaactcgctgctgaagatcatgaatggtggtggagatcattcctatgtggtggatcgactggtctgttcatctacgcttactgcttatactattactacgcaagatcagacatgtccggtttcatgcaaacatccttcttcttcggttacatggcttgcatttgttacggtttcttcctcatgcttggaactgttggcttccgcgctgctctcctcttcgtccgccacatttaccggtcgattaaatgcgagtaaaactgttgctgccaatccaccttcccttacgatttttggtagaacaaagaagatgataatctgtcattaggtagataaagaagaagacttcttcgaagccagaaaccgaataccaaaatcgctctatgatcacatttt

SEQ ID NO: 1223 - DNA, 2167 bp, Manihot esculenta
catgaaaattccttctgcaattctccttctcgcgcttctagtctccttttctgtaactcacgtcaaatcggacgcctccgatcaccgctacaaggacggcgattctgttcccctttacgccaataaggtcggcccctttcacaaccccagtgaaacgtatcgctatttcgatctgcccttctgtgttccagaacacctgaaagagaaaacagaagctcttggtgaggtgttgaatggagatcgtttggtcagtgctccttacaaactcaactttagagatgagaaggacacagcagttgtttgccggaagaagcttacgaaggaggaagttgcacaattccgatctgcagttgacaaagactattacttccagatgtactatgatgatttgccaatttggggtttcataggaaaggttgacaaggaaggcaaagctgacccaagtgaatacaagtacttcctttacaagcatatccagtttgatgttctttataacaaggaccgtgtgattgaagtaagtacccggatggatcctcattcactgttggatctgacagaggacaagggagttaatgcagagtttctttatactgtgaaatggaaggaaacagatactcccttcgagaagagaatggagaagtactccctgtcttcttcactgccacatcacttggagatccattggttctcaattataaactcttgtgtgacagttctccttttaactggttttcttgctacaattctcatgcgggtcttgaagaatgacttcatgaagtatgctcaagatgaggaagctgctgatgaccaggaagagactggatggaagtacatccatggtgatgtatttaggtacccaaagtacaaatctttgtttgctgctgcccttggttctggcacccagttgtttacacttactgtctttatttttatgcttgccttggttggcgtattttatccatacaatcgaggagctctgtttactgcactggtggttatttatgcacttacttccggaattgctggatatactgcaacctctttatattgtcagctggaaggaaagaactgggtcaggaatcttttgctgacaggatgccttttctgtggacctctgttcctcacattctgcttcctgaacactgttgccataatttacagtgcgactgctgcattgccttttggcactattgtggtaattgtccttatatggacgctggtaacatctccattactcgtgttgggtggtattgctggcaaaaatagcaaggctgagtttcaagccccttgtcgaaccacaaaatatccccgggagatcccaatattgccatggtacaggagtgctcttcctcagatggcaatggctggttttctgccttttagtgccatctacattgagctttactacatatttgccagtgtttggggtcacaggatttacaccatctacagcatcctgtttattgtcttcattattcttctggttgtcacggctttcataactgttgccttgacatacttccaacttgctgctgaagatcatgaatggtggtggaggtcttttctctgtggtggatcaactggcctattcatctatgcttactgcttgtattactattatgcccggtcagatatgtctggcttcatgcaaacctctttcttcttcgggtacatggcttgcatatgctatggcttctttctcatgcttggtacggtgggtttccgtgcctctctgctctttgttcgccacatatacaggtcgattaagtgtgagtagttggttggaccttcctcatcttctttttctgtcagataaatatctgttatttttgttagaagttaggctcgagaatgctttgggtgtcagaagtgaaaaatatgaagctttcgccttggccatgcttttgatctctttcttgctttaggatttcttgggtatctttgatggggcatatagacattcagggtgtatgtaattatcatacataaaatatgaaaacgcctgtattgctgcatataccttcaggtctatagaagcagttttttccttctttttatttttttccctacacgttctttgaaattgaaacctattttcctgactactagctgatgtaaagatgcaaatttgtctgataaatgcatacgtctagtacattgccaacca

SEQ ID NO: 1224 - DNA, 2124 bp, Medicago truncatula
gttttgtttctttcttgttcgtattatctaatctaatctaatctgacagagaaggaaggaaagaagaaggtagagaagaaaatgggaagtagtagtgtcatatggatccacctgctgatctctcttctcgctgctactcacgtcagatccgatgcctccgatcaccgttacagcgacggcgatgccgttcctctttacgccaataaagtcggtccctttcacaaccccagtgaaacgtatcgttaccttgaccttccattctgtgttacaggtcacgagaaagaaaagactgaagcgcttggtgaggtgttgaatggagatcgccttgttagtgctccttatgaacttaagtttaagaaggagaaagactctacggttgtgtgcaagaagacactcacaagggagcaagttaatcagttccgagaggcagttaaaaaggactattatttccaaatgtattacgatgacttgccgatctggggatttattggaactgttgacaaagaaggaaaggcagatccgagcgagtataaatattttctttacaagcacattcagtttgatgttctgtacaacaaagatcgtgtgattgaaatcagtgcccgtatggaccctcattctgtggttgacctgactgaggacagggaagtggatgttgagtttatgtacacagtaaaatggaaggaaactgatattccttttgagaagagaatggaaaaatactctcagtcttcttctcttccacatcacttggagattcactggttctccatcataaactcctgtgtgacggttcttcttttgactggtttcctggcaaccattctcatgcgtgtcttgaagaatgattttatgaaatatgctcaagacgaggaagctgctgatgatcaagaggagacaggatggaagtacattcacggcgatgttttccggtttcctaagttcaagtccatatttgcagctgcccttggttccggcacccagttattcactctcacaatcttcatttttatgcttgcactggttggtgtattctatccctacaaccgaggagctttatttactgcacttgtggtcatatatgctctcacatctggaattgctggatatactgccacttccttctatattcaacttgaagggactaattgggttagaaacttattgctgacaggatgcctcttttgtggccctcttttccttatgttctgcttccttaacacagttgcaattgcttatagtgcaactgctgcccttccttttggcacaatttgcgtgatagtcctaatatggacactggtaacttcgccattacttgtgttaggtggaattgcaggtaaaaatagcaaaacagagttccaagcacctgtccgcactactaaatatccccgagaaattccacctcttccttggtacaggagcaccattccccagatggcaatggcagggtttctcccattcagtgccatctacatagagctgtactacatttttgctagtgtctggggccacaggatttacactatctacagcatactcttcatcgtctttattattctgttgatcgtcactgctttcatcactgtggctttgacatactttcaacttgctgcagaagatcatgaatggtggtggaggtcttttctttgtggtggatcaactggcttattcatctatggctactgcttgtattattactacgcaagatcagatatgtctggttttatgcaaacttcgttcttctttggctacatggcctgcatctgctatggcttctttctcatgctcggtagcgtaggtttccgtgcctccctgctctttgtccgccacatatacaggtccatcaagtgtgagtagttgtggttgaacgttttggtaagtttatattgtttctgttagttaatgagagaaggtctatgaatttcttttccttttttgtgtcataaagtaggtttatagtgtacctgataacaacagaagctttgactcctccatattagtgtcatgttatttctgctctttaattgcacaagcttgacacttgagtagattttggaaccatggggtttaaatgttttattactgtagttactgaaatttattttgaagtagattgtactaatt

SEQ ID NO: 1225 - DNA, 2185 bp, Arabidopsis thaliana
cgttgctctcaaaaatataaagcaaactcagatctcacgattttcttcttcctctcacattaacacacatcatcatgagattaccaacgacgctgctcctctttatcggagctctcatcttctccggcgccggtactgtcagatccgatgcctccgaccaccgttacaaggacggtgactccgttcctctctacgccaacaaggtcggcccctttcacaatcccagtgagacgtatcgctatttcgatctccccttttgtattccagagggtgtgaaagataagaaggaagctcttggtgaggttttgaatggggataggcttgttagtgctccatacaagcttaactttagagatgagaaagactcagaggtgtactgtaaaaagaagcttagtagagaagaagttgaacactttcgaagagctgttgaaaaagattattactttcagatgtattatgatgatttgcctatttggggattcattgggaaggtggacaaagagagcaaatctgatcctagcgagtttaaatattttctctacaaacacatccagtttgagattttgtacaataaggatcgggtgattgaaatcaatgctagaatggatcctcattcgcttgtggatcttactgaggataaggaagtcgatgctgagtttatgtacactgtgaagtggaaggaaactgagacttcttttgagaaaagaatggataagtatgctatgtcttcttctcttccacatcacttggaaatccactggttctccattattaactcctgcgtcactgtccttcttttgactggtttccttgcaaccatcctgatgcgggtcctcaagaatgatttcatgaagtatgctcaagatgaggaagctgctgatgatcaagaggaaaccggatggaaatacattcatggagatgtcttccggttcccaaagaacaaatctctctttgctgcatctcttggtagcggtacccagttgttcactctgaccatcttcattttcatgctttcacttgttggagtgttctatccatacaaccgtggagcactcttcactgctttggtcgttatctatgctctcacatctggaattgccggatacactgcctcctctttctactgtcaactcgaaggaaagaattgggtgagaaatttgctgctaactggaggtctcttctgtggcccactatttctcaccttctgcttcctaaacaccgttgcaatcgcatacagtgcaactgccgctcttccctttggaaccatcatagtgatcgtcctcatatggacactagtcacttcgcctttacttgtgttgggtggtattgccggtaaaaacagcaaagctgagttccaagctccagtccgcaccactaagtatcctcgggagatcccgccactcccatggtacaggagtgctgtaccgcagatggccatggctggatttcttcctttcagtgccatctacatcgagctatattacatctttgccagtgtttggggccatcgtatctataccatttacagcatcctcttcatcgtcttcatcatcctgttgatcgtcactgcttttataacagttgcccttacttacttccaactcgctgctgaagatcatgaatggtggtggagatcattcctatgtggtggatcgactggtctgtttatatatgcgtactgcttatactactactacgcaagatcagacatgtctggtttcatgcaaacatccttcttcttcgggtacatggcttgcatttgttacggtttcttcctcatgcttggaaccgttggcttccgcgctgctctcctcttcgtccgccacatttaccggtcgattaaatgcgagtaaaactgttgctgccaatcaccctcccccttacgatttttggtagaacaaagaagatgataatctgttcttaggtagataaagaagaagacttcttcgaagccagaaactgaataccaaatcgctctgtggtcacattttttttcctttttgttaaaatgttttgtggcagtttgttttctgtgatatgatttatagacgaaactatgtttgtttaggtgaagtctttctcttctctactactttagagagttatcttctttttttggtaattaattaagataactttgtaaccttttttttattgatctatatatattctaaagacgaaaaaa

SEQ ID NO: 1226 - DNA, 2125 bp, Medicago truncatula
gttttgtttctttcttgttcgtattatctaatctaatctaatctgacagagaaggaaggaaagaagaaggtagagaagaaaatgggaagtagtagtgtcatatggatccacctgctgatctctcttctcgctgctactcacgtcagatccgatgcctccgatcaccgttacagcgacggcgatgccgttcctctttacgccaataaagtcggtccctttcacaaccccagtgaaacgtatcgttaccttgaccttccattctgtgttacaggtcacgagaaagaaaagactgaagcgcttggtgaggtgttgaatggagatcgccttgttagtgctccttatgaacttaagtttaagaaggagaaagactctacggttgtgtgcaagaagacactcacaagggagcaagttaatcagttccgagaggcagttaaaaaggactattatttccaaatgtattacgatgacttgccgatctggggatttattggaactgttgacaaagaaggaaaggcagatccgagcgagtataaatattttctttacaagcacattcagtttgatgttctgtacaacaaagatcgtgtgattgaaatcagtgcccgtatggaccctcattctgtggttgacctgactgaggacagggaagtggatgttgagtttatgtacacagtaaaatggaaggaaactgatattccttttgagaagagaatggaaaaatactctcagtcttcttctcttccacatcacttggagattcactggttctccatcataaactcctgtgtgacggttcttcttttgactggtttcctggcaaccattctcatgcgtgtcttgaagaatgattttatgaaatatgctcaagacgaggaagctgctgatgatcaagaggagacaggatggaagtacattcacggcgatgttttccggtttcctaagttcaagtccatatttgcagctgcccttggttccggcacccagttattcactctcacaatcttcatttttatgcttgcactggttggtgtattctatccctacaaccgaggagctttatttactgcacttgtggtcatatatgctctcacatctggaattgctggatatactgccacttccttctatattcaacttgaagggactaattgggttagaaacttattgctgacaggatgcctcttttgtggccctcttttccttatgttctgcttccttaacacagttgcaattgcttatagtgcaactgctgcccttccttttggcacaatttgcgtgatagtcctaatatggacactggtaacttcgccattacttgtgttaggtggaattgcaggtaaaaatagcaaaacagagttccaagcacctgtccgcactactaaatatccccgagaaattccacctcttccttggtacaggagcaccattccccagatggcaatggcagggtttctcccattcagtgccatctacatagagctgtactacatttttgctagtgtctggggccacaggatttacactatctacagcatactcttcatcgtctttattattctgttgatcgtcactgctttcatcactgtggctttgacatactttcaacttgctgcagaagatcatgaatggtggtggaggtcttttctttgtggtggatcaactggcttattcatctatggctactgcttgtattattactacgcaagatcagatatgtctggttttatgcaaacttcgttcttctttggctacatggcctgcatctgctatggcttctttctcatgctcggtagcgtaggtttccgtgcctccctgctctttgtccgccacatatacaggtccatcaagtgtgagtagttgtggttgaacgttttggtaagtttatattgtttctgttagttaatgagagaaggtctatgaatttcttttccttttttgtgtcataaagtaggtttatagtgtacctgataacaacagaagctttgactcctccatattagtgtcatgttatttctgctctttaattgcacaagcttgacacttgagtagattttggaaccatggggtttaaatgttttattactgtagttactgaaatttattttgaagtagattgtactaatta

SEQ ID NO: 1227 - DNA, 2117 bp, Eutrema parvulum
gcgttcctccaaaatataaagcaaaatcagatctcacgattttccctcacagaaacaccatgaaaataccgacgacgctgctcctctttatcggagctctcatcttctccggcgccggaaatgtcagatccgatgcctccgaccaccgttacaaggaaggcgactccgttccgctctacgccaacaaggttggcccgtttcacaatcccagtgagacgtatcgctatttcgatctcccattctgtgttccagagggtgtgaaagataagaaggaagctcttggtgaggttttgaatggggaccggcttgttagtgctccatataagcttagcttcagagatgaaaaagactcagagacatactgcaaaaagaagcttagcagagaagaagtcgaacagtttcgaagggctgtcgaaaaggattattacttccagatgtactatgatgatttgcctatctggggattcattggaaaggtcgacaaagagagcaaagcagatccgagcgagttcaaatatttcctctacaagcacatccaatttgagattttgtataacaaggaccgagttatcgaaatcaatgctagaatggatcctcattcgcttgtggatctcactgaggacaaggaagtcgatgcagagtttatgtatactgtgaagtggaaggaaaccgagacctcgtttgagaaaagaatggataagtacgccatgtcgtcttctcttccacatcacttggaaatccactggttctccattataaactcctgcgtcactgtcctgcttttgaccggtttccttgctaccatcttgatgcgagtcctcaagaatgatttcatgaagtatgctcaagatgaggaagctgctgatgatcaagaggaaactggatggaagtacattcacggggatgtgttccgattccctaagtacaaatcactctttgctgcatctctcggtagcgggacccaattattcactctcaccatatttatcttcatgctttcacttgttggagtgttctatccatacaaccgaggagcgctcttcaccgctttggttgttatctacgctctcacttctggaatcgccggatacaccgcctcctctttctactgtcaactcgaaggaaagaactgggtgagaaatttgttgctcactggaggtctcttctgtggaccactattcctcaccttctgcttcttaaacaccgttgcaatcgcctacagcgcaaccgctgctcttccctttggaaccattgttgtgatcgtcctcatatggacactagtcacttcgcctttgcttgtattgggtggaatcgctggtaaaaacagcaaagcagagttccaagctccttgccgcaccactaaatatcctcgggagatcccgccactcccatggtacaggagtgctatacctcagatggccatggctggttttcttcctttcagtgccatctacatcgagctatattacatctttgccagtgtttggggccatcggatttatactatttacagcatcctcttcattgtcttcatcatcctcttgatcgttaccgcttttataaccgttgccctgacttacttccaacttgccgctgaagatcatgaatggtggtggagatcattcctatgcggtggatcgactggtttattcatctatgcgtactgcttatactattactacgcaagatcagacatgtccggcttcatgcaaacctccttcttcttcggatacatggcttgcatttgttacggtttcttcctcatgcttggaacggtgggcttccgcgccgctctcctcttcgtccgccacatttaccggtcgatcaaatgcgagtaaaagtgttgctgccaatcactccgtcaaaaagcttcccttacgattttttggtagaacgaagaagatgaaaaagagttccgtcctttaggtagataaagacttcttttaaagccagaaaccaaaaatatcaaatggctttaaggttttattttcttagggctgttttattataagtggtcaagttttttttgcctttctttttaaaatgtttgtgtgaaactagtgttttctctcttttttggggtaattaattaactacattgtatctttttttttctt

SEQ ID NO: 1228 - DNA, 2034 bp, Brassica napus
gagatctcacgattctcttcacctcacagaaacaccatgagcacaccgacgactctgctcctcttcctcggagctctcctcttctccgccgccggaattgtcagatccgatgcctccgatcaccgttacaaggaaggcgactctgtccctctctacgccaacaaggtcggcccgtttcacaatcccagtgagacgtatcggtacttcgatctccccttctgtgttccagagggtgtgaaagacaagaaggaagctctcggtgaggttttgaacggtgaccgtcttgttagtgctccatacaagctcaacttcagagacgagaaagactccgagacgtactgcaaaaagaagcttagcagagaagaggtcgaacagttccgaagagctgttgagaaagactattactttcagatgtactacgatgatctgcctatctggggattcattgggaaggttgagaaagagggcaaatctgatccgacggagttcaagtacttcctttacaagcacatccagttcgagattttgtataacaacgaccgggtgattgagatcaatgctaggatggatcctcattcgcttgtggatgttactgaggacaaggaagttgatgcggagtttatgtatactgtgaagtggaaggagactgagactcctttcgagaagaggatggataagtacgccatgtcttcttctcttccgcatcacttggagattcactggttctctattatcaattcgtgtgttactgtccttcttttgactggtttccttgcgacgatcttgatgcgtgtcctcaagaatgatttcatgaagtatgctcaagatgaggaagctgctgatgatcaagaggaaactggatggaagtacattcatggagatgtgttccggttcccaaagcacaaatctctctttgctgcatctctcggcagcgggactcagctgttcactctgaccatattcatcttcatgctttcacttgttggagtgttctatccatacaaccgaggagcactcttcacagctttggtcgttatctacgctctcacctctggaatcgccggatacaccgcctcctctttctactgtcaactcgaaggaaagaactgggtgaggaacttgttgctcactggaggtctcttctgtggcccgctcttcctcactttctgcttcctaaacaccgtggcaatcgcctacagcgcaaccgcagctcttccctttggaaccattgttgtgatcgtcctcatttggacactagtgacttctcctttacttgtattgggtggtatcgccggtaaaaacagcaaagcggagttccaagctccagtccgcaccactaagtatcccagggagatcccgccactcccgtggtacaggagtgctatacctcagatggccatggctggtttccttcctttcagtgccatctacatcgagctatattacatctttgccagtgtttggggtcacaggatctacaccatttacagtatcctcttcatcgtcttcatcatcctcttgatcgttaccgcctttataaccgttgcccttacttatttccagctcgccgctgaagatcacgaatggtggtggagatcattcctgtgtggtggatcgactggtttattcatctacgcgtactgcttatactattactacgcgagatcagacatgtctggtttcatgcaaacctctttcttcttcggttacatggcttgtatttgttacggtttcttcctcatgctcggaacagttggcttccgtgcagctctcctcttcgtccgccacatttacaggtcgattaaatgcgagtagaaacgttgctgccaaccacactcccttaaaaagcgtcgcgtatgatttttggtagaacaaagaagatgaaaccatgaaaaagagatctgttatgtaggtaactatgaaagcttgtgtgttgtttaggcgagtctctctttgttatgctatactatagtgtcttctctttctctttttggttaattaattaactacattgtatctttttcttatatatat

SEQ ID NO: 1229 - DNA, 1939 bp, Brassica napus
ggcggaattaataaagcacaaactgagatctcactgatttgaaggaagagaaaaaacgaaatgacgaagctgctcctcttactcggagctataatcctctccagcgtcggctatgtcagatccgacgcctccgaccaccgttacaaggagggagacatcgttcctctatacgccaacaaggtcggcccattccacaatccaagtgagacgtatcgttactttgatcttcccttctgtgttccagagggtgtgaaagagaagaaggaagctcttggagaggttctgaacggcgatcgtctcgtgagcgctccgtacaagctcaacttcagagaagaaaaagactcggaagtctactgcaagaagaagctaagcaaagaagaggtcagaaagttcagacaagccgttgagaaagactactacttccagatgtactacgacgatctccccatctgggggttcattggcaaagtcgacaaggagatcaaatccgatccgagcgagtacaagtactttttgtacaagcacatcgagttcgagattctgtacaacaacgaccgtgtgattgagatcagtgctaggatggatcctcactcgcttgtggatcttaccgaggataaagaagttgatgcggagtttatgtatacggtgaagtggaaggagactgagactccgtttgagaagaggatggacaagtactctatgtcttcttctcttccgcatcacctggagattcactggttctctattattaactcgtgtgtcactgtcctgcttttgactgggttccttgcaactatcttgatgcgagtcctcaagaatgatttcactaagtatgctcaagacgaggaagctgctgatgatctagaagaaactgggtggaagtacattcatggtgatgtgtttaggttcccaactcgcaactctttgtttgctgcattcgcttggtagtggcacacaattgtttaccctgaccatattcattttcatgcttgctcttgttggagtgttctacccttacaaccgaggagcactcttcaccgctttggttgtcatttacgctctaacctctggaattgctggatacacatccgcctctttctactgccaacttgaaggcaaaagctgggtgagaaacttgttactcactggatgtctcttctgtggtcctttactcctaaccttctgcttcctcaacaccgtagccatcacctacacagcaaccgcagcactaccctttggaaccattgtcgtgatcgtccttatatggactctagtaacatcgcctctactcgtcttaggtggcatcgccggtaaaaacagcaaagctgagttccaagcgccctgccgcacgaccaagtacccccgcgagatcccgccgctcccttggtacagaagcgctattcctcagatggccatggctggttttcttcctttcagtgccatctacatcgagctctactacattttcgctagcgtctggggtcaccggatctacaccatctacagcatcctgttcattgtcttcatcatcctcatcattgtcactgcttttataactgtcgccttgacttacttccagctcgctgctgaagatcaccaatggtggtggagatcattcctatgcggtgggtcgaccggtttgtttatctacgcctactgcttatactactactacgcacgatcagacatgtctggattcatgcaaacatcgttcttcttcgggtacatggcttgcatttgctacgggttcttcttaatgctcgggactgtcggcttccgcgctgcacttttcttcgttcgtcacatttaccggtctatcaaatgcgagtaagaagtctttatcttcttacgatggttctcttcttcttctgcctccttaagaatttttgctagaacaaagaaaagataaagagatgggttgttagaaagaagagagata

SEQ ID NO: 1230 - DNA, 2101 bp, Brassica napus
cgacgacgctgctcctcttcgtcggagctcttatcttcttcgccgccggaaacgtcagatccgatgcctccgatcatcgttacaaggaaggcgactctgtccccctctacgccaacaaggtcggcccgtttcacaatcccagtgagacgtatcggtacttcgatctaccattctgtgtcccagagggtgtgaaagataagaaggaagcttttggtgaggttttgaacggtgacaggctcgttagtgctccgtataagcttagcttcagagatgagaaagactctgagacgtactgcaaaaagaagcttagcagaaaagaagttgaacagttccgaagagctgtagagaaggattattactttcagatgtactatgatgatcttcctatctggggattcattgggaaggttgacaaggagagcaaatcagatccgagcgagttcaagtacttcctctacaagcacatccagttcgagattttgtataacaacgaccgagttatcgaaatcaatgctaggatggatcctcattcgcttgtggatctcactgaggataaggaagttgttgcggagtttatgtacactgtgaagtggaaggagacagagactcctttcgagaagaggatggataagtacgccatgtcgtcttctcttccgcatcacttggagattcactggttctctatcataaactcgtgtgttactgtcctcctcttgactggtttccttgcgaccatcttgatgcgagtcctcaagaatgatttcatgaagtatgcacaagatgaggaagctgctgatgatcaagaggaaactggatggaagtacattcacggggacgtgttccggttcccaaagcacaaatctttatttgctgcatcacttggtagcgggactcagttgttcactctcaccattttcatcttcatgctttcacttgttggagtgttctatccatacaaccgaggagcactcttcaccgccttggtcgttatctatgctctcacgtctggaatcgctggatacaccgcctcctctttctactgccaactcgaaggaaagaactgggtgagaaacttgttactcactggaggtctcttctgtggcccattattcctcaccttctgcttcctaaacaccgtcgcaatcgcctacagtgcaaccgcagctcttccctttggaaccatcgttgttatcgtccttatatggacactagtgacttcgcctttacttgtattgggtggcatcgccggtaaaaacagcaaagccgagttccaagctccagtccgcacaactaagtatccacgtgagatcccgccacttccatggtacagaagcgctgttcctcagatggccatggctggttttcttcctttcagtgccatctacatcgagctgtattacatctttgccagtgtttggggccatcggatctacaccatttacagcatcctcttcatcgtcttcatcatcctcttgatcgttaccgcttttataaccgttgccctgacttacttccaactcgccgcagaagatcacgaatggtggtggagatcattcctatgcggtgggtcgactggtttgtttatctacgcgtactgtttatactattactacgcgagatcagacatgtctggtttcatgcaaacatctttcttcttcggttacatggcttgcatttgctacgggttcttcctcatgcttgggactgttggcttccgtgccgctctcctcttcgtccgtcacatttaccggtcgattaaatgcgagtaaaactgttgctgccaaccacacactctcaaagcttcacttgcgattcttttgggtagaacaaagaagatgaagaaagagatccgtgctttaggtaagtagatgaagacgttgttttaaagccacaaaccgaaacatcaaatggctttttaaaggttttatatcttagggttattttactacaaatgctttaatttcttgtctcgtttttaacgtttatgttgaaacttgttttgtttaggcgagtctcttctaatataatgtttctctctttttgggtaattagttaactacattgtatctgtattgtttttcgtttcttgagttcactacat

SEQ ID NO: 1231 - DNA, 2008 bp, Brassica napus
gaagagaaaacgaaatgacgaagctgctcctcttactcggagctctaatcctctccagcgtcggctatgtcagatccgacgcctccgaccaccgttacaaggaaggagacatcgttcctctatacgccaacaaggtcggcccattccacaatccaagtgagacgtatcgctactttgatcttcccttctgtgttccagagggagtgaaagagaagaaggaagctcttggagaggttctgaacggcgatcgtctcgtcagcgctccatacaagctcaacttcagagaagagaaagactccgaagtctactgcaagaagaagctaagcaaagaagaggtcagaaagttcagacaagccgttgagaaagactactacttccagatgtactacgacgatctccccatctggggcttcattgggaaagtcgacaaggagatcaaatccgatccgagcgagtacaagtactttttgtacaagcacatcgagttcgagattctgtacaacaacgaccgtgtgattgagatcagtgctaggatggatccacattcgcttgttgatctcactgaggataaggaagttgatgcggagtttatgtatacggtgaagtggaaggagactgagactccgttcgagaagaggatggacaagtactctatgtcttcttctcttccgcatcacctggagattcactggttctctattattaactcgtgtgtcactgtcctgcttttgactgggttccttgcaactatcttgatgcgagtcctcaagaacgatttcaccaagtatgctcaagacgaggaagctgctgatgatctagaagaaactgggtggaagtacattcatggtgatgtgtttaggttcccaactcgcaactctttgtttgctgcatcgcttggtagtggcacacaattgtttaccctgaccatattcattttcatgcttgctcttgttggagtgttctacccttacaaccgaggagcactcttcaccgctttggttgtcatttacgctctaacctctggaattgctggatacacatccgcctctttctactgccaacttgaaggcaaaagctgggtgagaaacttgttactcactggatgtctcttctgcggtcctttactcctaaccttctgcttcctcaacaccgtagccatcacctacactgcaaccgcagcactaccctttggaaccattgtcgtgatcgtccttatatggactctagtcacatcgcctctactcgtcttaggtggcatcgccggtaaaaacagcaaagctgagttccaagcgccctgccgcacgaccaagtacccccgcgaaatcccgccgctcccttggtacagaagcgcgattcctcagatggccatggctggtttccttcctttcagtgccatctacatcgagctttactacattttcgctagtgtctggggtcaccggatctacaccatctacagcatcctattcatcgtcttcatcatcctcatcatcgtcactgcttttataactgtcgccttgacttacttccagctcgctgctgaagatcaccaatggtggtggagatcgttcttatgcggtgggtcgaccggtttgtttatctacgcctactgcttatactattactacgcacgatcagacatgtctggattcatgcaaacatcgttcttcttcgggtacatggcttgcatttgctacgggttcttcttaatgctcgggactgtcggcttccgcgctgcacttttcttcgttcgtcacatttaccggtctatcaaatgcgagtaagaagtctttatcctcttacgatggttctcttcttcttcttcggccttctaaagaatttttggtagaacaatgaaagataaagagataggttgttagaaagaagagagacacaataacaatgtcaatgtctgataatttcctgaaaaagcatctcttctctgtctctctcttcttctctcgttattttgggctacggaaattaaaattacttacgtgtatccttt

SEQ ID NO: 1232 - DNA, 2181 bp, Humulus lupulus
tagtctactagatctgaggattcagagagaatcaatggaggactctctcaagttcctcgttctcgcgctcctaatctcttgttgtgccacccacgttagctctgatggctcggatcaccgctacaaggataatgacgtcgtccctctctacgccaacaaggtcggccctttccacaaccccagtgagacgtatcgctacttcgatctgcccttctgttcaggaggtgatgtgaaggagaagaaagaagctcttggagaggtgctgaatggagatcgccttgttagtgctccttataaacttgagtttagaaaagagaaggaatctgaggttgcttgttcgaaaaagctctcaaaggaagatgttgctaagtttagggaagctgtgaaaaaggattactactttcaaatgtactacgatgacttgccaatctggggttttataggaaaagttgataaagatgtaaaaactgacccaagcgaagtcaaatattctctttacaagcatatccattttgacattctctacaataaagatcgtgtgattgaaatcagtgctaagactgatccttcatcagttgtagacttgacagaggacaaagaggctgatgccgatttcacatacactgtgaaatggaaggaaactgagattccttttgagaagagaatggacaagtattcacaatcgtcttcactgccccatcacttggaaattcactggttctcaatcataaattcatgtgttacagtgcttctgttgactggtttccttgcaacaatcctcatgcgggttttgaaaaatgatttcatgaagtatgcacaagatgaggaagctgctgatgatcaagaggagacaggatggaagtatatccatggtgatgtttttcggttcccaaagcacaaatcagtgtttgctgctgcccttggttctggcacacaattgttcactctcactatattcattttcatgcttgcattagttggtgtattttacccatacaaccgaggtgctttattcactgctttggtggtcatttatgcactcacatctggtattgcgggatacacagcaactgctttctattgtcagcttgaaggaacgaactgggtgagaaatctgttgcttacagggtgccttttttgcgggcccctgttcttcacattctgcttccttaacactgttgcaattgcttatagtgcaaccgcagctcttccttttggcactattgtagtcattgtccttatatggacattagtaacctcaccattgcttgtgttgggtggtattgctgggaaaaatagcaaagctgagttccaagctccttgtcgcaccacaaaatatcctcgggaaattccacccttgccttggtacaggggtacacttcctcagatggcaatggcagggttccttccttttagtgctatttacattgagctttactacatatttgcaagtgtttggggtcacaggatctacaccatctacagcattctgtttattgttttcatcatcctcttgattgtcactgcattcatcactgtggctttgacgtacttccaacttgctgctgaagatcatgaatggtggtggagatctttcctgtgcggtggatcaactggtctgtttatctacgcatactgcttgtattactactacgcccgatcagatatgtctggtttcatgcaaacctcgttcttcttcggttacatggcatgcatctgctacggcttcttcctgatgctcgggatggtgggtttccgtgctgcgctgctctttgttcgccatatttacaggtcgatcaagtgtgagtaagcattgttggccgatgctttcggtaaaatctgtgctgtgctggtttcttcttctgctgcatcaaagggaggaaggtctgtgatttttgttaggtggatttggtcatttaggaattctgctctgcgtttgctccagggtttagggatatattgggctctacttatgttgactgtatgtatttacaatgttaatgtggggaagagattgtataaccacatttttaccttactcgctgaaacgactttttccatgttagcaaaaagtgaccctctatttttatctctttacaccaattattttcccaccatggagattatttgaattatggagagaaaaaaaaaagagaatttaaagcgttgctttcagtatta

SEQ ID NO: 1233 - DNA, 2188 bp, Eutrema halophilum
ttgcgttcgtcccaaatataaagcaaaatcagatctcacgattttttcccttcaacagaaacaccatgaaaataccgacgacgctgctcctcttggtcggagctctcatcttctccggcgccgggaatgtcagatccgatgcctccgaccaccgttacaaggaaggtgactccgttccgctctacgccaacaaggtcggcccgtttcacaatcccagtgagacgtatcggtatttcgatctgcctttctgtgttccagagggtgtgaaagataagaaggaagctcttggtgaggttttgaatggggatcgacttgttagtgctccatacaagcttaacttcagagatgaaaaagactcggagatatactgcaagaagaagcttagcagagaagaagttgaacagtttcgaagggctgtcgaaaaggactactacttccagatgtactatgatgatttgcctatctggggattcattggaaaggttgacaaagagagcaaatcagatccgagcgagttcaaatatttcttgtacaagcacatccagtttgagattttgtacaacaaagaccgtgtgatcgaaatcaatgctagaatggatcctcattcgcttgtggatctcactgaggacaaggaagtcgatgcagagtttatgtacactgtgaagtggaaagaaaccgagactccttttgacaagagaatggagaagtacgccatgtcttcttctcttccacatcacttggaaatccactggttctccatcataaactcatgcgtcactgtccttctcttgactggtttccttgcaaccatcttgatgcgggtcctcaagaatgatttcatgaagtatgctcaagacgaggaagctgctgatgatcaagaggaaactggatggaaatatattcatggggatgtgttccggttcccaaagcacaaatctctctttgctgcatctctcggtagcggtacccaattgttcactctcaccatattcatcttcatgctttcacttgttggagtgttttatccatacaaccgaggagcactcttcactgctttggtcgttatctacgctctcacatctggaatcgccggatacaccgcttcctctttctactgtcaactcgaaggaaagaactgggtgagaaacttgttgctcaccggttgtctcttctgtggcccactattcctcaccttctgcttcctaaacacagtcgcaatcgcctacagtgcaaccgccgctcttccctttggaaccattgttgtgatcgtccttatatggacactagtgacttcgcctttgcttgtattgggtggtatcgccggtaaaaacagcaaagcggagttccaagctcctgtccgcaccactaagtatcctcgggagatcccgccactcccatggtacaggagtgctgttcctcagatggccatggctggttttcttcctttcagtgccatctacatcgagctttactacattttcgctagtgtctggggtcaccggatctacaccatctacagcatcctcttcatcgtcttcatcattctcatcatcgtgactgcttttataaccgtcgctttgacttacttccaactcgctgctgaagatcacgaatggtggtggagatcattcctatgcggtggatcgactggtctgttcatctacgcgtactgcttatactactactacgcaagatcagacatgtccggtttcatgcaaacctccttcttcttcggttacatggcttgcatttgttacggtttcttcctcatgctcggaaccgttggcttccgtgccgctcttctctttgtccgccacatttaccggtcgatcaaatgcgagtaaggtatggttgctgccaatcactttcctcacaaagctccccgtatgatttttggtagaacgaagaagatgaaaaagaagatccgtccttttaggtagataaaagacttgttttaaagccagaaaccaaatatcaagtggcttataaggtttgattttcttagggctatttgcttaagtttctttttcccttcttcttaaaatgtttctgtgacactttgtgttgtttagttgagtctcttttctctgcttctactatagtgttttctctcgctctctctttttctttttgtggtaattaattaactataatgtacgttttttctcatatattctaaagacgaaaa

SEQ ID NO: 1234 - DNA, 2251 bp, Brassica rapa
aattactttgcattgaagtctggggctgtatataagtatcgtcgtctccagttttccttgtgcggaattaataaagcacaaactcagatctcactgatttgaaggaagagaaaaaacgaaatgacgaagctgctcctcttactcggagctataatcctctccagcgtcggctatgtcagatccgacgcctccgaccaccgttacaaggagggagacatcgttcctctatacgccaacaaggtcggcccattccacaatccaagtgagacgtatcgttactttgatcttcccttctgtgttccagagggtgtgaaagagaagaaggaagctcttggagaggttctgaacggcgatcgtctcgtcagcgctccatacaagctcaacttcagagaagagaaagactccgaagtctactgcaagaagaagctaagcaaagaagaggtcagaaagttcagacaagccgttgagaaagactactacttccagatgtactacgacgatctccccatctggggcttcattggcaaagtcgacaaggagatcaaatctgatccgagcgagtacaagtacttcctgtacaagcacatcgagttcgagattctgtacaataatgaccgtgtgattgagatcagtgctaggatggatcctcactcgcttgtggatcttaccgaggataaggaagttgatgcggagtttatgtatacggtgaagtggaaggagactgagactccgtttgagaagaggatggacaagtactctatgtcttcttctcttccgcatcacctggagattcactggttctctattattaactcgtgtgtcactgtcctgcttttgactgggttccttgcaactatcttgatgcgagtcctcaagaacgatttcactaagtatgctcaagacgaggaagctgctgatgatctagaggaaactggatggaagtacattcatggtgatgtgtttaggttcccaactcgcaactctttgtttgctgcatcgcttggtagtggcacacaattgtttaccctgaccatattcattttcatgcttgctcttgttggagtgttctacccttacaaccgaggagcactcttcaccgctttggttgtcatttacgctctaacctctggaattgctggatacacttccgcctctttctactgccaacttgaaggcaaaagctgggtgagaaacttgttactcactggatgtctcttctgcggtcctttactcctaaccttctgcttcctcaacaccgtagccatcacctacactgcaaccgcagcactaccctttggaaccattgtcgttatcgtccttatatggactcttgtcacatcgcctttactcgtcttgggtggcatcgccggtaaaaacagcaaagctgagttccaagcgccctgccgcacgaccaagtacccccgcgagatcccgccgctcccttggtacagaagcgcggttcctcagatggccatggctggtttccttcctttcagtgccatctacatcgagctttactacattttcgctagtgtctggggtcaccggatctacaccatctacagcatcctattcatcgtcttcatcatcctcatcatcgtcactgcttttataaccgtcgccttgacttacttccagctcgctgctgaagatcaccaatggtggtggagatcattcctatgtggtgggtcgactggtttgtttatctacgcctactgcttatactactactacgcacgatcagacatgtctggattcatgcaaacatcgttcttcttcgggtacatggcttgcatttgctacgggttcttcttaatgctcgggactgtcggcttccgcgctgcacttttcttcgttcgtcacatttaccggtctatcaaatgcgagtaagaagtctttatcttcttacgatggttctcttcttcttctgcctccttaagaatttttgctagaacaaagaaaagataaagagatgggttgttagaaagaagagagataaaatgactatgtcaatgtctaattatttcctgaaatagcatctcttttctgtctctctcttcttctctcgttattttgggctacggaaattaaaattacttacgtgtatccttttctatatattttatggattgtaaaagatgatcataccttcggactattttttttttgtacgtaataaatgtcaaagctcttattcaaggtagtgatgatcgttgtgcaatatatgcatctgtttaaatctatttgataa

SEQ ID NO: 1235 - DNA, 2255 bp, Elaeis guineensis
attatggtgcacggaagaggtacatatcttcacgtaaaaggggtgtggaaagagagatgaggaagaaggcgatggctccggcggcggtggcggcgctgctgctgtgtttcgggatcgccggagtcgtatcgagcgcctccgaccaccgctacaagccggaggatccagtccccctttatgccaacaaggtcggccccttccagaaccctagtgagacctatcggtactttgatcttcccttctgcaccccagagcatgtgactgagaagaaagaagaccttggtgaagttttgaatggggaccgcctcgttgttgccccatacaagcttgatttccatgtcaatcaagattccaaagtggtctgcaagaagcagctaacaaaagaagatgtggcaaagttcaggaatgccgtaatcaaagactactattttcagatgtactatgatgaccttcctatttggggattcattggcaaggttgacaaggaaggcaaggacccaagcgagtacaagtacttcctttacaagcatatccactttgacattctctacaatgatgaccgtgtggtcgagattaatgttcatactgatcccaatgcactggtggatgtcacggaggatggcgatattgaagtcgagtttttatattctgcgacgtggaaagagacaaccacaccctttgagaagagaatggataagtactcgcagtcctcttcactgccacatcacttggagatccattggttctcgataattaattcatgcatcacagttcttctcttgactggatttcttgccacaattctcatgcgggtgctgaagaatgatttcgtcaagtatgctcatgatgaggagtcagctgatgaccaagaggagactgggtggaaatatattcatggggatgtctttagattcccaaagaacaagtcacttttttctgcatgtcttggttctggcacacagttattcgctctcacggtttttatttttattcttgcacttgttggggtattctatccctacaatcgtggagctctttttacagctctggtggtcatctacgcgcttacttcaggcattgctggttatactgctacctctttctatcgtcagcttgaagggacaaactgggtgcggaatttgctgttgaccggatgcctgttttgtgggcctctattcctgacattttgcttcctaaatactgttgccattgtttatagtgctactgcagcattaccatttggcaccatcattgttattgttctcatatggacgctggtgactgctcctttgcttgttttgggtggaattgctggtaaaaacagcaagacagagttccaagctccttgtcgtaccaccaagtatcctagagagattccaccattgccctggtatcgagaaacaattccacagatggcaatggccgggtttctgcctttcagtgccatctatattgaactttactacatatttgcaagtgtgtggggccacaggatttacaccatatatagcattctctttgtggttttcattattctcctcattgtcaccgctttcattactgtagcactgacctactttcagctggctgctgaagatcatgaatggtggtggaggtctttcctttgtggggggtcgactggcttatttgtttatggatactgcttatactactaccatgctcgctcagatatgtcaggtttcatgcaaacttctttcttcttcgggtatatggcttgcatctgttacggtttcttcctgatgctcggaatggtgggtttccgtgctgccttgctgtttgtccgtcacatatacaggtccatcaagtgcgaatagccagttcccagatttagatcagatacatgcttctcttttcggctatgtaagtgttgcttatagagaaaggaacatgtgagcgatgtgctaaaggctgaatttacatacagcttggcagcagcagcagcaacagtcaagtaggatcattacttctagaaataggtacttgggcctatgaatcataaagtttggtgggatagcccttgtggtaatttgtattttttctgcttccaattctctttcttatcatgctaggaggtttgtatccatccatgcatctggacatttcctcaaacagattccttctgatacctggatctatcatagaagtctagttttctatacttacgatgaacttatgtttgcatggataattctgtttgatgccagtggttacatgtcaaagctacatgcaaagaa

SEQ ID NO: 1236 - DNA, 2179 bp, Lotus japonicus
aaactcatctttcttcttcttcttctattcattcttcctttcattggtcgtttatcatctgattcagagagcagaagcagtggaagctagcatgggaagaagcaagtggtcaacgttgctcttcttcgttctcgcaatcctgcacggaactcacgtgagatccgatgcctccgatcaccgttacaaggacggtgacctcgttcctctctacgccaacaaagtcggtccattccacaaccccagtgaaacgtatcgatacctagacctgccattctgtgtaacaggtaaagagagagagaaaacggaagcacttggcgaggtgttgaatggagatcgccttgttagtgctccgtatgagcttgattttagaaaggagaaagactctaatgttgtgtgcaagaagaagctcacaaaggcgcaagttgctcagttccgagaagcagttaagaaggactattatttccaaatgtattatgatgacttgccaatctggggatttattggaacagttgacaaagaaggaaagaccgaccctagcgagtacaagtattttctttacaagcacattcagtttgatgttctgtacaacaaagatcgtgtgattgagatcagtgcccggatggatcctcattccgttgtggacctgactgaggacaaggaagttgatgttgagtttatgtatactgtaaagtggaaggagacagatacttcttttgagaagagaatggataaatactcgcagtcttcttctctgccacatcacttggagattcattggttctcaatcataaactcatgtgtaacagttcttcttttgactggttttctggcaaccattctcatgcgtgtcttgaagaatgactttatgaaatatgctcaagatgaggaagctgctgatgatcaggaggagacgggatggaagtacattcatggtgatgttttccggtttcctaagtacaagtccttgtttgcagcagcccttggttctggctctcagttattcactcttacaatcttcatttttatgcttgcactggttggtgtattttatccctataaccgaggagctttgtttactgcactggtggtcatttatgctcttacatctggcattgctggctacactgctacttccttctatattcaacttgaaggatctaactgggttagaaacttattgctgacagggtgcctcttttgtggccctcttttcctcatgttctgcttccttaacacagttgcaattgcttatagtgcaaccgctgctcttccatttggcacaattttggtgatagtcctaatatggacattggttacgtcgccattacttgtgttgggtggtattgcaggtaaaaatagcaaaactgagttccaagctcctgtccgcactacaaagtatccccgagagattccacctctgccttggtacagaagtaccattccacagatggcaatggcagggtttctccctttcagtgccatatacatagagctgtactacatttttgctagtgtatggggccacagaatttatactatctacagcatactcttcatcgtctttattattctgttgattgtcaccgcgttcatcactgtggctctgacatatttccaacttgctgctgaagatcatgaatggtggtggaggtctttcctttgtggtggatcaactggcttgttcatctatggttactgcctgtattattactatgcacgatcagacatgtctggtttcatgcaaacctcgttcttcttcggttacatggcctgcatctgctatggcttctttctcatgctcggtgctgtaggtttccgtgcctcgctgctctttgtccgccacatatacaggtccatcaagtgtgagtagttgtggttaaacctgttggtaagtttttactatttctattaggtgataagaaaaggtctaagatatgtttttgaggtcataaggtaggttctaaagtgtatctggtaacaagagaagcattgactactactctgaattagtgtcatgttatctctgctctttaactgcacaggcttgacacttgaggaagtttttggaaccgtggatttaattaatctttattgttgtagttactgaaatttatttgaagtagcttgtactaattttttgtctttctttctgctgtatgaaaattaccatttagtatta

SEQ ID NO: 1237 - DNA, 2131 bp, Citrullus lanatus
ctttattcactcgctctctctcgctctctctcgccggagatctcctgatcggagcatgaagaactctctgatcttcacccttttctggatcgcaatctgtgccactcacgtggcgccagatgcctccgatcaccgctacagcgaaggcgaccctgttcctctttacgccaataaggtcggcccatttcacaaccccagcgaaacctaccgctactttgatctgcctttctgctcaccaggtgatgtaaaagagaaaaaggaagctcttggtgaggtattgaatggagaccgtcttgttagtgcgccctacaagcttgactttagaagagagaaagatacagaagttgcttgcaaaagcaagttatcaaaggaagaagttgctcagtttcgagctgcagtgaagaaagattattactttcagatgtattatgatgatttgccaatctggggtttcattggaaaagttgatagggaaggcagggatgatccaagtgaatataaatatttcctgttcaagcacatccaatttgatatttcctacaataaagatcgtgtgattgaaattagtgctcgaatggatcctcattctgtggtggatctgacagaggacaaggatgttgatgtagagttcatgtatactgtgaagtggagggaaacagatactccctttgagaagaggatggataagtactcgcagtcttcttcattaccacatcacttggaaattcattggttttcaattattaactcatgtgtaacagttcttcttttgaccggttttcttgccactattctgatgcgtgtcttgaagaatgactttatgaagtatgcgcaagatgaggaagcagctgatgatcaagaagagactggttggaaatacatccacggcgatgtctttcgattcccaaaatacaaatcattgtttgctgctgcccttggttctggcactcagttgttcacccttacaattttcatatttatgttggcattagttggtgtgttttatccgtacaatcgaggagccttgtttactgccctggtggtcatatatgcactcacatctgggattgcaggatatacagcagcctcgttctattgccaacttgaaggaacaaactgggtgaggaatctgttgctgactggttgccttttctgtgggcctctttttgtcacattctgctttcttaacactgtggctattgtttacaatgcaaccgccgcacttccctttggcacaattgtggtgatagttctcatatggacattggtaacatcaccattgcttgttttgggtggtatagcaggaaaaaatagtaggattgaatttcaagctccatgtcgcactacgaagtatcctcgagagattccgcagttaccttggtataggagtactgttcctcagatggcaatggcaggatttctccctttcagtgctatatacattgagctttactacatatttgctagtgtctggggtcacaagatatacacaatttacagcattctatttattgtcttcatcatccttctgatagttactgctttcattaccgtggctttgacttactttcagctaaccgctgaagatcatgaatggtggtggagatcttttctatgcggtggctcaaccggtctgttcatctatggttactgcctgtactattattacgcacgctctgatatgtcgggtttcatgcaaacttctttctttttcgggtacatggcttgcatctgctatggcttctttctgatgctcggaactgtaggcttccgtgcagccctgttctttgttcgtcacatttacaggtcgatcaaatgcgagtagcagatttggtctcttttccttttcttttttgctggtgagggaggaagagaagacgttggttcagtttcatccctctgttttagttaaaggctcctctcttggctagtcgttaggtacagcatactgaatgttacctccattctgggatctttttcagattctaaagctttgacagattttggtcgttactacatgttaatctttgttctgcattttttttttttttttttttcattttctggacaaaaggatatcagttctgttaaattctatattatttattcatgtagagaaacagtgctaaat

SEQ ID NO: 1238 - DNA, 2086 bp, Eschscholzia californica
ctctctcattactccttcctctttctacgtttttataatatacaacttcaaccttttctctttctccattcgaaggaggagagagaaatggagagaaccatggcattcttccccattttaacacttctgctctctttcttcattatcggaacaagatctaatggatccgatcatcgttataaccctaaagacctagttcctttatatgctaacaaggtcggtccctttcacaatcccagcgaaacttatcgattcttcgatctacctttctgttctccaactgaagttactgagaaaaaagaagctcttggtgaaattttaaatggagatcgtttagttagtgcaccttataaaattgatttcttagttgataaagattctgaaattgtatgtaagaagaaattatctactgaagaagttattaaatttcgagatgctgttactaaagattattactttcagatgtactatgatgatttaccgatctggggttttattggaaaaattgataagaatggtagatctgatcctagtgagtataaatactatttgtataagcacattaactttgaagtcctttataataaggatcgtgttattgagattaatgttcgaaccgatccgagtgcgttggtggatctcactgaggataaacccgttgatgcggaatttatgtacactgtgaaatggaaagagacaactataccgttcgagaagaggatggaaaaatactcgcaatcttcttcgttgcctcatcacttggagattcattggttttcaattataaactcttgtgttactgttttactactaactgggtttcttgccaccattcttatgcgagtactcaagaatgattttgttaagtatggacacgatgaagagtcagctgatgaccaagaagagactggatggaaatacatccatggtgatgtatttaggtacccaaaggggaagtctttgttcgctgcagctcttggttccgggacccagttgtttgctcttaccatcttcatttttattcttgctcttgttggggtattttatccgtataaccgaggagcactcttcacggctcttgttgtcatatacgctttaacatctgggattgctggttatactgcaacctcgttctattgccagctcgaagggacaaactgggtgaggaatttgctgttgacaggatgcttgttttgtggtcctttgctccttgcgttttgctttctcaacactgtcgctattgcgtacagtgctactgctgcacttccttttggcacaattgtagtcatagttctcatatggactctggtaacctcacctttgcttgtgttgggtgggattgctggcaaaaacagtaaggctgagttccaagctcctgtacgcacaacaaagtaccctagagagattccatcaatgccttggtaccgtagcaccattccacagatggcaatggccgggtttttgccattcagtgctatttacatcgagctttactacatatttgccagtgtctggggtcacagaatttacaccatatacagcatcctctttattgtcttcatcatcctcttgattgtcactgctttcattactgtggctttgacatacttccaacttgcagctgaagaccatgaatggtggtggaggtctttcctatgcggaggatcaactggtttatttatctacggatattgcttgtattactactacgcacgatcagatatgtcaggcttcatgcagacttcattcttcttcggttatatggcttgcatctgttacggcttctttctcatgcttggtaccattggtttccgggcttccttattctttgttcgtcacatataccgatctatcaagtgtgagtagtagtgaatcagtcggtctccaatatcaattcaacaatcaggtatggttctcccgctgttttcttttccttcgttcttataggtttctattatagagaaagtttatatggtttttgttgaaaaggagtagttggattttgtaattctgagaatacaagacaagggttgttctccttgagaatctttttgtaagccttgtgtaactgctgatactataagaa

SEQ ID NO: 1239 - DNA, 2124 bp, Brassica rapa
gagagggtcggacacagattaataaagcacaaacacaaactcagatctcactgattcgaagagaaaaaacgcaatgacgaagctgctcctcttactcggagctctaatcctctccagcgtcggctatgtcagatcctacgcctccgaccaccgttacaaggaaggagacatcgttcttctatacgccaacaaggtcggcccatttcacaatccaagtgagacgtatcgttactttgatcttcccttctgtgttccagagggtgtgaaagagaagaaggaagctcttggagaggttctgaacggcgatcgtctcgtcagcgctccatacaagctcaacttcagagaagagaaagactccgaagtctactgcaagaagaagctaagcaaagaagaggtcagaaagttcagacaagccgttgagaaagactactacttccagatgtactacgacgatctccccatctggggcttcattggcaaagtcgacaaggagatcaaatccgatccgagcgagtacaagtacttcctctacaagcacatcgagttcgagattctgtacaataatgaccgtgtgattgagatcagtgctaggatggatccacattcgcttgttgatctcactgaggataaggaagttgatgcggagtttatgtatacggtgaagtggaaggagactgagactccgtttgagaagaggatggacaagtactctatgtcttcttctcttccgcatcacctggagattcactggttctctattattaactcgtgtgtcactgtcctgcttttgactgggttccttgcaactatcttgatgcgagtcctcaagaacgatttcaccaagtatgctcaagacgaggaagctgctgatgatctagaagaaactgggtggaagtacattcatggtgatgtgtttaggttcccaactcgcaactctttgtttgctgcatcgcttggtagtggcacacaattgtttaccctgaccatattcattttcatgcttgctcttgttggagtgttctacccttacaaccgaggagcactcttcaccgctttggttgtcatttacgctctaacctctggaattgctggatacacatccgcctctttctactgccaacttgaaggcaaaagctgggtgagaaacttgttactcactggatgtctcttctgcggtcctttactcctaaccttctgcttcctcaacaccgtagccatcacctacacagcaaccgcagcactaccctttggaaccattgtcgtgatcgtccttatatggacactagtcacatcgcctctactcgtcttaggtggcatcgccggtaaaaacagcaaagctgagttccaagcgccctgccgcacgaccaagtacccccgcgaaatcccgccgctcccttggtacagaagcgcgattcctcagatggccattgctggtttccttccgtttagtgccatctacatcgagctttactacattttcgctagtgtctggggtcaccggatctacaccatctacagcatcctattcatcgtcttcatcatcctcatcatcgtcactgcttttataaccgtcgccttgacttacttccagctcgctgctgaagatcaccaatggtggtggagatcattcctatgtggtgggtcgactggtttgtttatctacgcctactgcttatactactactacgcacgatcagacatgtctggattcatgcaaacatcgttcttcttcgggtacatggcttgcatttgctacgggttcttcttaatgctcgggactgtcggcttccgcgctgcacttttcttcgttcgtcacatttaccggtctatcaaatgcgagtaagaagtctttatcttcttacgatggttctcttcttcttctgcctcaagaacttttgctagaacaaagaaaagataaagagataggttgttagaaagaagagagatatattcctgaaaaagcatctcttctcagtctctcttcttctctcgttattttgggctacataaattaaacttacttacgtgtatccttttttatatattttatggattgtaaaagatgatcatacattcggactatttttttttttgtatgtaataaatgtcaaagctcttattcaa

SEQ ID NO: 1240 - DNA, 2311 bp, Lippia dulcis
cacagatgagatccagatctgtgcttttcttttttctcggtatatagatctgtgctcttcatttctctcactaaggtctctctaccccctctttttaacactgtaattacaaggtccactcacccataaaccctttgtgaaaaaaatggcgagaggagggtcgcacgtcggcgttctgctgctgctgttgtgcgccgcggtgccggcggtcagatcggatggatcggatcacaagtacaaagtcggagatccggtgccgctgtatgccaataaagtcgggccatttcacaaccctagtgaaacataccgctactttgatctcccattctgttctccaggcgatgtgaaagataaaagtgaagctcttggtgaagtgctaaatggagatcgtttggtcagtgctccatacaagcttgactttttggcggataaagagtctgaagtcatctgcaaaaagcagctctcaaagaaagaagttgctgaatttcggagagcggttgcgaaggactactatttccaaatgtactatgatgacttgcccatttggggttttctgggaaaggttgacaaggaaggcaaagctgatccaagcgaatacaaatattatctatttaagcatctccattttgaaattttctttaacaaggaccgtgtgattgagatcaatgcgcggacagatcccaatgctttggtggacctcaccgaagataaggaagttgatgtggagttcatgtattcagcaaaatggaaggaaactaacatagcttttgaaaagaggatggagaagtactctcagtcgtcttcacttcctcgccacttagagatccactggttttcaattatcaattcatgcgtgactgttctccttctgactggatttcttgctactattttaatgcgagtactgaaaaatgattttgtcaaatatgctcatgatgaggagacagcagatgatcaagaagaaactgggtggaaatacattcatggtgatgtttttaggttcccaaagtacaagtctttgttttctgctgcccttggaagtggcacacagctctttacactggctactttcatattcttgcttgctcttgttggtgtattttatccctacaacagaggagctcttttcactgcactagtggttatatatgctcttacatcaggcattgcaggctacacagcagcctcattctattgccagttggagggatcaaactgggtgcgaaatttattgttgactggaggtctcttctgtgggccgctttttctcacattttgcttcctcaacactgttgccattgcttatcatgctactgcagctctgccatttggtaccattgtggtgatctttctgatatgggctcttgtcacatcacctctattagttttgggagggattgctggaaagaatagtaaggcagagttccaagctccatgtcgtaccaccaaatatcctagagagattccaccactaccttggtatcgtggaaccctgcctcagatggctatggctggctttttgccttttagtgccatctatattgaactctactatatatttgcaagtgtctggggtcacaggatttacaccatttacagtattttgttcatagtcttcattatcctcctgattgtcactgcattcattactgtggcattgacatatttccaacttgctgctgaagatcatgaatggtggtggaggtcatttctatgtggtggatccaccggcttatttatttatggctattgcctgtattactactatgctcgttcggatatgtcaggattcatgcagacatcattcttctttgggtacatggcttgtgtatgttatgctttcttcctgatgctcggagctgtaggtttccgtgctgctctattctttgttcgccatatatatcgctccataaagtgtgaatgagaaatcagacagatctgtattctgtccagtattgacagaaggatgtgttggatggagattggttattgtattcgtcaagtggcatgcaactggggttcagtgaggattgaattttgcattttgtaggaaaatctccatttaggtacttgtggatgcattttctgagcacaaagtagtttaatatgactaataaatttgtatcagacactagtttagggttttatctattgttcaaatctctacttctatatatatactagtaccaaaagtgtgaacgactctaaaagtttctttgaaattttgattcgactagtttacatttcgatattgttagttttagtgacattccttgattgaattttggtatggataagtgaactgacttta

SEQ ID NO: 1241 - DNA, 2214 bp, Eutrema parvulum
tttgattgaagtctggtatataaatattgtcgttatttcctccatttttacttctccgaaatcaaaaaaaaaactcagatctcacgatttgggagagaaaacgcaatgaggacaccgacgatgctgctcctttatgttggagctctcatcttctccggcgctggctatgtcagatccgacgcctcggaccaccgttacaaggaaggagacatcgttcctctatacgccaacaaggtcggcccatttcacaacccaagtgagacgtatcggtattttgatcttcccttctgtatcccagagggcgtgaaggagaagaaggaagctcttggtgaggttctgaatggtgatcggcttgttagcgctccatacaagctcaacttcaaagatgaaaaagagtctgaggtctactgcaaaaagaagcttagtaaagaagaggtcaaacagttccgaaaagctgttgagaaggactactactttcagatgtattatgatgacctgcctatctggggattcattggcaaggttgacaaggagatgaaatctgatccgagtgaatacaaatatttcctgtacaagcacatccagtttgagattctgtacaacaaagaccgtgtgatcgaaatcagtgccagaatggatcctcactcgcttgtggatctcacagaggacaaggaagtcgatgcagagtttatgtacactgtgaagtggaaggaaacggagactgcgtttgagaaaagaatggagaaatactctatgtcttcttctcttccacatcacttggaaatccactggttctccattattaactcctgcgtcactgtccttcttttgactggattccttgcaactatcttgatgcgagtcctcaagaacgatttcatgaagtatgctcaagacgaggaagctgctgatgatcaagaagaaactggatggaagtacattcatggcgatgtgtttaggttcccaacgcacaattctttgtttgccgcatcacttggtagtggtacccaattgttcactctcaccatattcattttcatgcttgctcttgttggagtgttctatccatacaaccgaggagcattgtttaccgctttggtggtcatttacgctctcacttctggaatcgctggatacacatccgcctcgttctactgccaacttgaaggaaaaagctgggtgagaaacttgttactaactggatgtctcttctgtggccctttattcctaaccttttgcttccttaacaccgttgccatcacctacactgcaaccgcagcattaccctttggaaccattgtggtaatcgtccttatatggactcttgtcacgtcgcctttgcttgtcttaggtggtatcgcaggtaaaaacagcaaagcggagttccaagcgccttgtcgcacaaccaaatatccacgtgagattccgccactcccttggtacagaagcgctgtacctcagatggccatggctggttttcttcctttcagtgccatctacatcgagctttactacattttcgctagtgtctggggtcaccggatctacaccatctacagcatcctctttattgtcttcataattctcatcatcgtcactgcttttataaccgttgccttgacttacttccaacttgctgctgaagatcaccaatggtggtggagatcattcctatgcggtggatcgaccggtttgtttatctacgcctactgcttatactattactatgcccgatcagacatgtctggttttatgcaaacctcgtttttcttcggatacatggcttgcatttgctatggattcttcttaatgcttggaactgtcggcttccgtgcagcccttctcttcgttcgtcacatataccggtcgatcaaatgcgagtaagaagtctttatcttcttacgttggttttcttcttcttcttctgcctccttacgaattttgctagaacaaagaagataaagagataggctgttagaaagaagagagacagaagacaatgtctgattattttctaagaaatcatctcttctcattagaggttttactttaggtgagtctctcttcttctctttattttgggctacagaaaattaaagttacttctatccttttctatatattttacggattgtaaaagacgagtaatacttcagactgctttattcgagtttctttgtatctaataaatgtcaaaactcttttttttccctt

SEQ ID NO: 1242 - DNA, 1930 bp, Malus domestica
ctttctccagttgaaaaaatatcacttgcatcttatttttcttcttccccgacaggacaatgaagatgaacctcccgcccattctcctactcgcggctctaatcgcgtgcactgccactcacgtcagatccgacgcctccgaccaccgctacaacgaaggcgacgccgtccccctctacgccaacaaagtcgggcccttccacaaccccagcgaaacgtatcggtattttgatctgcccttctgctcagcaggtgatgtgaaggagaaaagggaggcgcttggagaggtgttgaatggagatcggcttgttagtgctccttataagcttgagtttagaaaagataaggactctgaggttgcttgtagaaggaagctgaccaaggaagaagttgcgcagtttcgaactgctgtgaaaaaagactactacttccaaatgtattatgatgacttgcccatctggggctttttgggaaaggttgacaaggaaggaaaaactgacccaagggaatacaaatattttctttacaagcatatccaatttgatgctcggtacaataaagaccgtgtgattgaaatcaccgccaagatggaccctcattctgttgtagacttgacggaggacaaggatgttgatgcggatttcatgtacagtgtgagatggtcggatactaacattccctttgagaatagaatggataaatactcacagtcctcttcactgccacatcacttggaaatccattggttctcaatcataaattcatgcgtcacagttctccttttgacgggttttcttgcaacgattctcatgcgagtcctgaagaatgatttcatgaagtatgcacaagatgaggaagctgctgatgatcaagaagagactggatggaagtacattcatggtgatgttttccggttccccaagaacaaatctttatttgctgcagcccatggttctggaacccagctgttcactctcacaatattcattttcatgctggcattggttggtgtattttatccatacaaccgaggagctttattcactgcgcttgtggtcatatatgcacttacttctggcattgcaggatatactgcaacttctttctattgtcagcttgaaggaaaaaactgggtgagaaacttgttacttaccgggtgccttttctgcgggcccctgttcctgactttctgcttccttaacactgttgcaattgtttatagtgcaactgcagctcttccttttggtactattgtggtaattgtccttatttggacattggtaacatcaccattgcttgtcttgggtggtatcgccgggaaaaacagcaaggctgaatttcaagctcctgtccgcaccacaaagtatcctcgagaaattccaactcttccatggtacaggacgaccattcctcagatggcaatggcagggtttctccctttcagtgcaatatacattgaactttactacatatttgccagcgtctggggtcacaggatctacacaatctacagcatcctgtttattgtatttattattcttttgattgtcactgcctttataactgtggctttgacatatttccaacttgctgctgaagatcatgggtggtggtggaggtctttcctatgtggtggatccactggcctcttcatctatggttactgcttgtattattactatgcccgatcagatatgtctggttttatgcaaacatcgttcttcttcggttacatggcctgcatttgctacggcttctttctcatgcttggcaccgtaggtttccgcgctgctttgctgtttgttcgtcacatttacaagtccatcaagtgtgagtaggtggtcggttgatcgttctgttgaataggttgtcgtttattccttttttatcataggaaaaagtcatgatttttgttagaacgtaggcgaga

SEQ ID NO: 1243 - DNA, 2165 bp, Arabidopsis thaliana
cctcttctcccaaataaaaaaagttactcagatctcacgatttgagcagaatacgcaatgaggacaccgacgacgattctccttcttgtcggagctatcctcttctccggcgccggctatgtcagatccgacgcctccgaccaccgttacaaggaaggagacaccgttcctctctacgccaacaaggtcggcccatttcacaatccaagtgagacgtatcgatattttgatcttcccttctgtatcccagagggtgtgaaagagaagaaggaagctcttggcgaggttctaaacggggatcggctagttagcgctccatacaagctcaacttcagagatgaaaaagagtctgaggtatactgcaacaagaagttgagtaaagaagaggtcaaacagttcagaaaagctgttgagaaggactactacttccagatgtactatgatgatctacctatctggggattcattggaaaggttgacaaggatatcaaatctgatccgagtgaattcaaatatttcttgtacaagcacattcagtttgagattctatacaataaggaccgtgtgatcgagatcagtgctagaatggatcctcattcgcttgtggatctcactgaggataaggaagttgatgcagagtttatgtacactgtgaagtggaaggaaactgagactccttttgagaaaagaatggagaagtactctatgtcttcttctcttccacatcatttggaaatccactggttctccattattaactcctgtgtcactgtccttcttttgactggattccttgcaactatcttgatgcgagtcctcaagaacgatttcatgaagtatgctcaagatgaggaagctgctgatgatcaagaggaaactggatggaagtacattcatggcgatgtgtttcggttccctactcacaattctttatttgctgcatcgctcggtagtggcactcaattgttcacgctcaccatatttattttcatgcttgctcttgttggagtgttctacccatacaaccgaggagcactctttaccgctttggtggtcatttacgctctcacttctggaattgccggatacacatctgcctctttctactgtcaacttgaaggaaaaagctgggtgaggaacttgttactcactggatgtctcttctgtggcccattattcctaaccttttgcttccttaacaccgtagccatcacctacactgcaaccgctgcattaccctttggaaccattgtggtgatcgtccttatatggactctagttacctcacctttactcgttttgggtggtatcgcgggtaaaaacagcaaagcagagttccaagcaccatgccgtacaaccaaatatcctcgtgagattccaccactcccttggtacagaagtgctattcctcagatggccatggctggttttcttcctttcagtgccatctacatcgagctttactacattttcgctagtgtctggggtcaccggatctacaccatctacagcatcttattcatcgttttcatcattctcatcatcgtcactgcttttataaccgttgccttgacttacttccaactcgctgctgaagatcaccaatggtggtggagatcattcctatgtggtggatcgaccggtttgtttatctacgcatactgcttatactattactacgcacgatcagacatgtcgggttttatgcaaacctcgtttttcttcggatacatggcttgcatttgctacggattcttcttaatgctcggaacagttggcttccgcgcagccctcctctttgtccgtcacatttaccggtcgatcaaatgcgagtaagaaggtctgtacaccaatcttcttatgttgatttccttcttcttcttctgccttcttacgaattttgcttagaacaaagaagataaagagataggttgttagaaagaagagagacacaaagacaatgtctgattattttctaaagaagcatctcttctcattagaggttttagcgagagtctctcttcttctctctttattttgggctacagaaattaaattacttgtatcctttctatatattttacctattgtaaaagactatcaatacctttgaattcgagtttctttgtatctaataaatttcaaaacacacatattttctcctt

SEQ ID NO: 1244 - DNA, 2134 bp, Prunus persica
ctcgtgtcttcttctccgtcaagaccatgaagaacctctcgacgattctcgtccttgccgttttaatcacgtgctgcgttacccacgtcagatcggacgcctccgatcaccgctacaatgatggcgacgccgtccctctctacgccaataaagtcggcccctttcacaaccccagcgaaacgtatcggtattttgatctccccttctgctcagcaggtgatgtgaaggagaagagggaagcacttggagaggtactgaatggagatcgtcttgttagcgctccttataaacttgagttcagaaaagagaaggacactgaagttgcttgtagaaggaagctgaccaaggaagaagttgctcagtttcgaactgctgtgaaaaaagactactacttccagatgtattatgatgacttgcccatctggggctttttgggaaaggttgacaaggaaggaaaaactgacccaagtgaatacaaatattttctatacaagcatatccaattcgaagttatgtacaacaaagaccgtgtaattgaaatcggggccaagatggatccccattctgttgtggacttgacagaggacaaggatgttgatgcagatttcatgtacactgtaaaatggagggaaacaaatattcccttcgagaataggatggataaatattcacagtcctcttcacttccacatcacttggaaattcattggttctcaatcataaattcatgtgtcacagttctcctcttgacgggttttcttgcaacgattcttatgcgggtcctgaagaatgatttcatgaagtatgcacaagatgaggaagctgctgatgaccaagaagagactggatggaagtacattcatggtgatgttttccggttccccaagcacaaatctttgtttgctgctgctcatggttctggaacccagctgttcactctcacaattttcatttttatgctcgcactagttggtgtattttatccatacaaccgaggagctttattcactgcacttgtggtcatatatgcactcacttctggcattgcgggatatactgcaacttctttctattgtcaacttgaaggaacaaactgggtgagaaatttattacttactgggtgccttttctgtgggcctctgttcctgacattctgcttccttaacactgttgcaattgcttatagtgcaactgcagctcttccttttggtactattgtggtaattgtccttatttggacattggtaacatcaccattgcttgtcttgggtggcattgctgggaaaaacagcaaggctgagttccaagctccttgccgcaccacaaagtatcctcgagaaattccccctcttccatggtacagaacgaccattcctcagatggcaatggcagggtttctccctttcagtgcaatatatattgaactttactacatatttgccagtgtctggggtcacaggatttacaccatctacagcattctgtttattgtttttattattcttttgattgtcactgcctttataactgtggctttgacctatttccaacttgctgctgaagatcatgagtggtggtggaggtcttttctatgtggtggatctactggcctcttcatctatggctactgcttgtattattactatgctcgatcggatatgtctggttttatgcaaacctcgttcttctttggttacatggcttgcatttgctatggcttctttctcatgcttggtaccgtaggctttcgtgccgccctgctgtttgttcgtcacatttataagtctatcaagtgtgaataggggggttgtttcttcctctttttattctattttttttaaatgataggaaaaagtctatgaattttgttagaaggtaggcgagagtgccttcagaagcggaagcagaggaagcaagcttttcgaagtaaaagcgcttggagacttgtcttttgcttttgcttcaggcatggggaacatgtgggcattgttggggtttcctttaactattttcactatatgtatctatggacgcgttaatatagggagcagccttgtatgtccacgttttacttgctctctgaaatgactttttccatgttactcgttcgtgagtttggtagccttatctaaaa

SEQ ID NO: 1245 - DNA, 1967 bp, Tabernaemontana elegans
aaaagaagcagcacagaatggcgagatggcaggtcgtcgttttcgtggtggtgtcaatggtcgccgtagtgagatctgatggctccgatcacaagtacaaagcgaaggatcaggtgcctctgtatgctaacaaggtcggacctttccaaaaccctagtgaaacttaccgcttcttcgatctcccattctgtttcccagatcatgcgaaagagaaaaaggaagctctaggtgaagttttgaatggagatcgcttagtcagtgcaccttataaacttgactttttagttgacaaagactctgagactgtttgcaaaaagaagttgaacaaagataaagttaaacaatttcgaagagcagtaacaaaggattactacttccaaatgtactatgatgacttgcctgtctggggtttcgtagggaaagttgatagggaaagcaaatctgatccaagtgaatacaagtattacctttttaagcatctgcatttcgagatattctacaacaaggaccgtgtgattgagatcaatgcacggactgacccaagtgcccttgtagacatcactgaggataaggatgttgatgtagagttcatgtactcagtaaaatggaaagagacaaatattccttttgaaaagaggatggagaaatactcaaagacctctgctttgccacaccacttggaaattcattggttctcaataattaactcttgcgtcacagttctccttcttactggctttcttgcaactattctcatgcgagttcttaagaatgactttgtcaagtatgctcatgatgaagaaactgctgatgaccaagaagaaactgggtggaagtacatacatggtgatgttttcaggtatccaaagtacaagtctctgtttgcagcagcccttggttgtggcactcagttattcatcatggcaactttcatttttattcttgcactagttggtgtattttatccatacaatcgtggagctctgttcactgcacttgttgttatatatgcacttacatctggaattgctggctatacggcagcttctttctactgccaacttgaaggaacaaactgggtgaggaatgtattattgactggggccctgttctgtggacccctctttctaacattttgctttctgaataccgtggcaattgcttataatgccactgctgcactgccatttggtaccattgttgtcatctttttgatttgggcccttgtgacctcacccttgctagttcttggcggggttgctggaaagaacgccaaggctgagtttcaagctccatgccgtaccacgaagtaccccagagagattccaccattgccttggtaccgcagcactctgccccagatggcaatggctgggtttttgcctttcagtgccatctatattgagctctactacatatttgcaagtgtttggggtcacaggatttacaccatttacagtatactatttattgtcttcattattctcctaatagttaccgctttcattaccgtggcattgacatatttccaacttgctgctgaagaccatgagtggtggtggaggtctttcctttgtggtggatcaactggactgttcatctatggttactgcttatactactattatgcacgctcagatatgtcaggcttcatgcagacctcattcttctttgggtacatggcgtgcatatgctatggtttctttcttatgcttgggactgttggtttccgtgcagcgctcttttttgtccgtcatatataccgatcaatcaagtgcgagtagcaagttgactgggtggtcttctttgctcatctttatgatattcatgttttcggtaggacaatattggctcaaagaggactaagtaggacattccttctcaaggcaaaacttgtaacatcttactatagcaccataggaaacctcgtcaaattttgcttctacaactcaacaaagttatattcg

SEQ ID NO: 1246 - DNA, 2170 bp, Eutrema halophilum
atcattcttcgaaataaaaaacaaactcagatctcacgatttggaggagaaaacacaatgaggacaccgacgctgctgctcctctttgtcggagctctcatcttttccggcgccggctatgtcagatccgacgcatcagaccaccgttacaaggaaggagacaccgttcctctctacgccaacaaggtcggcccatttcacaacccaagtgagacgtatcggtattttgatcttcccttctgtgtcccagagggtgtgaaagagaagaaagaagctcttggtgaggttctgaatggtgatcggcttgttagtgctccgtacaagctcaacttcagagatgaaaaagagtctgaagtgtactgcaaaaagaagcttagtaaagaagaggtcaaacagttccgaaaggctgtcgagaaggactactacttccagatgtattatgatgatctgcctatctggggattcattggaaaggttgacaaggatatcaaatctgatccgagtgaatacaaatatttcctgtacaagcacatccagtttgaaattctatacaacaaagaccgtgtgatcgaaatcagtgccagaatggatcctcattcgcttgtggatctcactgaggacaaggaagttgatgcagagtttatgtacactgtgaagtggaaggaaaccgagactccgtttgagaaaaggatggagaagtactctatgtcttcttctctaccacatcacttggaaatccactggttctccatcataaactcctgcgtcactgtccttttgttgactggattccttgcaactatcttgatgcgagtccttaagaatgatttcatgaagtatgctcaagacgaggaggctgctgatgatcaagaagaaactggatggaagtacattcatggcgatgtgtttagattcccaacgcacaattctttgtttgccgcatcacttggtagtggtacccagttgttcactctcaccatattcattttcatgcttgctcttgttggagttttctatccatacaaccgaggagcactctttaccgctttggtggtcatttacgctctaacttctggaatcgctggatacacatccgcctctttctactgccaacttgaaggcaaaagctgggtgagaaacttgttactcactggatgtctcttctgtgggcctttattcctaaccttttgcttccttaacaccgtagcgatcacctacactgcaaccgcagcattaccctttggtaccatcgtggtaattgtcctaatatggactctagtcacatcgcctttactcgtgttaggtggtattgctggtaaaaacagcaaagcagagttccaagcaccatgccgcacaaccaaatatccccgtgagattccgccactcccttggtacagaagcgctgttcctcagatggccatggctggttttcttcctttcagtgccatctacatcgagctttactacattttcgctagtgtctggggtcaccggatctacaccatctacagcatcctcttcatcgtcttcatcattctcatcatcgtgactgctttcataaccgtcgccttgacttacttccaactcgctgctgaagatcaccaatggtggtggagatcattcctatgcggtggatcgaccggtttgtttatctacgcgtactgcttatactattactacgcgcgatcagacatgtcgggttttatgcaaacatcgtttttcttcggatacatggcttgcatttgctacggattcttcttaatgcttgggactgttggcttccgcgcagctctccttttcgtccgtcacatttatcggtcgatcaaatgcgagtaagaagtctttacaccaatcttcttacgttggttttcttcttcttctgcctcacgaattttgctagaacaaagaggacaaagagataacttgttcgaaagaagagagacacaagacaaatgtctgattattttcttaaaatagcatccttctcagtagaggttttactttaggtgagtctctcttcttctctctttattttgagctacagaaattaaattacttgtatccaatttccatatatttttacgtattgtaaaagacgaaaatacctttttcactgctttattggagtctctttgtatctaataatagccataactcttatttttccctt

SEQ ID NO: 1247 - DNA, 2332 bp, Solanum phureja
ttcaaaagtcgacgttttgtttgagcttcactctccacaaaaagcgcgtgaagtaaaatccaactccctctcctcctccatatctatttccccatttcatttcacaggaagatcgagatctgtgctcacaccccaccccacctaaaccccctacccctgcccttcaaaattcatatatacaacattgatgtgcacaaaattcgtgaaggaaatggagaagatggcgttgtacgtcgtcgttttgcttatcatctgctatgcatcgccggcgagatcagacggttccgatcataagtataaatccggagatcaggttccactttatgctaacaaagtcggtcctttccataatccgagtgaaacataccggttctttgaccttcctttttgtactccagatcatgtaaaagagaagaaggaagctcttggtgaggtcttgaatggtgaccgattggtcagtgccccttacaagcttgactttttgtatgacaaggactcagaaatagtttgcaagaagaagttgtccaaggaagaagtttctcaattccgcagcgctgttgctaaagactactacttccaaatgtattacgatgacctgcccatttggggtttcttagggaaagttgacaaggaaggaaaatctgaccccagcgagtacaaatactacttgtttaaacatcttcattttgagatcttttacaatgatgatcgtgtgattgagatcaatgcacgaactgatcctaatgccctggtagatattacagaggataaggaggttgatgttgacttcatgtactctgtaaaatggaaagagacaaaaacaccttttgataagaggatggagaagtactcacagtcttcatcgttgccgcatcacttggaaatccattggttctcaattatcaattcctgtgtgacagttcttctcttaactggttttcttgccacaattcttatgcgggtccttaagaatgactttgtcaagtatgcacatgatgaggaggcggttgatgaccaagaagaaactgggtggaaatacatccatggtgatgtgtttaggtacccaagtcacaaatccttgatggctgcagcacttggtagtggcacacagttattcacattgaccatctttattttccttctctcacttgttggtgttttctatccatacaaccgcggagctttattcacggcactggtcgtcatatatgctctcacatctggtattgcaggctatactgctgcctctttctattgccagctagaagggacaaactgggtcaggaatttgatattgaccggagccttgttttgtggacccctgtttctcacgttctgtttccttaacagcgtagcaattgcatacagtgccactgctgcactgccttttggaaccattgtggtcatctttctcatatgggctcttgtgacatcacctttacttgtattgggagggatagctggaaagaacagcagggctgagttccaagctccttgtcgaaccaccaaatacccaagagagatcccaccattaccttggtaccgcggaactctacctcagatggcaatggctgggtttttgcctttcagtgccatatatatcgaactttactatatatttgcaagtgtttggggtcacagaatttacaccatatacagcatcttatttatagtcttcatcattcttataattgtcactgcttttattaccgtggccttgacatactttcaactcgctgctgaagatcatgaatggtggtggagggctttcctctgtggtggatcgactggactgttcatctatggctactgcttgtattactattatgcccgttccgatatgtctggcttcatgcaaacctcattcttctttggatacatggcttgcatctgctatggtttcttcctcatgctcgggactgttggtttccgtgcagccctattttttgtccgtcatatataccggtcaatcaagtgcgagtaggaagcaggtacgacggttttccgtctcgtacagaatgctttacagatgtggtagggcaatatggtatccaagaagaccttgtaggatcttaggatctcttgagatgatgaagcatgtattatcttacaccggaaagttaagaaccttttttttgccatttttcatttacagcttatatcgattaataggtatattagagtttctgttccatattttaatcctttgcaacacaattatcctaatcttgtctagtattattcctttttactgcattggacaaactttgagctataaattgtactggtcccaagtttcggaagattgtatcaaaaatgtgttttaaatctt

SEQ ID NO: 1248 - DNA, 2308 bp, Triphysaria pusilla
gtcttcaatttttattctactaaatgagatcgagatctgtgctcttcctctaagagtttctctcttattcatttagatctctgctactgaatccaaaacccaattctgtctcagcgtcctatttcttataaacgtaatggcgagaggagagtggccattcgttgttctgctgctgctgtgcatcgcaatcccggcggtaagatctgatggatctgatcacaagtacaaaatcggagattcggttccgctgtatgccaataaggttgggccatttcacaaccctagtgaaacgtaccgttactttgacctcccattctgctccccaggtaatgtgaaagataaaagtgaagctcttggtgaagttctgaatggagaccgtttggttagtgctccatacaagcttgactttttggttgacaaagagttggaagtaatctgtaagaggcagctgtcaaagaaagatgttgccgagttccgaagtgcggttgcaaaagactactattttcaaatgtactatgatgacttgccgatatggggtttcctggggaaggttgacaaggaaggcaaagttgatcctagcgagtacaagtattacctatttaagcatctccattttgaaatcttttataacaaggaccgtgtgattgagatcaacgcacgtacggaccccagtgctcttgttgaccttactgatggtaaggaagttgatgtggagtttatgtactctgcgaaatggaaggaaaccaacatagcttttgacaagaggatggagaagtactcacattcttcctcacttcctcggcacttggagatccattggttttcaattatcaattcatgtgtgactgttctccttcttactggattccttgccacaatattgatgcgagtacttaaaaatgatttcgtcaagtatgcccatgatgaggaaacagcagacgaccaagaagaaactgggtggaaatacattcatggtgatgttttcaggttcccgaaatacaaatctttattttctgctgcccttggaagtggcacacagctctttaccctggcgacctttatattcttactcgctcttgttggtgtattttatccctataaccgaggagctctttttaccgcactagtggtcatatacgcactcacatctggcattgcaggatatacagcagcctctttctattgccagttagagggaacaaattgggtccggaatttattattgactggaggcttgttctgtgggccactttttctcacattttgcttcctcaacacagttgccattgcttaccatgctactgctgcacttccttttggtacaattgtggtgatttttctgatatgggctcttgtgacatcacctttattagtgttggggggaatagcagggaagaatagtaaggcagagtttcaagctccttgtcgtaccacaaagtatccgagagagattccaccattgccttggtatcgtggaacacttccgcaaatggctatggccggatttttgccattcagtgccatctacattgaactctactatatatttgctagtgtttggggtcataggatttacaccatttacagtattttattcatagtattcattatcctcttgattgtcactgcatttataacggtggctttgacatactttcaacttgctgctgaagatcatgaatggtggtggaggtcattcctatgtggtggatcaactggattgtttatttatgcatattgcctttattactactatgcacgatcggatatgtcgggctttatgcagacctcatttttctttgggtacatggcttgtgtctgctatgcattcttcctaatgctgggggctgtaggttttcgtgctgctttgttctttgtgcgccatatatatcgctctataaagtgtgaatgagaaatcagaatactgcaatatttccaagctcgacagaggattataccgagtgggtgaatggttttatcatgtgactgattcgtaaaagtgaaagacagtcggattaatattgcatttaggttttacttgtttaagcatttcctgagaacaaagtacttattgtctaggacttatgaaaacttcatcaaacttttggaagttctttttttgttttttacttgtttttaaagatatcgaagggggtgatatgttcgctcttcagtgtcatgcccatttaacatctctttttatgctattagtgcatttttaggatgttattttgtgtaagatatctaccgatgggtttgtgttgagcttgggattaatagcaaatctcgaaataaaaatacgtatgtt

SEQ ID NO: 1249 - DNA, 2137 bp, Artemisia annua
aacaatcaaaatccactgtacccatcattcaaagatatgaaaatgtcggtgatacggtggtcattggtggttttaacacttttttatttaacaacgacatcaacagtccggtcagatgcatcagatcataaatataaatctggtgatgaagttcctatttatgctaataaagttggaccctttcataatcctagtgaaacataccgattttttgatctaccattctgcttaccagctcatttaaaggaaaagccggaagctcttggcgaagttctgaatggagatcgtttagtcagtgctccatacaagcttgactttatggttgaaaaagactctgaaattgtttgcagaaaaacactgacaaaggcggaagtagctaaattccgaagtgctgttaccaaggattattattttcaaatgtactacgatgacttgcctttctggggatttcttggaaaggttgaaaaggacaaaactgaccctagtgaagaaaagtattacctctttaagcatcttcacttcgagatcctctacaacaaagatcgggtcatagagataaatgcaaaagccgatcctaatgctgtggtggatcttactgaagacaaggaagttgaggtggaattcatgtacaccgtcaggtggaaagaaaccactattccatttgagagtagaatggaaaaatactcccaatcttcttcgcaaccacatcacctcgagatccattggttttcaatcatcaactcatgtgtcacagttctcctcttaaccggtttccttgccaccattcttatgcgagtcctcaagaacgactttgtcaagtatgctcatgacgaggaggcagctgatgaccaagaagaaactgggtggaagtacattcatggtgatgtattcaggtaccccaagtacaagtccttgttcgctgctgcccttggttctggtacccagctatttgctcttgcgcttttcatctttatacttgctcttgttggtgtattctatccatacaaccgaggagctctttttaccgcactggttgtcatatatgctcttacttctgggattgctggctacactgccgcatccttttatcaccagctagaaggaactaactgggttaggaacttgttattgaccggctgcctgttctgcggacctctgtttctcactttctgtttcctaaacactgttgctattgcttatactgcaactgcggctctaccgttcggtactattgtggtgattgttttgatctggtctttggtgacatcaccattgctagtattggggggtattgcaggaaagaacagcaaggctgagtttcaggctcctgttcgcaccacgaagtatcccagagagatcccaccattgccttggtaccgcaagactgttcctcaaatggccatggctggttttcttccattcagtgctatctacattgagctttactacatatttgccagtgtgtggggacacaggatctatacaatttacagtatcttattcatcgtttttatcattctcttgattgttactgcctttatcaccgttgcgttgacatatttccaacttgctgccgaagaccatgaatggtggtggaggtctttcctatgtggtggttcaactggtgttttcatctatgggtattgcttgtattactactatgagcgttcggacatgtctggattcatgcaaacgtcatttttctttggttacatggcgtgcatttgttatggtttctttcttatgcttgggatggtcggtttccgtgcggcattgttctttgttcgacacatataccgctcaatcaagtgtgaatagacacactcaactttcgatattccgtactcagacaggagcccctgcttctgctaccgcccaatgtgaaagcttaaaggtaacgagaaccaacttacatgtcgcgaagatgttgaaggctgttctatccgtccaaattatgttatattaggtcaataagataaagtgatgtttaatatgttagttctcctgttgtttgtcttttgatttgaagataggaaggtagtttgaactataccggcccaatttttaacatatatatagaccaattttcgtttcgaactgtagtgtgtaattgtctcattatatgactatgatgaaa

SEQ ID NO: 1250 - DNA, 2160 bp, Helianthus annuus
cggcgggggtacagatcggatctattggtatccaatccaacttaccaaacacgtcaaaatgtcggtgatacggtggttgacggtggccctgctactcgcattttgcactaacaaagttcaatccgatgcctcagatcacaaatacaaacccgctgatgaagtacctatatacgccaacaaagttggcccctttcataaccctagtgaaacataccgatattatgatctaccattctgtttaccagctcgtttgaaggagaaaccagaagctcttggtgaagtacttaacggagaccgtttagtcagcgctccttataagcttgacttcatggtcgaaaaagactcagaaatcgtttgcaaaaaaacacttacaaaagacgaagtatctaaattccgaaaagccgttaccaaagattactatttccaaatgtactatgacgacttacctttctggggctttttagggaaggttgaaaaagacaaaaatgaccctagtgaggaaaaatattacctgttcaagcatattcacttcgagatccactacaacaaagaccgcgtgatcgagataaacgcaaaagccgatcctagtgctgtcgtggatctcacagaagacaaagaagtcgaggtggagtttatgtacactgtaaggtggaaagaaactaacgttccgtatgagagtcggatggagaaatactcgcaatcttcttcacaaccgcatcaccttgaaattcattggttttcgattattaactcgtgtgtcacggttcttctcttaactggtttccttgccaccattcttatgcgagtcctaaagaatgattttgtcaagtacgcgcatgatgaagaggcagcggatgatcaagaggaaaccgggtggaagtacattcacggtgacgttttcaggtatccaaagtacaagtctctgtttgccgccgcacttggttccggtacccagctatttgctctcgcactttttatcttcatactcgctctagttggtgtattttatccatataatcgcggagccctctttaccgcactagttgtcatatacgctcttacgtccgggattgcaggctataccgcagcctcattttatcaccagctagaaggaactaactgggtgaggaacttgctattgaccggctgcttgttctgtgggcccctctttcttacattctgctttctaaacactgttgcaatcgcgtacactgcgactgctgctctacccttcgggacaatagtcgtgattgtgctaatatggacactggtgacttcaccgttgttagtattgggtggtattgctggcaaaaacagcaaggctgaatttcaagcacccgttcgcaccacgaaatatcccagagagatcccaccgttaccgtggtaccgtaaaaccgtccctcaaatggccatggccggttttcttccgttcagtgcaatctacattgagctttattacatctttgccagtgtgtggggccacaggatttataccatttacagcatcttatttatagtctttatcattcttctcattgttaccgcctttataactgtggcgttgacttatttccaacttgccgctgaagaccatgaatggtggtggagatcttttctatgtggtggttcgacgggtgttttcatctacgggtattgcttgtattattactatgagcgctctgacatgtcgggattcatgcaaacatcgtttttctttggttacatggcttgcatctgttacggtttctttctcatgcttgggacggtcggttttcgtgctgctttgttctttgttcgacacatataccgctccatcaagtgtgaatagaagctcaacgtttcatgctcagtcaggagctgcttctgctactgctgaatttggaagcataaaggcagcaagtaccgaattacgtttggcgaggatgctgaagaatgttgaaactgtcggattcccaatcatgttttattaggtcaataagataaaatgatgtttaatatgtttgttcttatgttgttttacttttgagtttgaaattaggaaagtagattgatctatacactcaattttgacacacatatatggacccttgtttgtaactgaactctatgtcgggtccgcttatacacatggcttctatgtcaaaattgagtgtatagatc

SEQ ID NO: 1251 - DNA, 2049 bp, Elaeis guineensis
tttcgggattgcaggagtggcggccgacgcgtccgatcaccgctacaaggccggggagccggtccctctctacgccaacaaggtcggccctttccacaaccccagtgagacgtatcggtactttgatctccccttctgcagtccagaacatgtgaaggagaaatcagaagctctcggtgaagtgctgaatggggaccgcctggtcgatgctccatacaagcttgacttccgtgtcgacctggattccaaagtggtgtgcacgaagaagctgaagagcgaagaggtggcccagtttagaagcgcagtcctcaaggactactacttccagatgtactatgatgacctccccatttggggattcattgggaaggttgacagggaaggcaagactgatgagaatgagtacaagtactacctttacaggcatatccactttgacgtcctatataatggtgaccgagtgattgagatcaatgcccacaccgatcccaatgcattggttgatgtcactaaggacagggaaatcgaggtggagttcttgtattcagtgaagtggagggagacaagcacaccctttgagaaccggatggataagtattcacagacttcatcactgccgcatcacttggaaattcattggttctcaataattaactcatgtgtcacggttcttctgctgaccggattccttgccacgattctcatgcgggtgctaaagaatgactttgtcaagtatgctcatgatgaggaatcagctgaagaccaggaagagactggatggaaatatatccatggggatgtctttaggttcccaaagcacaagtcactctttgctgcctgtgttggttctggcactcagctatttgctcttacaattttcatatttattcttgctttagttggggtgttctacccttacaatcgaggtgctcttttcactgctctggttgtcatctacgcacttacatctggcatagctggttatatttccacttctttctattttcagcttgaaggaacaaactgggtaaggaatttgctgatgacaggatgcctgtttttgcgggcctctgttcctgacattctgctttttgaacactgtggccattatctatagtgctacagcagcactcccatttggcactattttagtgattcttctcatatggacactggtaacttctcctctgcttgttctgggtgggattgctggcaagaacagcaaggcagaattccaggctccttgtcgcactaccaagtatcctcgagagatcccacctctgccttggtaccgaggaactattccgcagatggcaatggctggttttctaccctttagtgccatttatattgaactttactacatatttgcgagtgtctggggtcaccgaatttacacaatctacagcatcctctttatagtctttatcattcttctcattgtcactgccttcataactgttgcattgacctactttcaacttgctgctgaagatcatgaatggtggtggaggtcattcctttgcggaggatcaactggcctattcatatatgggtactgcttgtactattactatgcccggtcggacatgtcaggttttatgcaaacttcgttcttctttgggtacatggcttgcgtctgctatggtttcttcctcatgcttgggagcattggtttccgtgctgccttgttatttgtccgtcacatataccggtctatcaagtgtgaataatcagtcatccctggatcatgttaggtatgtttcttttttctattttatataggctttcctatagagagtgagagagttgctatttgtgaaaggtggttggactttacatgtggacatggagcagcagatggatttagagctggatcaccttttcttgaacaaaggctgagccttcaaaattgttattttggtggagtcaattgtattcatgttctttttgtattctgctcccttgaaagctccggttaatctgcaaagaagtttgtaccattacatggacctacatattctacaatatagttcctcttttcacacc

SEQ ID NO: 1252 - DNA, 2172 bp, Malus domestica
tcttcttctccgtcgagaccatgaagaacctcctgaccgctcttccactcgccgttctaatcgcgtgcaccgccactctcgtgagatcggacgcctccgaccaccgctacaacgaaggcgacgccgtccccctctacgccaacaaagtcggccccttccacaaccccagcgaaacgtatcgatattttgatttgcccttctgctcagcaggtgatgtgaaggagaagagggaggctctcggagaggtgttgaatggggatcggcttgttagtgctccctataatcttgagttcagaaaagataaggactctgaggttgcttgtagaaggatgctgaccaaggaagaagttgcacagtttcgaactgctgtgaaaaaagactactacttccaaatgtattatgatgatttgcccatctggggctttttgggaaaggttgacaaggaaggaaaaactgaccccagggaatacaaatattttctttacaagcatatccaatttgatgctcggtacaataaagaccgtgtgattgaaatcaccgccaagatggatcctcattctgttgtagacttgacagaggacaaggatgttgatgcggatttcatgtacagtgtaaaatgggcggatacaaacattcccttcgagaatagaatggataaatactcacagtcctcttcactgccacatcacttggaaattcattggttctcaatcataaattcatgcgtcacggttctccttttgacgggttttcttgcaacaattctcatgcgagtcctgaagaacgatttcatgaagtatgcacaagatgaggaagctgcggatgaccaagaagagactggatggaagtacattcatggtgatgttttccggttcccccagcacaaatctttgtttgctgctgcccatggttctggaacccagctgttcactctcacaatattcatctttatgctcgcactggttggtgtattttatccatacaaccgaggagctttattcactgcgcttgtggtcatatatgcactgacttctggcattgcgggatatactgcaacttctttctattgtcagcttgaaggaaaaaactgggtgagaaatttgttacttactgggtgccttttctgcgggcctctgttcctgactttctgcttccttaacactgttgcaattgcttatagtgcaaccgcagcccttccttttggtactattgtggtaattgtccttatttggacattggtaacatcaccattgcttgttttgggtggtatcgccgggaaaaacagcaaggctgagtttcaagcccctgttcgcaccacaaagtatcctcgagaaattccacctcttccatggtacaggactaccattcctcagatggcaatggctgggtttctccctttcagtgcaatatacattgaactttactacatatttgccagcgtctggggtcacaggatttacacaatctacagcatcctgtttattgtatttattattcttttgattgtcactgcctttataactgtggctttgacctatttccaacttgctgctgaagatcattggtggtggtggaggtctttcctatgcggtggatctactggcctcttcatctatgggtattgcttgtattattactacgcccgttcagatatgaccggctttatgcaaacgtctttcttcttcggttacatggcttgcatttgctacggcttcttcctcatgcttggcaccgtaggtttccgcgcggctttgctgtttgttcgtcacatttacaagtccatcaagtgtgagtaggtggtcagttgatgggtctttcgaccaggtcctcgtttcttccttttttatgataggaaaaagtcggtatttttgtcagaaggtaggcgagagggtgccttcagaagcagaggaatgggcgagctttcccgaatcaagtcctttcggggcctctgttgcgcgtttgcttcaggcgttcgggaaaatttggggaattagggttttgccttaactattcttcactagatgtatgtcgtagaatagaagtatgaatgtggggggaacagaagagattgctgtatggccacattttaccccactctctgaaatgactctttccatattagcttacccttactgttttttctaattagcattttacattcaaatcaaataa

SEQ ID NO: 1253 - DNA, 1808 bp, Solanum phureja
tgatacatttatatttatgtatacaacgaaaatggagaagaagatgacgagttacgtcgtcgttttgatcgctttgtgttgttgtgttactccggcgagatcggacggttccgatcataagtacaaggccggagatcaggttactatgtatgctaacaaggttggtcctttccataatccaagtgaaacgtaccgtttctttgatcttcccttctgtgcaccagctcatgtgactgagaaaaaggaagctcttggtgaagtcttgaatggtgatcgattggtcagtgctccttacaagctcgactttatgtacgacaaggactcagaaatagtgtgcaaaaagaagttgtccaaggaagaagtttctcaattccgtagtgccgttgcaaaggactattacttccaaatgtactatgatgacttgcccatttggggtttcttagggaaagtcgataaggagggaaaaacagatcccagcaagtacaaatattacctgtttaaacatctccatttcgagatcttttacaacaatgatcgtgtggttgagatcaatgcccgaactgatcctaatgccttggtcgatatcacagaggacaaggaagtagatgttgactttgtgtactctgtgaaatggaaggagtcaactactccttttgagaagaggatggaaaaatactcacagtcgtcatcattgccacatcacttggaaatccattggttctcaattatcaactcctgtgtgacagttcttctcttaactggttttctcgcaacaattcttatgcgcgttcttaagaatgactttgtcaagtatgcacatgatgaggaggcagctgatgaccaagaagaaactgggtggaaatacattcatggtgatgtttttaggtatccgaagtacaaatcgttgttggctgcagcacttggttctggtacccaactctttacaatgaccatctttattttcattcttgcactagttggtgttttctatccttacaaccgcggagctttattcactgcactggttgtcatatatgctctcacgtctgggattgctggctatactgcatctgctttctactgccaactagaaggaacaaactgggtcaggaacttgatattgactggggctttgttttgtggacccctgtttctcacattctgctttcttaattccgttgctatcagctacactgccactgctgcgctaccttttggaaccattgtggtcatttttctaatatgggctcttgtaacatcacctttgctcgtcttgggagggatagctggaaagaatagcaaatctgagttccaagctccttgtcgtaccaccaagtatccaagagagatccctccatcaccttggtaccgtggaactatgcctcagatggcaatggctgggtttttgccttttagtgccatatatattgaactttactacatatttgcaagtgtttggggtcacagaatttacacaatttacagtatcttgtttatagttttcattatccttctaattgtcaccgcttttataaccgtggcattgacatacttccaacttgctgctgaagatcacgaatggtggtggagggctttcctttgtggtggatcaactgggctgttcatctacggatactgcttgtattactattatgcacgttccgatatgacagggttcatgcaaacctcattcttctttgggtacatggcttgcatctgctatggtttctttctcatgctcgggtctgttggtttccgtgcagccctattctttgtccgtcacatataccgatcaatcaaatgcgagt

SEQ ID NO: 1254 - DNA, 2256 bp, Fragaria vesca
tctcacttttcgtgtgacttgaatagagagaagaatcacactccgtccttcttttcttaatcacaaagaagcatgaagaacctctccaccattctcctcctcacggttttaatcacctgcagcgccaccaccaccgtccgatccgacgcctccgatcaccgctacaatgaaaacgacgtcgtccccctctacgccaataaggtcggccccttccacaaccccagtgagacctatcgctattttgatctgccattttgctcgccaggtgatgtgaaggagaagaaggaagctctcggggaggtgctgaatggggatcgtcttgtgagtgctccttacaagcttgagttccggaaagagaaagacactgaagttgcttgtagaaggaagctgaccaaggaggaagttgcggagtttcgaaaggctgtggaaaaggattactactttcaaatgtattatgacgacttgcccatctgggggttcttaggaaaggttgacaaggaagggaaaactgacccaagtgaatacaaatatttcctgtacaagcatatccagtttgaaattctctacaataaggaccgtgtgattgaaattggtgccaagatggatcctcattcagtcgtggacttgacagaggacaaggacgttgatgcagatttcatgtacactgtgaaatggagagagacaaatattccgtttgagaatagaatggataagtactcacagtcctcttcactgccacatcacttggaaattcattggttctcaatcataaattcctgtgtcaccgttctccttttgacgggttttctcgcaacaattctcatgcgagtcttgaagaatgatttcatgaagtatgcccaagatgaggaagcagctgatgaccaagaagagacaggatggaagtacattcatggtgatgttttccgatttcccaagtacaaatcgttgttttctgccgcccatgggtctggaacccagttattcaccctcacagtgttcatttttatgcttgcactggtcggtgtgttttatccatacaaccgaggagctctattcactgctcttgtggtcatatacgcactcacatctggcattgcgggatatacttcaaccgctttctactgtcagcttgaagggacaaattgggtcagaaatttattacttactgggtgccttttttgtgggcctctgttcctgacattctgcttccttaacacagttgcaattgcttatagtgcaactgctgctcttccttttggtactattgtggtaattgttcttatctggacattggtaactgcaccgttgcttgtcttgggtggtattgctgggaagaacagtaaggctgagttccatgctccttgtcgcaccacaaagtatcctcgagaaattccaactctgccatggtacaggacaactgttcctcagatggcaatggcaggatttctccctttcagtgctatatacattgaactttactacatatttgccagtgtctggggtcacaggatttacaccatctacagcattctgtttattgtttttcttattcttctgattgtcactgcctttataactgtggccttgacctacttccaacttgctgctgaagatcacgagtggtggtggaggtcttttctttgcggtggatcaactggcctatttatctatggttactgcttgtattactactatgcaagatcagatatgtctggtttcatgcagacatcgttcttctttggttacatggcctgcatttgctatggtttctttctcatgcttggaactgttggatttcgtgctgctttgttctttgttcgtcacatttacaagtccatcaagtgtgaatagcggggtagctggatctttttggtgaatggtccttgttcttcatttaaaacatggggggaaaagtctatgatttttggtagaggtagatggtagaagccttcagaagcaacagaggactcaaggtttcctatattaaaaggtgttttgaaccctttgtatggcgcttgcttcaggctttgggaagatgtggtgctcctgaactcttcttcactagtagtgtatctatatgacacgggaataacttgtattaaccacattttaccttactttctgaaggtgactttttcctatgtactccttatgaccttatttatctagctatttaacttttacctgttctttatttcggttcttacatttagtcgaagatatcagggaatacatgctgtaaagagttaaaagcgc

SEQ ID NO: 1255 - DNA, 2151 bp, Solanum phureja
tgtacctaaaagaagagtttcaaaggaagaaacaatctttggtattttgttttcttcttctgtatgtgagtaagaaaaaaaacagaaaaaaatggtgaggaagagtagtatggggtgtgggaattacgttgtcgtattggtgcttttgttctttggggctatgaaagtgagatcggattcatcagatcacaagtataaatctggagaagaagtccctttgtatgcaaataaagttggtccttttcataatccgagtgaaacatatcgctactttgatcttcctttttgttctccaggtcatgtaaaagataaaactgaagctcttggtgaggtgttgaatggagatcgtttagtcactgctccatacaaacttgacttcacaaatgatcgagaaaccgaggtagtttgcaagaagacattgtcaaaggaagaagttgcaagattccgtgatgctgttgccaaggactactacttccagatgttctatgatgaccttcctatttggggtttcatcggtaaggtagataaggaggggaaagctgaccccagtgagtacaaatattacctatttaaacatcttcattttgacatccatcacaataaagaccgtgtgattgaagtcaatgcacgaactgaccccaatgcgctagtggacataactgaagataaggaaattgatgtagacttcatgtactctgtaaaatggaaggaaacacacatccctttcgagaaaaggatggaaaagtactcgcagacttcagctttaccacatcatttggagatccactggttctctatcattaattcttgtgtcacagttttgctcttaactggtttccttgctacaattctgatgcgcgtccttaaaaatgactttgtcaaatatgcccatgatgaggaagcagctgatgaccaagaagaaactgggtggaagtacattcatggtgatgtatttaggtacccgaagcagaagtcactttttgcagcagccctgggttctggcacacagttgtttaccctggcaattttcatattcatacttgctcttgttggtgttttttacccctacaaccgaggagctcttttcacagctttggtggttatttacgctcttacatcaggaattgctggctatactgcagcatcattctattgccaacttgaagggaaaaattgggtaaggaacttgttgttgacaggaggtctgttctgtgggccgctgcttctaactttctgcttccttaattctgttgcaattgggtatcatgccactgcagcacttcctttcggtaccatcgtggtcattttcctcatatgggcccttgtgacatcaccattgcttgtcttgggaggaattgcaggaaagaatagcaaggcagaatttcaagctccaactcgaacaacgaagtatccaagagagataccacaattaccatggtatcgtggagctcttcctcagatggcaatggctgggttcttgcctttcagtgctatctacattgaactctactacatatttgccagcgtgtggggtcataggatttacacgatttacagtatcttattcatagttttcatcattctgatcattgtcactgcatttattacggtggctttgacatacttccaacttgccgcagaagaccatgaatggtggtggaggtcattcgtttgtggtggatcaaccggcttgttcatctatggctactgcctgtattactattatgcccgatcagatatgtcaggtttcatgcaaacctcattcttctttggttacatggcttgcatttgctatgccttcttcctcatgcttggaactgttggtttccgagctgctttgtttttcgtccgccacatataccgctcaatcaagtgcgagtaagatgcagaattccacattagcctggttcaaccggggcttgtgtttttggtgtaaaaatcgtcgtcgtgcttggagtagtgcaacacatgttagatccatttagaattggtgtggaacaacaaagcagaagaaaatatgttgacagaagaagttgaaatcagtgctctttttattgtgtttagaacaaagtctataaatagttttagcttcagcttaattttcctagttttaaccttcttaatatatagaatatggttctgttaattgca

SEQ ID NO: 1256 - DNA, 2197 bp, Solanum lycopersicum
acacacaacaaaggaaaattccactgtacctaaaaagagagtttcaaaggaagaaacaatctttggtatttttgttttcttcttctgtatgtgagtaaagaaaaaaatggcgaggaagagtagaatggggtgtgggaattacgctgtcgtattggtgcttttgttctttggggctatgaaagtgagatcggattcatcagaccataagtataaatctggagaagaagtccctttgtatgcaaataaagttggtccttttcataatccgagcgaaacatatcgctactttgatcttcctttttgttctccaggtcatgtaaaagataaaactgaagctcttggtgaggtgttgaatggagatcgtttagtcactgctccatacaaacttgacttcacaaatgatcgagaaaccgaggtagtttgcaagaagacattgtcaaaggaagaagttgcaagattccgtgatgctgttgccaaggactactacttccagatgttctatgatgaccttcctatttggggtttcattggtaaggtagataaggaggggaaagctgaccccagtgagtacaaatattacctatttaaacatcttcattttgacatccatcacaacaaagaccgtgtgattgaagtcaatgcacgaactgaccccaatgcgctagtggacataactgaagataaggaaattgatgtagacttcatgtactctgtaaaatggaaggaaacagaaatcccttttgagaaaaggatggaaaagtactcgcagacttcagctttaccacatcatttggagatccactggttctctatcattaattcttgtgtcacagttctgctcttaactggtttccttgctactattctgatgcgcgtccttaaaaatgactttgtcaaatatgcccatgatgaggaagcagctgatgaccaagaagaaactgggtggaagtacattcatggtgatgtgtttaggtacccgaagcataagtcactttttgcagcagccctgggttctggcacacagttgtttaccctggcaattttcatatttatacttgcgcttgttggtgtgttttacccctacaaccgaggagctcttttcacagctttggtggttatttatgctcttacatcaggaattgcaggctatactgcagcatcattctattgtcaacttgaagggaaaaattgggtaaggaacttgttgttgacaggaggtctgttctgtgggccgctgcttctaactttctgcttccttaattctgttgcaattggttatcatgccactgcagcacttccttttggtaccatcgtggtcattttcctcatatgggcccttgtgacatcaccattgcttgtcttgggaggaattgcaggaaagaatagcaaggcagaatttcaagctccaactcgaacaacgaagtatccgagagagataccacaattaccatggtatcgcggagctcttcctcagatggcaatggctgggttcttgcctttcagcgctatctacattgaactctactacatatttgccagcgtgtggggtcataggatttacacgatttacagtatcttattcatagttttcatcattctgatcattgtcactgcatttattacggtggctttgacatacttccaacttgctgcggaagaccatgaatggtggtggaggtcattcgtttgtggtggatcaaccggcttgttcatctatggctactgcctgtattactattatgcccgatcagacatgtcaggtttcatgcaaacctcattcttctttggttacatggcttgcatttgctatgccttctttctcatgcttggaactgttggtttccgagctgctttgtttttcgtccgccacatataccgttcaatcaagtgcgagtaagatgcagaattccacattagcctggttcaaccggggcttgtgtttttggtgtaaaaatcgtcaacgtgcttggagtagtgcaacacatgttagatccatttagaatttgtgtggagcaacaaagcagaagaaaatatgttgacagaagaagttcgaatcaatgctctttttattgagtttagaacaaacttacaaagagtctataattagtttttagcttcagcttaattttcctagttttaaccttcttaatatatagaatatggttctgttatttacatcctaagctgtttatgttcc

SEQ ID NO: 1257 - DNA, 2098 bp, Musa acuminata
ggactttgagcgctccgaacgcgagaggtggggactggggcggctaggcgatggatctgatccgggtgacggcgctgctgctgtgcttcggggtcactggcgtcgtgtcggacgcctccgaccaccgctacaagcagggggaccccgtccctttgtacgctaacaaggtcggccctttccacaaccctagcgagacatatcggtactttgatctgcccttctgtgttccagagcatgtaactgagaaaaaagaagcacttggtgaagttctgaatggggaccgtcttgttgaagccccatacaagctggacttccgcgtcgatcgtgactctgaaccgctttgcaagaagaagctcacgaaagaagatgttgccaagttcaggagcgcagtcactaaggactactacttccaaatgtattatgatgacctccctatttggggtttcataggaaaagttgacaaagaaaggaaagatctgagcgagtacaagtactacctctacaggcatatccactttgatatcctctacaacagtgaccatgtgattgagatttctgtgcacacagatcccaattctttggcagacctcactgaggacaaggatattgaagcgagtttcttttattctgtcaagtggaaggagacaaccacaccatttgaaaagaggatgaataaatactcccagacctcttcattgcctcatcatttggagattcattggttctcaattataaattcatgtgtcacagttcttctcttgactggatttcttgccacaattctcatgcgagtgctgaagaatgattttgttaagtatgcccatgatgaggagtctgctgaggaccaagaagagacagggtggaagtatatccatggtgatgtcttcaggtttccaaagaataagtcactgttggctgcttgtcttggttccggaacccagttatttgcccttacggtgttcatttttattctagcacttgttggggtcttttacccgtacaatcgtggggcactttttactgctcttgtggttgtctatgcactcacctctggaattgctgggtatactgcatcctctttctattgtcaacttgaagggacgaattgggtaaggaatgtgcttttgactggattcctcttttgtgggcctctgttccttacattctgcttccttaatacagtcgcaattgtgtatagtgctactgcagcactaccatttgggactatcgttgtcattgttctcatatggacactagtcacttcacctttgcttgttttgggtggaattgctgggaagaatggtaaaacagaatttcaagccccttgtcgtacaacaaagtatcctagagagatcccactgttaccctggtaccggagaactattccacagatggcaatggctggtttcttgcctttcagcgcaatctacattgaactttactacatatttgccagtgtgtggggtcacaggatttacatcatatatagcattctctttatagtcttcatcatcctcctcattgtcactgctttcatcactgtggcactgacctactttcagctagcttctgaagatcatgaatggtggtggaggtcttacctatgcggaggatcaactggcctatttgtatatgggtattgcttttactattactttgcacgctcagacatgtcagggtttatgcagacatctttctttttcgggtacatggcttgcatctgttatgggtttttcctaatgcttgggatggttggcttccgtgctgctttgcttttcgtccgccacatatatcgatccatcaagtgtgagtagctcattggtaccagatcagctcgagaaatggttgcatgcagaactcaccactcgacatgctatcttgttctgtgtgcagtatggaagcagcgccggtaagtcttagattagggaagttgttcaagaaatagttggtctgtttaaccttgctcatctttcttattttcaaaaagatgtatcacattatctgcgactcggacaacttttttgtcacacatggatgtctaatgaaatcggtggcattggctaaatagttgtcggcagggacaactttccacaaattg

SEQ ID NO: 1258 - DNA, 2258 bp, Musa acuminata
cacgaattctatccacagacgactcacaatacgctgttccttcttccttctttcccgtcgcaccacttgtgctctgatctcttcggttccgtttctcggatcgaagggaaagggatggggagggaaccgatggatctggcggcggcggtggcgctgctgctgctctgcttcgggatcgcaggagttgcgtcggacgcctccgaccaccgctataagaaaagagactccgtacccctctacgccaacaaggtcggccctttccataaccctagtgagacgtatcgctactttgatctccccttttgcgctccagaacatgtgactgagattagagaagctcttggtgaagttctgaatggggatcgccttgtagatgccccctacaagcttaatttcctagtggatcttgattccaaacagctttgcaagaagaaacttacgaaagaggatgtggccaagtttagaagtgctgttacaaaggactattatttccagatgtactttgatgacctccccatctggggattcattgggaaggttgacaaggaaggcaaagatctgggtgattataaatactacctatacaggcatatccactttgatgtcctctataatggtgatcgtgtgattgagattactgtccacaccgaccctagtgcattggtggatctcacagacgataaggaaatcgaggtggattttatgtactcagtcaagtggaaggagacaagcacaccatttgaaaagaggatggaaaagtattcactgacatattcacaaacgcatcatctggagattcattggttctcaatcatcaactcatgtgttacagttcttctcttgactggtttcctagccacaattctgatgcgggtgttgaagaatgattttgtcaagtatgcccatgatgaggagtctgctgaggagcaagaagagactggctggaaatatatccatggagatgtgtttagattcccaaagaacaaatcactctttgcagcatgtcttggttctggcacacaattatttgctctcacggttttcatttttgttcttgcattaattggggttttctatccttacaatcgtggggctctttttactgctctggtagtcatctatgcacttacctctggcattgctggatatactgctacctctttctactgtcagctcgagggaacaaattgggtaaggaatttgctgttgaccggatgcctcttctgtgggcctcttttcctgacattctgtttcctcaacactgttgctattgtgtatagtgccactgcagctttaccatttggaaccattgttgttattgttctcatttggacattggtaacctctccgttgcttgttttgggtggaattgctggtaaaaatagtaaaaatgaattccaagccccttgtcggacaaaaaagtttcctagagagattccaccactcccttggtatcgaggaacacttccacagatggcaatggctggttttctgcctttcagtgcaatctacattgagctttactacatctttgccagcgtgtggggccacagtatttacaccatatatagcattctgttcatagtgttcatcatcctcctcattgtgaccgcattcatcaccattgcgctaacctactttcagcttgctgctgaagaccatgaatggtggtggaggtctttcctatgtggaggatcaactggtgtatttgtgtacgcatactgtttgtactactactatgcccgatctgatatgtctggctttatgcagacatccttcttctttggttatatggcttgcatctgctatggcttcttccttatgcttggcatggttggcttccgtgcagcattgctgtttgtacggcacatctatcgatccatcaagtgtgagtaacctgtcagtaccaaatcgaattgatgaatccgattgctttggcaaccatccagttaaatcttgccctttgcggggattaggagtaataccagtttgaaccgacagggctctgcttcttccagaaataggcagttactaatcattagtatctatagttgtatgtttccctgtctttgatcacttgttccatttgccaattctttgtatgacattgtcaagtagttttttttacatgtatctgcacattcgtggaatggctctcttatgaaccacttggataagacatatttctctatacatctaaagaaacttgttttaagagcatggatatctatctattcattcttacaagtatctgtgag

SEQ ID NO: 1259 - DNA, 2195 bp, Artemisia annua
agcactgtagttgttttatccacggggcccgagaagaaaacgtgagaagtcatcgtctctccacactttaaaataccaaaaacacccttccctcaactgacttacttcttccatagactacacacatttcacaaaacacatctatctaacaaactgtgtgcaacgaagaaaatgatccggtggcagttactagtagctttagtggcggttataacaatcagcccacaagctgcatcagcctcttcagatcacaagtataaacctaatgatgatgttccgatttacgctaataaagtcggcccatttcataaccctagtgaaacataccgtttttatgatctgccattctgtttaccagatcatctgaaagagaaaaaggaagctcttggtgaagtactgaatggagatcgtttagtcagtgctccttacaagcttcaatttatggttgaaaaggactcggaaattgtttgcagaaagaaactgaccaaggaggaagttaaaaagttccgaagtgctgttgccaaggattactatttccaaatgtactatgatgacttgcctttctggggctttctagggaaagttgaaaaggacaaaactgaccccagtgaggagaagtattacctgtttaagcatcttcacttcgagatccactacaaaaaagatcgtgttatagagataaatgcaaaagctgatcctagtgctgtggtggatcttactgaagacaaggaagttgaggtggaatttatgtacacggtgaggtggaaagaaacaagcattccttttgagagtaggatggagaaatacgctcagtcttcttcacagccgcatcacttggagatccactggttctcgatcatcaactcatgtgtgacggttctcctcttaactggtttccttgccacaattcttatgcgagtccttaagaatgactttgttaagtatgctcatgatgaggaggaagctgacgaccaagaggaaactgggtggaagtacattcatggtgatgttttcaggtacccaaagtacaagtccttgtttgctgccgcccttggttccggtacccagctattttccctctcacttttcatctttggactggcccttgttggtgtattttatccatacaaccgaggagctctgtttacggcactggttgtcatatatgctcttacttctgggattgcgggctatactgcatcctccttttatcaccagctagaaggaactaactgggtgaggaacttgctattgactggctgcctgttctgcggacctctgtttctcactttctgctttcttaacactgttgcaattgcttataatgctactgctgctctacccttcggtaccattgtggtcattgttttaatatggactttagtgacgtctccattgctagtattggggggtattgcaggaaagaacagcaaggctgagtttcaggctcctgttcgcaccacaaagtatcccagagagatcccaccgttgccttggtaccgcaaaactgttcctcaaatggccatggctggttttcttccattcagtgctatctacattgagctttactacatatttgccagtgtctggggtcacaggatttataccatctacagtatcttatttatcgtttttatcattctcctgattgttaccgcctttatcaccgtggcattgacatatttccaacttgctgctgaagaccatgaatggtggtggaggtctttcctctgtggtggctcaactggagttttcatcttcggttattgcttgtattactattatgaacgttctgacatgtccggattcatgcaaacctcgttcttctttggttacatggcttgcatctgttatggtttctttctaatgcttgggacagtcggtttccgtgcggctttgttctttgtacgccacatataccgatcaatcaagtgcgaatagaagtttaatgttcaacctagcatgcttagacaggagctgctgctgttgctgctgctgttgctgctgccgcccagggtgaagctatgagatcgatgtttttgtataccagtttatgttgtttcttttttatttttcgatttgacaataggaagcaaatttgaacacatatactcaattttggacataccagtttaatattgattctgtagcttgtaattaaaagtttgtattagtccagttattcaccagccttc

SEQ ID NO: 1260 - DNA, 2013 bp, Vinca minor
gtcggtgattgaatgtgaaaaatggagacggagaagaaaaagatctgtagaatggcgagatttccggtcgtcgttttgatcgtgttgttaatggtcgccggagtaagatcggatggttccgatcacaagtataaagctaaggatcaggttcctctctatgctaacaaggtcggacctttccaaaaccctagtgaaacttaccgcttcttcgatctgccattctgtattccagatcatgtgaaggagaaaaaggaagctctaggtgaagtgctgaatggagatcgcttagtcagtgcaccttataagcttgactttttagttgacaaagactctgagacagtttgcaaaaagaagttgaccaaggatgacgttaagttatttcgaaaggcagtggcaaaggattactacttcgaaatgtattacgatgacttacctgtctggggtttcttagggaaagttgataaggaaagcaaatctgatccaagtgaatacaagtattacctttttaaacacctgcattttgagatattctacaaaaaagaccgtgtgattgagatcaatgcacggactgacccaagtgcccttgtagacctcactgaggataaggatgttaatgtagaattcatgtactcagtaagatggaaagagacaaatattcctttcgaaaagaggatggagaaatattcaaagacgtctgcgttgccacaccacttggaaattcattggttctcaataattaactcttgtgtgacggttcttcttctcactggctttcttgcaactattctcatgcgagttcttaagaatgactttgtcaagtatgctcatgatgaggagactgctgatgaccaagaagaaactgggtggaagtatatacatggtgatgttttccggtatcctcagtacaagtctttgtttgcagcagctcttggttgtggcactcagttattcatcatggtaacttttattttcattcttgcactggttggtgtgttttatccatacaaccgcggagctcttttcactgcacttgttgtcatatatgcactgacgtctggcattgctggctatacagcagcttctttctactgccaacttgaaggagcaaactgggtgaggaatgtgttattgactggggccctcttctgtggacccttctttctgacattttgctttctaaataccgtggcaattggttatagtgccacagctgcactgccatttggtaccattgttgtcatcttcttgatctgggcccttgtgacttctcctttgctggtccttggtggggtagcaggaaagaacgccaagacagagtttcaagctccatgccgtaccacaaagtatccccgagaaattcctccatcgccgtggtatcgcagtactctgccccagatggccatggctggattcttgcctttcagtgccatctatattgaactctactacatatttgcaagtgtttggggtcacaggatttacaccatctacagtatcctatttattgtcttcattattctgctaatagttaccgcttttattaccgtggcattaacatatttccaacttgctgctgaagaccatgagtggtggtggaggtccttcctttgtggtggatcaactggactgttcatctacggatactgcttatactactattatgcacgttcagatatgtcgggcttcatgcagacatcattcttcttcggatacatggcttgcatttgctatggtttctttcttatgcttgggactgttggtttccgtgcagcactcttttttgtccgtcatatataccgatctatcaagtgcgagtagtaagttgactaggttgtgttctttactcatctttatgattcatgtttctggtagaatgatattaggtcaaagaggacgactacgtagaacattcattctcaaggcaaatcttgtaatatcttactatagcaccataggaaaccttgttagagtttgctttcgcaattaaaaaaatgttacattcaatttgctagt

SEQ ID NO: 1261 - DNA, 2672 bp, Theobroma cacao
attattttaataagttttttaattttttaaaggacttgtaactagttggtgtcagtcatacactttgctataaaatataaaaataaaataaaataaatactagaataaaagttgtcccctttccttccgaccgagaccccaacacgtttttgcagaaacttgatctctggactcttggtgagggaatggagagaataagggcgtgtttggtagcgctgatcgttctcagcctctgcggcgtaccccaggtgagatccagtgcttctgatcatcgttacaaagctggagctgaagttcctctctacgccaataaagtaggtcccttccacaatcccagtgagacataccgttatttcgattttccattctgttcatcaacccccgtgaaggaaaagaatgaagctctcggcgaagtgttgaatggagatcgattagtgagtgccccttacaaacttgactttttgaatgacaaagaggctgagattgcctgcaaaaagaagttgacaaaggaagaagtcgccaagttccgaagtgcagtttcaaaagactattacttccaaatgtattacgacgacctccccatttggggtttcttagggaaagttgataaggaagggaaggttgatcccagcgagtacaaatattatctctttaagcatctcatattcgagatcctttacaacaaggatcgtgtcattgagattactgtgcaatctgatcccaacgcccttgtggacctcaccgaagatgaacaagtcaatgtggatttcatgtacactgttaaatggaaggaaacggaaactccgtttgagaagaggatggacaagtactcgctatcttcttcgttgccacaccacttagaaatccactggttctcaattatcaattgatgtgtcaccgttctgctattgactggtttccttgctaccattcttatgcgagtccttaagaatgatttcgtcaagtatgcacatgacgaggaatcagcagatgaccaggaggagactgggtggaagtacattcatggtgatgtgttcaggtacccaaagcacaagtctttgtttgcagcggctcttggttctggcacccagctctttactcttacaattttcatttttatcctcgctctagttggggtcttttatccatataatcgaggagctttgttcactgctctggttgtcatttatgcacttacttctggcattgctggctacactactgcctctttctattgtcagctagaaggaacaaattgggtgagaaacttattactgactggaggcttgttttgtggacctctttttatcacattttgctttctcaacactgttgcaattgcttataaaaccactgcagcattgccatttggaactattgtagtgatttttctcatatgggctctagtcacatctcctctattagtattaggaggtattgctgggaaaaatagcaaggcagagtttcaagccccttgtcgcaccacaaaataccccagagagattccaccgttgccttggtactgcaaaactcttcctcagatggcaatggcagggttcttgccgttcagtgctatctatattgaactttactacatatttgccagtgtgtggggacataggatctacaccatatacagcatcctgtttattgtcgttatcattctcttgattgtcacggcttttatcactgttgctttgacttattttcaacttgctgctgaagaccatgagtggtggtggaggtccttcctttgtggtgggtctaccgggttgttcatatatgcctactgtttgtattcctacaatgcacgatcagacatgtcaggcttcatgcaaacctcattcttctttgggtgcatggcgtgcatttgttatggtttcttcctcatgcttggggccattggcttccgtgcttctctgttctttgttcgtcacatttaccgttctatcaagtgtgagtaggaagatggacggtgttccctgtttactagagagagcagattgggacaatgtgcttcagcccatgtttgctgccaagggatattgcaatgttgtatgaaatatgaatcatgtagggtcaccttatttgattacgacaaccagatgccaacagaaacttgtatttctgagttgactcattacacgactcaacaattccttttatttttgtttttaatttttatattggggagtatcatactgaatattaggatgctttaggaataacttggtgctgttatacatgtaaacccgaatgaattgttcatcttcaccatgttagctctaaaattagtaacatattgcaatctctatgttgctcaaggttttgggaagtgattcagagtgaacaccagttgggaacaacgaaggccgggtttttgacatgaaatctctgaaaccatttagttaaaaataatttaatttcttgaaattgaaattaaaacatgtggattgatcattataatataatattataatataattacattatagttaagagatataatgtgattataatctaaaattaatgcaatcacgttacattgcattctgtaatattattaacgttatttttttaattttattattttataaaaaatattttataatattaaaatataagtaaaaaatattaaaataaaatatataatataaaaattagaaattaaa

SEQ ID NO: 1262 - DNA, 2301 bp, Catharanthus roseus
ccaaaacctcaactcgattaaaaaaaattagttttctcactgtatctccacttaagctacccccaaattaccctcactggtgaatcgagatctgtgccttctatatatgtatttctaggcgcagagatcagcggtggtgtgtgcgtcggtgattgaatgtgaaatggagattgagaaggagtttcaaagattggcgaaatggcaggtcgtcgttctaatccttttgtcaacagtcgccgtagtcagatcggatggctccgatcacaagtataaagctaaggatcaggttcctctctatgttaacaaggtcggacctttccaaaaccccagtgaaacgtaccgcttcttcgatctcccattctgttctccagatcatgtcaaagacaaaaaagaagctctgggagaagtgctgaatggagatcgtttagccagtgcaccttataagcttgactttttagttgacaaagactctgaggttgtttgcaaaaagaagttgaacaaggatgaagttaagcaatttcggaaggcagtggcaaaggattactacttccaaatgtactacgatgacttacctgtctggggtttcttggggaaagttgataaggaaggcaaatctgatccaagtgaatacaaatattacctttttaaacatctgcactttgaggtgttctacaacaaggaccgtgtgattgagatcaatgcacggactgatccaagtgcccttgtagacctcactgaggataaagacgttgatgttgagttcatgtactcggtaagatggaaagagacaaacgttccttttgaaaagaggatggaaaaatactcaaagacttcagcgttgccacaccacttggaaattcattggttctcaataataaactcttgtgtgacagttcttcttctcactggctttcttgcaactattcttatgcgagttcttaagaatgactttgtcaagtatgctcatgacgaggaggctgctgatgaccaagaagagactgggtggaaatatatacatggtgatgttttcaggttccccaagtataagtctctgtttgcagcagcccttggttgtggcactcagttatttatcatggtaactttatttttgttctggcactggttggtgtattttatccatacaatcgtggagctcttttcactgcactagttgtcatatatgcacttacatctggaattgctggctatacagcagcttctttctactgccaacttgaaggaacaaactgggtgaggaatgtcttattgactggggccttgttctgtggtcccttctttctcacattttgctttctgaatactgtggcaattgcttatagtgccactgctgcactgccatttggtaccattgtggtcatctttctgatttgggccctcgtgacctcacctttgctggtccttggtggggtagcaggaaagaacgcgaaaacagagtttcaagctccatgccgcaccacaaaatatccccgagaaataccaccattgccttggtaccgcagtactctgccccagatggcaatggccgggtttttgcctttcagtgccatctatattgagctctactacatatttgctagtgtttggggtcacaggatctacaccatctacagcatcctatttattgttttcattattttgctaatagttaccgcttttatcactgtggcattgacatacttccaacttgctgcggaagaccatgagtggtggtggaggtctttcctttgtggtggatcaactggactgttcatctatgggtactgcttatactactattatgcacgttcagatatgtccggcttcatgcagacctcattcttcttcggatacatggcgtgcatctgctatggcttctttcttatgcttgggactgttggtttccgtgcagcactcttttttgtccgccatatataccgttcaattaagtgtgagtagtaagtttactagatgtacctgttttctcacctttatgattcatggttttggtaggacgatattgagtcaaagagggctatgcagggcattccttctcaagccaattcttgtaatatcttactatagcacaataggaaaacttgttaaattttgtatttgcaactcaaaggaagttacattcatatgctagtttttacagtctaccaatttccatcttgcttgagggaggagagggcattgaattagctctctgcaatgtttttttttactttctttgttgagaacacaaacgaacacaaggggttgtacctgcaccattttatgagggtgataaaatctttagaa

SEQ ID NO: 1263 - DNA, 2220 bp, Amsonia hubrichtii
actcttccctcaggccttatcgtcgagatctacttgcctatcttcttcactttctctctattgcacgagcaaattgaagacgaagatgatcgagaggaggtggtggagtccttacgttgtaatccttgcagtcttagtttgctttacggcggaggtaagatcagatgcatcggatcacaaatacaaacctggagatgaggttcctctttatgctaacaaggtcggacctttccataatcctagtgaaacctatcgctattttgatctcccattctgttctccagaccatgtgaaagagaagagggaagctcttggtgaagtcttgaatggtgaccgtttagttgttgctccctataagctagagtttttatctgataaagagtcaatcattgtttgcaaaaagaaattgtcacagggagaagttgctcaatttcgaagtgctgtctcaaaggattactacttccagatgtactatgatgacttgccactatggggtttcttagggacagttgataaggatgggaaagctgatgcaagtgaatacaaatatcacttatttaaacatcttcactttgaaatcttttacaacaaggaccgtgttattgagattaatgcacgaagtgatcctagtgctctagtggatattactgaagacaaggaagttgatgttgatttcatgtactctgtcaaatggaaggaaactaccacagcttttgaaaataggatggagaagtattctcattcttcttcactgccacatcaccttgaaatccattggttctcaattatcaattcatgtgttacggttctcctcttaactggttttctggccacaattttgatgagagtcctcaaaaatgattttgttaaatatgctcatgatgaggagacagcagatgatcaagaagaaaccgggtggaagtatattcatggtgatgttttcaggtatccaaagtacaaatctttacttgctgctgctcttggatctggtacacagctattcacacttacaatctgtatatttatacttgcacttgttggcgtattttatccttacaaccgaggagctctcttcactgctttggtgattatatatgctcttacatctggagttgctggctatattgcagcctctttctattgtcagctagagggaacaaattgggtgagaaatgtattgttgactggagccctgttctgcggaccactatttttaactttttgctttttgaacactgttgccattgcttacagtgctactgcagctctgccttttggtactattgtggtcatctttctaatatgggcacttattacatcacctttgctggtcatgggtgggatcgcaggaaaaaatagcaaggctgaatttcaagctccatgtcgtactacaaagtatccaagggagatcccaccattaccttggtatcgtggaactctaccccagatggcaatggctggtttcttgcctttcagcgccatatatattgaactctactatatctttgctagtgtgtggggtcataggatttacaccatctacagcatcttattcattgtcttcattattctcctgattgttactgcatttattacggtagcgctgacatatttccaacttgctgctgaagaccatgaatggtggtggaggtctttcctttgtggtggatcaactgggttgttcatctatggttactgcttgtattactattatgcaagatcagatatgtcgggcttcatgcaaacgtcgttcttctttggatacatggcatgcatatgctatgccttcttccttatgctcggaactgttggtttccgtgcagcattgttctttgtccgacatatatatcaatcaatcaagtgcgagtaagaacttggattgacaatcatcccttgtccagtaggtatgtcttttctgtagaaaagcttgttgtgttttagtgaactgagaaatgttgttcaaacactaatcacaagcagcaggaattgaaaggctgtaatggttcggaatcttgtggaagcctaagatgttacctgtggtgactgttgcggcatattgcataaatttcaagctagggttagagaccctatcagcgcgaacatgaaataggaaaatacctcttagggaaacgccaagctgagtcaaagggccgcaggcattattagggaagcagacttttattttgttaagaacggaataattgatattaaagtattagt

SEQ ID NO: 1264 - DNA, 2055 bp, Flaveria ramosissima
cgtactagcaccaccatagcagacgtcggagcaaaatgtcggcgatacggtggtttgtggtggcgctgctggtggccttctgcgttgaagaagttcgatcaggtgcagatcacaaatacaaacctggtgatgaagttcctttgtacgccaacaaagtcggcccctttcataaccctagtgaaacataccgtttttttgatctacctttctgtttgccagctcatttaaaggaaaaaccagaagctcttggtgaagtactgaatggagatcgtttagtcagtgctccttataagcttgactttatggttgaaaaagattctgaaattgtttgcagaaaaacactgacaaaagacgaagtatctaaattccgaagtgctgttaagaaagattactattttcaaatgtactatgatgacttgcctttctggggctttctagggaaggttgaaaaagacaaaactgaccctaatgaggaaaaatattacctttttaaacatcttcactttgagatccactacaataatgatcgtgtgatagagataaatgcaaaagctgaccctaatgctgttgtggatctcactgaagacaaggaagttgatgtagaatttatgtacacagtgaggtggaaagaaacaaatgttccttatgaaactaggatggagaagtacgcccaatcatcttcccaaccacatcacttggagatccattggttttcaattattaactcatgtgtgacggttctcctcttaactggtttccttgctaccattcttatgcgagtccttaagaatgactttgttaagtatgctcatgatgaggaggcagctgatgaccaagaggaaactgggtggaagtacattcatggtgatgttttcagatatccaaagtacaaatccctgtttgctgctgcccttggttctggtacccagctatttgctcttgcactttttatatttatactcgctcttgttggggtcttttatccatacaatcgaggagctctgtttacagcacttgttgtcatatatgcacttacatctgggattgctggctacaccgcagcctccttttatcaccagctagaaggaactaactgggtgaggaacttactattgactggctgcctgttttgtggacctctatttcttactttctgtttcctaaacactgttgcgatcgcgtatactgctactgctgccctgccctttggtacaattgttgtgattgtgctaatatggacattggtgacatcgccgttgttagttttggggggtattgctggaaagaacagcaaggctgaatttcaggcgcctgtgcgcaccacaaagtatccaagagagatcccacctttgccttggtaccgtaaaaccatcccgcagatggccatggctggttttcttcctttcagtgcaatctacatcgagctttactacatatttgcaagtgtgtggggccacaggatttatacaatttacagtatcttatttatagtttttatcatcctcctcattgttaccgcctttatcactgtggcattgacttatttccaacttgctgctgaagaccatgaatggtggtggaggtcttttctctgtggtggttcaacgggtgttttcatctttggttattgcttgtattattactatgagcgctctgacatgtcgggattcatgcaaacatcatttttctttggttacatggcttgcatctgttatggtttctttctcatgcttgggatggttggtttccgtgctgccctgttctttgtccgacacatataccgctccatcaagtgtgaatagaagctcaacattcaacctacagtacttagacaggctgatgcttctgctactgcccaatgtgaatcgtaaaggtaacaagaaccaagttacatgttgtgaggatgttgaaaccgtcaccttctcaattatgtttattaggtcaataatatgtaggtagtttgaactatacagactcaatttttgacatatatcgactcatttcgtttgaaaatgtagcttgtaatggaactcttgtcctgtctagttataaaca

SEQ ID NO: 1265 - DNA, 2137 bp, Helianthus annuus
ccccctaaacaaatataaacaacctcacacacatctaaacattagatctaccaacacactcaccatatcacacctcaaagatctgcagcaaaatgccggtgacggtgatacggtggctactggtggcgctgctagcggcagtttccgtcaactcagtccgatcagatcacaaatacaaacctggagatgaagtgccgttatacgccaacaaagtcggcccatttcataaccctagtgaaacataccgtttttatgatctgcctttctgtttgccagctcacttaaaggagaaatctgaagctcttggtgaagtactgaatggagatcgtttagtcagtgctccttataagcttgacttcatggtcgaaaaggactccgaaatcgtttgcaaaaaaacactaacaaaggaagaagtatccaaattccgaagcgctgttacaaaagattattatttccaaatgtactatgacgacttacctttctggggctttctcggaaaagttgaaaaagacaaaactgaccctagtgaagaaaagtattacctgtttaaacatcttcactttgagatccactacaataacgatcgtgtgatagagataaacgcaaaagccgatcctagtgctgtagtggatctcaccgaagacaaggaagttgaggtcgagtttatgtacacggtgaggtggaaagaaacaaatattccttatgaaagtaggatggagaaatacgcgcagtcttcttctcaaccgcatcatctcgagatccactggttttcgattattaactcgtgtgtgacggttcttctcttaactggtttccttgccaccattcttatgcgagtccttaagaacgactttgttaagtatgctcacgatgaggaggcagctgatgaccaagaggaaaccgggtggaagtacattcacggtgacgttttccggtatccgaagtacaaatcactgtttgctgcagccctaggttccggtagccagctatttgctcttgcactttttatatttattctagctcttgttggcgtattttatccatacaatcgaggagctctgtttacagcactggtggtcatatacgcacttacgtctggtattgctggctacactgcagcctcgttttatcaccaactagaaggaactaactgggtgagaaacttgctgttgactggctgcctgttttgcggacccctctttcttaccttctgctttctaaacactgttgcgatcgcttataccgctactgccgcactgccttttggtacaatcgttgtgattgttttgatatggacgttggtgacatcaccattgctagtattggggggtattgctggaaagaacagcaaagctgagtttcaggcgcctgtacgcaccacgaagtatccgagagagatccctcctttgccttggtaccgcaaaaccatcccgcaaatggccatggcgggtttccttccgttcagtgcgatctacatcgagctttactacatctttgctagcgtgtggggccacaggatttacaccatttacagtattttatttattgtttttatcatcctcctcatcgttactgcctttatcactgtcgcgttgacgtatttccaacttgctgctgaagatcatgaatggtggtggaggtcttttctgtgtggtggttcaacgggtgttttcatctttggttattgcttgtactactactatgagcgctctgacatgtcgggattcatgcaaacatcgtttttctttggttacatggcatgcatctgctatggtttctttctcatgcttgggatggttggtttccgtgctgccctgttctttgtccgacacatataccgctcaatcaagtgtgaatagaagctcgacattcaatttacagtactccgcaggcgctggtgcttatgctactgcccaatgtgaaagcgtaaaggtaacaaggaccgaattacatgtcatgaggatgttgaaaccgtcactttctcaattatgtttattaggtcaataatatgaaatgatgtttaagatgtaggtagtttgaactatacagactcgatttttgacatatatagactcgtttcgtttgaaactgtagcgtgtaattgaactcttgtttttgtccgtttataaatgtgccg

SEQ ID NO: 1266 - DNA, 2166 bp, Musa acuminata
gggaggagggacagatctcgatcgatggagatggggagatcggcgatggatctcgcggcggtggtggccgtggccacgctgctgctgtgtttcggcgtcgtcggagtcagatcggacgcctccaaccaccggtacaagacgggcgaccacgtcccgctctacgtcaacaaggtcggccctttccacaaccccagcgagacatatcgatatttcgatctaccattttgcaccccagagcatgtgaccgagaaaaaagaagcacttggtgaagttctgaatggggaccgcttggttgatgcaccatataagcttgattttcgtgttgatcgtgagtctgaagtgctttgcaagaagaagctaaaaaaagaagatgtagccaagttcaggagtgcagtcaccaaggactactacttccagatgtactatgatgatctcccactctggggattcattggtaaggttgacaaggaaggcaaggaccttggggagtacaagtactacctctacaagcgcttccacttcgatgttctgtacaacaatgaccgggtgattgagattattgtccacaccgatcccaatacattgttggatgtgacagaggacagggataccgaagtagaattcttatactctgtgaagtggaaggagaccagcacaccatttgagaagaggatggagaagtactcccagacttcttcgttacctcatcacctggagatccattggttctcaattatcaactcatgtgtgacagttcttctcttgactggattccttgccacaattctcatgagggtgctgaaaaacgattttgtcaagtatgcacatgatgaggagtctgctgaggaccaagaagagactgggtggaaatatatccatggtgatgtctttaggtttccaaagaacaagtcactgctggctgcctgtcttggttctggcacacaattatttactctgacggttttcatttttattcttgcacttgttggggtgttttacccctacaatcgtggtgctctttttactgctcttgtgatcatttatgcacttacctcgggcattgctggatatgctgcaacctcattctattgtcagctcgaagggacaaattgggtaagaaatttgctattgacaggatgccttttctgtggacctctgttcctgacattctgcttcctcaacactgttgccattgtgtatagtgctactgcagcattaccgtttggaactattgttgtgattgtcctcatatggacgttggtgacctctcctttgcttgttttgggtggaattgctggtaaaaacagcaaaatagagttccaagcaccttgtcgtacgacaaaatatcctagagagattccagaattgccctggtatcgacaagctattccgcagatgataatggctggttttcttcctttcagtgcaatctacattgagctttactacatatttgcaagtgtgtggggtcacagaatttataccatatatagcattctcttcattgtcttcattatcctcatcattgtcactgcttttataactgtggcactgacctactttcaacttgctgctgaggaccatgaatggtggtggaggtctttcctatgtggaggatcaactggcctttttgtatatggatactgttggtattattattatgctcgctcggacatgtcagggtttatgcaaacatcgttcttctttgggtacatggcttgcatctgttatggtttcttccttatgctcggcatggttggattccgagctgctttgctctttgttcgtcatatataccgatccatcaagtgtgagtagagctcaagtagaatgtcacttctgaatcatgccgtttggaaggaatgattcatgcaatctgtcaacaatcattctacattggagacttggatgacctgtgtttgaagtcatagaacatgatttattgtttccagaaattggcatttagaatttttgatcaaataggtcttgtcataaatcaattttcccatcttccacttatgttggtggcattgtttcaaaaagcgtatggtatacatgctttcatgcgttttatgaggcagtttcccaaacacacgcttggatgtattagtggactcgttgctctatacatgtgatggatttgctagtataatgagtaatttcgtg

SEQ ID NO: 1267 - DNA, 2185 bp, Helianthus annuus
accacttacataacttctcaccatctttacaagacacacaaaaccccctaaacaaatataaacaacctcacacacataaacatcagatctaccaacacactcaccatatcacacctcaaagatctgcagcaaaatgccggtgacggtgatacggtggctactgatggcgctgctagcggcagtttccgtcaactcagtccgatcagatcacaaatacaaacctggagatgaagtgccgttatacgccaacaaagtcggcccatttcataaccctagtgaaacataccgtttttatgatctgcctttctgtttgccagctcacttaaaggagaaatctgaagctcttggtgaagtactgaatggagatcgtttagtcagtgctccttataagcttgacttcatgatcgaaaaggactccgaaatcgtttgcaaaaaaacactaacaaaggaagaagtatccaaattccgaagcgctgttacaaaagattattatttccaaatgtactatgacgacttacctttctggggctttctcggaaaagttgaaaaagacaaaactgaccctagtgaagaaaagtattacctgtttaaacatcttcactttgagatccactacaataacgatcgtgtgatagagataaacgcaaaagccgatcctagtgctgtagtggatctcaccgaagacaaggaagttgaggtcgagtttatgtacacggtgaggtggaaagaaacaaatattccttatgaaagtaggatggagaaatacgcgcagtcttcttctcaaccgcatcatctcgagatccactggttttcgattattaactcgtgtgtgacggttcttctcttaactggtttccttgccaccattcttatgcgagtccttaagaacgactttgttaagtatgctcatgatgaggaggcagctgatgaccaagaggaaaccgggtggaagtacattcacggtgacgttttccggtatccgaagtacaaatcgctgtttgctgcagccctaggttccggtagccagctatttgctcttgcactttttatatttattctagctcttgttggcgtattttatccatacaatcgaggagctctgtttacagcactggtggtcatatacgcacttacatctggtattgctggctacactgcagcctcgttttatcaccaactagaaggaactaactgggtgagaaacttgctgttgactggctgcctgttttgcggacccctctttcttaccttctgctttctaaacactgttgcgatcgcttataccgctactgccgcactgccttttggcacaatcgttgtgattgttttgatatggacgttggtgacatcaccattgctagtattggggggtattgctggaaagaacagcaaagctgagtttcaggcgcctgtacgcaccacgaagtatccgagagagatcccgcctttgccttggtaccgcaaaaccgtcccgcaaatggccatggcgggtttccttccgttcagtgcgatctacatcgagctttactacatctttgctagcgtgtggggccacaggatttacaccatttacagtattttatttattgtttttatcatcctcctcatcgttactgcctttatcactgtcgcgttgacgtatttccaacttgctgctgaagatcatgaatggtggtggaggtcttttctatgtggtggttcaacgggtgttttcatctttggttattgcttgtactactactatgagcgctctgacatgtcgggattcatgcaaacatcgtttttctttggttacatggcatgcatctgctatggtttctttctcatgcttgggatggttggtttccgtgctgccctgttctttgtccgacacatataccgctcaatcaagtgtgaatagaagctcgacattcaatttacagtactccgcaggcgctggtgcttatgctactgcccaatgtgaaagcgtaaaggtaacaaggaccgaattacatgtcatgaggatgttgaaaccgtcactttctcaattatgtttattaggtcaataatatgaaatgatgtttaagatgtaggtagtttgaactatacagactcgatttttgacatatatagactcgtttcgtttgaaactgtagcgtgtaattgaactcttgtttttgtccatttataaatgtgccgtttacat

SEQ ID NO: 1268 - DNA, 2097 bp, Helianthus annuus
gcggggatgctcatacatctatctgagggcgctgtagcagagaccaaagatgacgacgatgaccgtgatccggtggttgctggtggcgttaacgttgctacaagtccgatcaggtgcctccgatcacaaatacaaacctaacgatgaagttcctatctacgccaacaaagtcggcccctttcataaccctagtgaaacataccgcttttttgatcttccattctgtttaccagctcatttaaaggagaagccagaagcacttggtgaagtactgaatggagatcgtttagtaagtgctccttataagcttgagtttatgcgcgaaaaggactctgaacttgtttgcagaaaaaaactaacaaaagcggaagtatccaaatttcgaaaagctgttgccaaggattactatttccaaatgtactacgatgacttgcctttttggggctttctagggaaggttgaaaaagacaaaactgaccctagtgaggagaagtattacctgtttaagcatcttcattttgagatccactacaataaagatcgtgtgatagagataaacgcaaaagccgatcctaatgctgttgtggatcttactgatgataaagaagttgaggtggagtttctgtatactgtgaagtggaaagaaaccgatattccgtatgagagtcgaatggagaaatactcccagacttcttcacagccacatcacctggagatccattggttttcgattattaattcgtgtgtcacggttctccttttaactggttttcttgctaccattcttatgcgggttcttaagaatgactttgttaagtatgctcatgatgaagaggaagctgatgatcaagaggaaaccggttggaagtacattcacggtgatgttttcaggtacccgaagtacaagtctctgtttgccgctgcacttggttccggcacccagctattttcccttgcactttttattttcgggctagctctagttggtgtattttatccatataaccgaggagctctgtttaccgcactggttgtcatatatgcacttacttctgggattgcaggctacaccgcagcctcgttttatcaccagctagaaggaactaactgggtgaggaacttactattgacaggctgcctattctgtgggcccctctttcttactttttgctttctaaacactgttgcaatcgcgtacaccgccactgctgctctaccctttggtacaatagtggtgattgtgttaatatggacattggtgacttcaccgttgttagtattgggcggtattgctggcaaaaacagcaaggctgaatttcaagcacccgttcgcaccacaaaatatcccagagagatcccgccgttaccgtggtaccgtaaaaccgtgccgcaaatggccatggctggttttcttcctttcagtgcaatctacattgagctttattacatctttgccagtgtgtggggccacaagatttataccatttacagtatcttatttatagtctttatcatcctcctcattgttactgcctttataactgtggcgttgacttatttccaacttgctgctgaagaccatgaatggtggtggaggtctttcttgtgtggggggtcaaccggtgttttcatctatgggtattgtttgtactattattatgaacgttctgacatgtcgggattcatgcagacatcgtttttctttggttacatggcttgtatatgttatggtttctttctcatgcttggaatggtcggtttccgggcggctttgttctttgttcgccatatctaccgctcaatcaagtgtgaatagaagtttagtgttcaaacagctgctgctgctgccgccgccgctgacagggtgaaaccatcaaaactatgagaactagtttacttgatgagtgttttgatatactagtttatgttatttcattttccgtttaataggagtcaaatcatacctagtcaattttggacatacattttaatatgtagcttgtaattaaatttcagtttgtgcaactccaggtactatatcagcagattttcttaagtttccttgtttgtattataaatttgtgtcggtattacttc

SEQ ID NO: 1269 - DNA, 2117 bp, Helianthus annuus
ttaataataacaatcccttttagtccttgaacaaagttggatagagtataaaattgccaaaatcgcctaattcatatgctccataccatctatctgtgggcgttgtagcagagaccaaagatgacgacgatgaccgtgatccggtggttgctggtggcgttaacgttgctacaagtccgatcaggtgcctccgatcacaaatacaaacctaacgatgaagttcctatctacgctaacaaagtcggcccctttcataaccctagtgaaacataccgcttttttgatcttccattctgtttaccagctcatttaaaggagaagccagaagcacttggtgaagtactgaacggagatcgtttagtaagtgctccttataagcttgagtttatgcgcgaaaaggactctgaacttgtatgcagaaaaaaactaacaaaagcggaagtatccaaatttcgaaaagctgttgccaaggattactatttccaaatgtactacgatgacttgcctttttggggctttctagggaaggttgaaaaagacaaaactgaccctagtgaggagaagtattacctgtttaagcatcttcattttgagatccactacaataaagatcgtgtgatagagataaacgcaaaagccgatcctaatgctgttgtggatctcactgatgataaagaagttgaggtggagtttctgtatactgtgaagtggaaagaaaccgatattccgtatgagagtcgaatggagaaatactcccagacttcttcacagccacatcacctggagatccattggttttcgattattaattcgtgtgtcacggttctccttttaactggttttcttgctaccattcttatgcgggttcttaagaatgactttgttaagtatgctcatgatgaagaggaagctgatgatcaagaggaaaccggttggaagtacattcacggtgatgttttcaggtacccgaagtacaagtctctgtttgccgctgcacttggttccggcacccagctattttcccttgcactttttattttcgggctagctctagttggtgtattttatccatataaccgaggagctctgtttaccgcactggttgtcatatatgcacttacttctgggattgcaggctacaccgcagcctcgttttatcaccagctagaaggaactaactgggtgaggaacttactattgacaggctgcctattctgtgggcccctctttcttactttttgctttctaaacactgttgcaatcgcgtacaccgccactgctgctctaccctttggtacaatagtggtgattgtgttaatatggacattggtgacttcaccgttgttagtattgggcggtattgctggcaaaaacagcaaggctgaatttcaagcacccgttcgcaccacaaaatatcccagagagatcccgccgttaccgtggtaccgtaaaaccgtgccgcaaatggccatggctggttttcttcctttcagtgcaatctacattgagctttattacatctttgccagtgtgtggggccacaagatttataccatttacagtatcttatttatagtctttatcatcctcctcattgttactgcctttataactgtggcgttgacttatttccaacttgctgctgaagaccatgaatggtggtggaggtctttcttgtgtggggggtcaaccggtgttttcatctatgggtattgtttgtactattattatgaacgttctgacatgtcgggattcatgcagacatcgtttttctttggttacatggcttgtatatgttatggtttctttctcatgcttggaatggtcggtttccgggcggctttgttctttgttcgccatatctaccgctcaatcaagtgtgaatagaagtttagtgttcaaacagctgctgctgctgccgccgccgctgacagggtgaaaccatcaaaactatgagaactagtttacttgatgagtgttttgatatactagtttatgttatttcattttccgtttaataggagtcaaatcatacctagtcaattttggacatacattttaatatgtagcttgtaattaaatttcagtttgtgcaactccaggtactatatcagcag

SEQ ID NO: 1270 - DNA, 2136 bp, Nicotiana tabacum
  misc_feature (21)..(21): n is a, c, g, or t
  misc_feature (82)..(82): n is a, c, g, or t
  misc_feature (140)..(140): n is a, c, g, or t
  misc_feature (155)..(155): n is a, c, g, or t
  misc_feature (173)..(173): n is a, c, g, or t
  misc_feature (204)..(204): n is a, c, g, or t
  misc_feature (428)..(428): n is a, c, g, or t
  misc_feature (450)..(450): n is a, c, g, or t
  misc_feature (554)..(554): n is a, c, g, or t
  misc_feature (564)..(564): n is a, c, g, or t
  misc_feature (590)..(590): n is a, c, g, or t
  misc_feature (632)..(632): n is a, c, g, or t
  misc_feature (755)..(755): n is a, c, g, or t
  misc_feature (758)..(758): n is a, c, g, or t
  misc_feature (853)..(853): n is a, c, g, or t
  misc_feature (866)..(866): n is a, c, g, or t
  misc_feature (872)..(872): n is a, c, g, or t
  misc_feature (881)..(881): n is a, c, g, or t
  misc_feature (936)..(936): n is a, c, g, or t
  misc_feature (1884)..(1884): n is a, c, g, or t
  misc_feature (1958)..(1958): n is a, c, g, or t
cccaaaaaatggtgaagaagnatagtatggggtgtggctattacgtcgtcgttttggtgctcttgttctttggagctacgantgtgagatcagattcatcagatcacaaatacaaaaatggagaagaagtccctttatangcaaacaaagttggnccttttcataaccctagngaaacatatcgctactttgatcttccatttngttctccaggtcatgtgaaagataaaacagaagctcttggtgaggtgttgaatggagatcgtttagtcactgctccgtacaagcttgactttctaagtgatcgagaaactgaagtagtttgcaagaagtcattatcaaaggaagaagttgcaagattccgtgacgctgttgccaaggattactacttccagatgttctatgatgacctgcccatttggggtttnattggtaaggtagataaggagngaaaatctgaccccaatgagtacaaatactacctttttaaacatcttcattttgacatccatttcaacaacgatcgcgtgattgaagttaatgcacgaactgancccaatgccntagtcgacataaccgaagataaggangttgatgtagacttcatgtactctgtcaaatggaaggaaacngacatcccttttgagaaaaggatggaaaagtactcacagacttcagctttaccacatcatttggagatccactggttctctatcattaattcttgtgtcacagttctgctcttaactggtttnctngccacaattctgatgcgagtccttaaaaatgactttgtcaaatacgcccatgacgaggaagcagctgatgaccaagaagaaactgggtggaagtncattcacggcgangtgttnaggtacccnaagcggaactcactttttgcagcagccctgggttctggcacacagttgtttaccntgacaattttcatattcatacttgcgcttgttggtgtgttttacccctacaaccgaggagctcttttcacagctttggttgttatttatgctcttacatcaggaattgcaggctatactgcagcatcattctattgccaacttgaaggaaaaaattgggtaaggaatttgttgttgacaggaggtctgttctgtggaccgctgtttctcacattctgtttccttaatactgttgcaattgcttatcatacaactgcagcacttccattcggtaccatcgttgtcattttcctcatatgggccttggtgacatcaccattgcttgtcttgggaggaatcgcaggaaagaatagcaaggcagaatttcaagctccatgccgaacaacgaaatatccaagagagataccacaattaccctggtatcgtggagctcttcctcagatggcaatggctgggttcttgcctttcagcgccatctacattgagctctactacatatttgccagcgtgtggggtcataggatttacaccatttacagtatcttattcatagttttcatcattctaatcattgtcactgcatttattacggtggctttgacgtacttccaacttgctgcagaagatcatgaatggtggtggaggtctttcctttgtggtggatcaactggtctgttcatctacggatactgcctgtattactattatgcccgatcagacatgtcaggcttcatgcaaacctcattcttctttggttacatggcttgcatatgctacgccttctttctcatgctcggaactgttggtttccgggcggctttatttttcgtccgccacatataccgttcaatcaagtgcgagtaagatgcagaattccacattgtcttggttcaactggagcctgtgtttttggtgtaaaaattgtcaacatgcttggagtagtgcagcncattccctgatatacaaaggtttaggtccatttagaattggtgtggagcaaaacaaagaagaagatatgttgangaagatgctcaaatcagttttcaggtgcagctttatgttgaacagtggttttaattgtgtttaggaactctatttgtaacaatgagtctattagttaagctcagcttatttttcctagtcttaacctttttgatatataaaatatgggtctgttaattgcattcttagctgtttatgc

SEQ ID NO: 1271 - DNA, 2247 bp, Vinca minor
tttttcttctcagggcttatcttcgagatctacttattctctctcatcatatttcttgcatgagcaacaaattgaagatgaagataatggagaggaggcgatggaatcccaacgccgttgttgtatttatcgccgccgtcttattttgttgcttcgcggcggaagttagatcggatgcgtgggatcacaaatacgaacctggagatcaggttcctctttatgctaacaaggtcggacctttccacaatcctagtgaaacctatcgctattttgatctcccattctgttctccagctcatgtcaaagagaagagggaagctcttggtgaaattctgaatggtgaccgcttagttattgctccatataagctagagtttttatctgataaggactcggaaattgtttgcaaaaagaaattgtccaaggaagaggttgctcaatttcgaagtgctgtctcaaaggactactattttcagatgtactatgatgacttgcctctgtggggtttcttagggaaggttgacaaggaagggagagctgatcccagtgaatataaatattatctatttaagcatctccacttcgaaatcttttacaacaaggaccgtgttattgagattaatgcacgaactgatcctaatgctctggtggatattaccgaggacaaggaagttgatgttgatttcatgtactctgtcaaatggaaggagacttccacagcttttgaaaacaggatggagaagtattcacagtcttcttctctgccacatcaccttgaaatccattggttctcaattatcaattcctgtgttacggtccttctcttaaccggttttctcgcaacaattttgatgagagttcttaaaaatgattttgtcaaatatggtcatgacgaggaggcagcagatgatcaagaagaaaccgggtggaagtatattcatggtgatgttttcaggtacccaaagtacaaatctttacttgctgctgctcttggatctggcactcagctattcacaatgactatctgtatatttatacttgcacttgttggtgttttttatccttacaaccgaggagctctcttcactgctttggttatcatatatgcactcacatctggagttgctggctatactgcagcctctttctattgccagctagagggaaaaaattgggtgagaaatgtgttgttgactggaggcttgttctgcgggccactatttttaactttttgctttttgaacactgttgctattgcttacactgctactgcagctctacccttcggaaccattgtggtcatctttctcatatgggcacttattacttcacctttgctagtcatgggcgggattgcaggaaagaatagcaaggctgaatttcaagctccatgtcgcacgactaagtatccaagggagatcccaccattaccttggtatcgtggaacgctacctcagatggcaatggctggtttcttgcctttcagtgccatttatattgaactgtactatatctttgctagtgtgtggggtcatagaatttataccatttacagcatcttattcattgtcttcatcattctcgtgattgttactgcgtttatcacaatagcactgacatatttccagcttgctgctgaagaccatgaatggtggtggaggtctttcctttgtggtggatcgactgggttgttcatctatggttactgcttatattactattatgcaagatcagatatgtcgggcttcatgcaaacatccttcttctttggttacatggcatgcatatgctatgcctttttacttatgctcggaacagttggtttccgtgcagcgttgttctttgtccgacatatataccgctcaatcaagtgtgagtaagaagttggacgacaaatcatcctttgttcagtaggtatgtcttctttgtagaaagcttcttgtgttttagaaaagtgaggaatgttgttcaagcactaattacgagcagctggaacggaaaggtgtagtatctggattttgtgaaaggataagattttacatgtgttgagcgttgctgcatagtgcataattttcaaggtagggttagagacccactgtcaatgcgaacgtgtgacatgaatatacctcttggagacaatgccaaattgagtacgaaagggatgcaggcattatgaaagaaagcgagagttatattttgttaagaaccaaataactgatagcaaagtattagttagattttcctttt

SEQ ID NO: 1272 - DNA, 2021 bp, Tripterygium wilfordii
aggtgagatccgatgcatcagatcatcggttcaaacacggcgacgacgtccctctctacgccaacaaggtcggccctttccacaatcctagtgaaacctaccgctactttgatctcccattctgctcatcagcacctgtcaaggaaaagaaggaggctcttggtgaagtgctgaatggagatcgattggttagtgcgccttacaagctcgaatttctgggtgagaaagagtctgatcctgcttgcaagaggaagctgacaaaggaacaagttgctcagttccgacatgctgtttccaaggactactactttcaaatgtattatgatgacttgccaatatggggttcttaggaaaggttgacaaggaaggcaaaagtgacccaagcgagtacaaatattacctttttaagcatcttatttttaatatccttcacaataaggatcgagtcattgagattactgtgcaatctgatcaaaactctttagtggacattactgaagataaagaagttgaagtggagttcacctacacagttaaatggaaggaaacagaaatcccctttgagaagaggatggagaagtattcacagtcttcttcactgccacatcacttggaaatccattggttctcaataattaattcatgcgtgacagttctccttttaactggttttcttgccacgattctcatgcgagttcttaaaaatgatttttccaagtatgctcatgacgaggagtcagcagatgaccaagaggagactgggtggaagtacattcatggtgatgtattcaggtatccgaagtacaagtctttgcttgctgcagcacttggttctggtacgcagttatttactctagtactgttcatttttatgcttgctttagttggtgtcttctatccgtacaatcgaggggctctgttcactgcactggttgtgatatatgcgcttacatctggcattgctggctacactgctgcctctttctattgccaactagagggaacgaattgggtgaggaatcttttactgactggaagcctgttttgtggacctcttttcctcacattctgttttcttaataccgttgcaatagcttacagtgctactgcggcattgccttttggaacaattgtggtgattttccttatacttactctggtcaccacaccattattagtactgggggggattgctgggaaaaatagcaaggctgagtttcaggctccctgtcgcacgactaagtatcccagagagattcctccattgccttggtatcgaaagtctcttcctcagatggcaatggcagggttcttgcctttcagtgctatctatattgaactgtactacatatttgctagcgtgtggggtcacaggatctataccatatacagcatcctctttattgtcttcattattctcttgattgtcacagcttttatcactgtggcattgacatactttcaacttgctgctgaagaccatgaatggtggtggaggtcattcctgtgtggaggatcaactggcttgttcatttatggctactgcttgtattactactatgcacgatctgacatgtcgggcttcatgcaaacctcatttttctttggatacatggcttgcatctgctatggtttccttctcatgctcgggacagtcggtttccgtgcttctttgttctttgtccgtcatatctaccgctctatcaagtgcgagtagcaagtcacctggtcttccctatgttacatggagaagagtgggttgtttgcgttcatgcttctggactcgtctgcggttttaggatgatgcttcgaggagttgcatattagacgatatatctacattccttcaatggagatgttcatgttgggtgtatgatgccatgaagctgctggcagtacctgatgcatgttacatttttctttttatttggcagtaacttttgttgttgggacaaaatgtagagtgcaagatgcatttaaaaaagaatacttgtgatatttacacgctatggcatccctat

SEQ ID NO: 1273 - DNA, 2010 bp, Cucumis sativus
atttcctgattggagcatgaagaactctctgatcttcacccttttctggatcgcaatctctgccattcaggtcgcacccgatgcctccaatcaccgctacagcgaaggcgactctgttcctctttacgctaataaggtcggcccatttcacaatcccagtgaaacctaccgctactttgatctgcctttctgctcaccaggtgatgtaaaagagaaaaaggaagctcttggtgaggtgttgaatggagaccgccttgttagtgctccctacaagcttgactttaaaagagagaaagataccgaagttgcttgtaaaagcaagttatcaaagaaggaagttgctcagtttcgagctgcagtgaagaaagattattactttcagatgtattatgatgatttgcctatctggggttttattggaaaggttgatagggaaggcagggatgatccaagtgaatataaatatttcctgttcaagcacatccaatttgatatttcctacaatagagatcgtgtgattgaaattagtgctcgaatggatcctcattctgtggtggatctgactgaggacaaggatgttgatgttgagttcatgtatactgtgaagtggagggaaacagatactccctttgagaagaggatggataagtactcgcagtcttcttcattaccacatcacttggaaattcattggttttcaattattaactcttgtgtaacggtccttcttttgaccggttttcttgccactattctgatgcgtgtcttgaagaatgactttatgaagtatgcacaagacgaggaagcagctgatgatcaagaagagacgggctggaaatacatccatggcgatgtctttcgattccccaagtacaagtcattgtttgcggcggcccttggttctggcacccagttgtttactcttacagttttcatatttatgttggcactagttggtgtgttttatccgtacaaccgaggagctttgtttactgccctggtggtcatatacgcactcacgtctgggattgcaggatatacagcatcctcgttctattgccaacttgaaggatcaaactgggtgaggaatctgttgctgacgggttgcctcttctgtggacctctttttgccacattctgcttccttaacactgtcgctatagtttacaacgcaactgctgcacttccctttggcacaattgtggtgatagttctcatatggacattagtaacgtcaccattgcttgttttgggtggtatagcaggaaaaaatagtcggattgaatttcaagctccatgtcgcaccacaaagtatcctagagagattcctcagttaccttggtacagaagtactgttcctcagatggcaatggcagggtttctcccattcagtgctatatacattgagctttactacatatttgctagtgtctggggtcacaaaatatacacaatttacagtattctatttatcgtcttcatcatccttttgatagttactgctttcattaccgtggctttgacttactttcagctaactgctgaagatcatgaatggtggtggagatcttttctatgtggtggctcaactggtcttttcatctatggttactgcctgtactattattacgcacgctcggatatgacgggcttcatgcaaacttctttcttttttgggtacatggcttgcatctgctatggcttctttctgatgcttggaactgtaggcttccgtgcagccctgttcttcgtccgtcacatctatcggtcgatcaaatgcgagtagcagatttggtctctttttcttttcttttattttttgctggggagggaggaagagaacactttggttcagttttatccctccgttttagttaaatgctcccctcttggctagtggttaggtaaagcttactgaatgttacctccattctgggatcttttttcagattctaaagttttcacagattttggccgttacttcatcttataatccttgttttgtttttg

SEQ ID NO: 1274 - DNA, 2021 bp, Ambrosia trifida
tccataaaacacatgctcctagacacatgtaaaaagattggatctaccaacactcacagtatcacaaaatgtcggtgatacggtggttagtagtgtctctactattaacagtttcccttaactcaatccaatcaaatgcatcagatcacaaatacaaaccaggtgatgaagtatccttatatgccaacaaagttggcccatttcataaccccagtgaaacatatcgtttttatgatctacctttctgtttgccagctcatttgaaggagaaatcagaagctcttggtgaagtactgaatggcgatcgtttagtcagtgcgccttataagcttgacttcatggttgaaaaagactccgaaattgtttgcagaaaaacacttacaaaggaagaagtatctaaattccgaagcgctgttaccaaagattattattttcagatgtactatgatgacttgcctttctggggctttcttgggaaggtcgaaaaagacaaaaccgaccctaacgacaaaaatattacctgtttaaacatcttcattttgagatccactacaataacgatcgtgtgatagagataaatgcaaaagctgatcctagtgctgtggtggatctcactgaagacaaggaagttgaggtggaatttatgtacacagtgaagtggaaagaaacaaatattccttatgaaagtcggatggagaaatacgcgcagtcttcttctcaaccgcatcacctggagatccactggttttcaattattaactcgtgtgtgacggttcttctcttgactggtttccttgccaccattcttatgcgagtccttaagaatgacttcgttaagtatgctcatgatgaggaggccgccgatgaccaagaggaaaccggatggaagtacattcatggtgacgtttttcggtatccaaagtacaaatcgctgtttgctgcagcccttggttccggtagccagttatttgctcttgcactttttatatttattctagctcttgttggcgtattttatccatacaaccgaggagctctgtttacagcgttggttgtcatatatgcacttacatccggtattgctggctacactgcagcctccttttatcaccaactagaaggaaccaactgggtgaggaatttgctattgactggctgcctgttttgtggacccctctttcttaccttctgcttcttaaatactgttgcaatcgcgtataacgctactgctgcattgccctttggtacaatcgttgtgatcgttttaatatggacgttggtgacatcaccattgctagtattaggtggtatcgctggaaagaacagcaaggctgagtttcaggcgcctgttcgcaccacaaagtatcccagagagatcccgcctttgccttggtaccgtaagaccatccctcagatggccatggctggttttcttccgttcagtgcaatatacatcgagctttactatatatttgctagcgtgtggggccacaggatttacaccatttacagtattttgtttatagtttttatcattctcctcattgtgaccgcctttatcactgtggcattgacttatttccaacttgccgctgaagatcatgaatggtggtggaggtctttcctatgtggtggttcaactggtattttcatctttggttattgcttatactactactatgagcgttctgacatgtcgggattcatgcaaacatcgtttttctttggttacatggcttgcatctgctatggtttcttcctcatgcttgggatggttggtttccgtgctgccctgttatttgtccgacacatataccgctcaattaagtgtgaatagaagcttaacattcaatttagagtactcagacaggcactggtgcttatgctactgcccaatgtgaaagcgtaaagttaacaagaaccgaattacatgtagtgaggatgtcgaaaccatcaccttctcaattatgttattaggcctcagcccataatatgaaaggatgtttaagatgcaggtcgtt

SEQ ID NO: 1275 - DNA, 2004 bp, Musa acuminata
atggggtcggggatgaggacgtcggtgacggatctgacggccgcggcgacggcgctgctgctattgctgtgcttcggggtcgacggagtcgtctcggacgcctccgaccatcgctacaagacaggcgatcacgtccccctttacgtcaacaaggttggccctttccataatcccagcgagacatatcgctactttgatcttccattttgtaccccagagcatgtgaccgagaaaagagaagcactcggtgaagttcttaatggggaccggctggtggatgccccatacaagcttgatttccgagtagaccatgagtctgaagtgctttgcaagaagaggctcacaagagaagaggtgtccaagttcaggagtgcagtcaccaaggactactactttcagatgtactatgatgatctccctctgtggggattcattgggaaggttgacaaggagggcaaggaccttggcgagtacaaatactacctgtacaagcgcttccactttgatgtcctttacaacaatgaccgtgtgattgagattgttgtccacactgatcccaatatgctgctagatgtcacggaggacagggatatcgaagcagagtttttatattctgtgaagtggaaggagactgccacaccattcgagaagagaatggagaagtactctcaaacttcttcactacctcatcacttggagatccactggttctccattataaattcatgtgtgacagttctactcttgaccggatttcttgccacaattctcatgcgtgtactgaagaatgatttcgtcaagtacactcatgatgaggagtctgctgaggaccaagaagaatctgggtggaaatatattcatggtgatgttttcaggtttccaaagaacaagtcactgttggctgcttctcttggttctggcacacaattatttactctcacggttttcatctttattcttgcacttgttggcgttttctacccttacaatcgtggggccctttttactgctcttgtgatcatatatgcacttacctcgggcattgctggatatgctgctacctctttctattgtcaactcgaaggaacaaactgggtacggaatttgttattgacaggatgccttttctgtgggcctctgttcctgacattctgttttcttaacaccgtcgccatcgtgtatagtgctactgcagcattaccctttggtactatcgttgttattgttctcatttggacgctcgtcacctctcctctacttgttttgggtggaatcgctggtaaaaacagcaaagcagacttccaagcaccttgtcgtacagcaaagtaccctagagagataccaccattgccatggtatcgacaaactattccacagatgataatggccggctttcttcctttcagtgcaatctacattgagctttactacatatttgcaagtgtgtggggccacagaatttataccatatacagcatcctattcatcgtcttcattatcctcctcatcgtcaccgcttttattactgtggcactgacctactttcaacttgctgccgaagaccatgaatggtggtggaggtctttcctatgtggaggatcaactggcttatttgtgtatggatactgtctgtactactaccatgctcgctcggacatgtcggggtttatgcagacgtctttcttctttggctacatggcttgcatctgttacggcttcttcttgatgctcgggatggttggcttccgtgctgctttgctgtttgtgcgtcacatttaccgatctatcaagtgcgagtagcaagttgaagttgttgcctgacttggagcagcagcacattttgaacacagaatagaatcactggtttctgaagtagatgcttaatagcctgtgaaatatctataatccaatagtcctcgtctacttttatgatcttcttccacttgaagtccttgatactgttttgaaaggtgtatcaaatatgcattcgtgcaatttgtgaaa

SEQ ID NO: 1276 - DNA, 1920 bp, Castanea mollissima
tctctctctctctctcagtctgtgttgtgttaaacactgaggagaaatggtggtggacatgaagaagaagattatggcgtgtttggtggcagccatagtgatcctctgcagcctaacccacgtcagatccgatgcttccaatcatcgttacaaagaaggtgacgatgttcctctatacgctaacaaggtgggacccttccacaatcccagtgagacataccgttattttgatctccctttctgttcaccagcccatatgcaagaaaagaaagaagctcttggcgaagtactgaatggggatcgcttagttgttgccccttacaatcttgaattcctaaaagacaaagaatctgagattgtttgcaaaaagaagttgaaacaggaagaagtttctcagttccgcactgcagtttcaaaggactattacttccaaatgtactatgatgacttgcccttatggggtttgttaggtaaatttgacaaggaaggaaaagatgaccccagtgagcacaaatattacctctttaagcatcttcatttcgacatcctttacaataaggatcgtgttattgagattattgtaaaaagtgatccagatgcccttgtggacctgacagaagacaaagaagttgacgtggaattcacgtactcagtcaaatggaaggacacagagattccatttgagaagaggatggagaagtactctcaaatttcttctctgcctcatcacctggaaatccattggttttcaataataaattcatgtgtgactgttcttctcttaactggattccttgccacgattctcatgcgagtccttaagaatgattttgttaagtatacccatgatgaggaggcagccgatgaccaagaggagactggatggaagtacattcatggtgatgtattcaggtatccaaagtacaagtcattgtttgcagcagcgcttggttccggcacccagctatttactctagcgattttcattttcttgcttgcactagttggtgtgttttatccctataaccgaggagctctgttcacggcacttgtcgtcatatatgcacttacatcagggattgcaggctatactgcagcatctttctattgccaactagaaggacaaaattgggtgcgaaatttgttattgactggaagcctcttctgtggaccactgtttctcaccttctgctttcttaataccgttgcaattgcttacagttccactgcagcactgccatttggaacaattgtggtgatttttctcatatggactcttgtaacttcacctttattagtattgggtgggattgctgggaagaatagcaaggctgagtttcaagctccatgccgcacggcaaaatttcctagggagataccatctttgcctgggtatcgtaaaacccttcctcagatggctatggcagggtttttgccattcagtgctatctacattgaactttactacatatttgctagtgtatggggccaccggatttacaccatctacagcattctgtttatagtattcatcattctcttggttgtcactgcttttatcaccgtgtcattgacatatttccaacttgctgctgaagaccatgagtggtggtggaggtctttcctttgtggtggatcaactggcctgttcatctatggctactgcttgtattactaccatgcacgatcagatatgtcaggcttcatgcaaacatcgttcttctttgggtacatggcttgcatttgctatggtttctttctcatgcttggggttgtcggtttccgtgcttctttattctttgttcgtcacatataccgatctatcaaatgcgagtagcaagtcactcggtctccttgaagttcaacaggtggtctgtttttcctttagtgggctcatttctggatactaaaccaagttca

SEQ ID NO: 1277 - DNA, 2366 bp, Euonymus alatus
gaaaacaacatggagtagtctttagttaaccatctccggttagggagtcattttccttggaatttacgcaaacaccagacaccctttcacgttcagcccactctcattaacacataaatttaatatacatatttaatatacatatatatatgtatgtatatatttgttgttttcgcgagcctttccatctttaaaagagtgaaccgagcgtgatcgaacccgaaaagaaaagaaaaaacacggaggagaagaggataatggcgtgcatcgttgcggccgtgttgatcctctgcggactatcccaggtgagatccgatgcatctgatcatcggttcaaagtcggcgacgacgtccctctctacgccaacaaggtcggtcctttccacaatccgagtgaaacctatcgctactttgatctcccattctgctcatcagcccctgtcaaggaaaagaaggaggctcttggtgaagtgctgaatggagatcgattggttagtgcaccttacaagcttgactttctgaatgagaaagagtctgaagttgcttgcaagaggaggctgacaaaggaacaagttactcagttccgacgtgctgtttccaaggactactattttcaaatgtattatgatgacttgccaatatggggtttcttaggaagggttgacaaggaaggcaaaagtgacccaagcgagtacaaatattacctttttaggcatcttatttttaatatcttttacaataaggatcgagtcattgagattactgtgcaatctgatccaaactctttagtggacattactgaagataaagaagttgaggtggagttcacttacacagttaagtggaaggaaacagaaatcccctttgagaagaggatggagaagtattcacagtcttcttcactgccacatcacttggaaatccattggttctcaataattaattcatgcgtgacagttctcctcttgactggttttcttgccacgattctcatgcgggttcttaagaatgacttttctaaatatgctcatgacgaggagtcagcagacgaccaagaggagactgggtggaagtacatccatggtgatgtatttaggtatccaaagtacaagtctttgcttgctgcagcacttggttctggtacgcagttgtttactctaacaattttcatttttatgcttgctttagttggtgtcttctatccttacaatcgaggtgctctgttcactgcactggttctgatatatgcgcttacctctggcatcgctggctacacggctgcctcgttctattgccaactagagggaacaaattgggtgaggaatctgttattaactggaagcctgttttgtggacccctttttctcacattctgttttcttaataccgttgcaatagcttacagtgctactgcggcattgccttttggaacaattgtggtgattttccttatacttactctggtcactacacccttattagtactgggtgggattgctgggaaaaatagcaaggctgagtttcaggcaccctgtcgcacaactaagtatcccagagagattcctcaattgccttggtatcgaaagtctcttcctcagatggcaatggcagggttcttgcctttcagtgctatctatattgaactttactacatatttgctagtgtgtggggtcacaggatctataccatatacagcatcctctttattgtcttcattattctcttgattgtcactgcttttatcactgtggcattgacatactttcaacttgctgctgaagaccatgattggtggtggaggtcattcttatgtggaggatcgactgggctgttcatttatggctactgcttgtattactactatgcacgatctgacatgtcgggcttcatgcaaacgtcatttttctttggatacatggcttgcatctgctatggtttcttgctcatgctcgggactgtaggttttcgtgcttctttgttcttcgtccgtcatatctaccgctctatcaagtgcgagtagcaagtcacatggtcttccatatgttccatggagaaggatgaattcagggttgtttgggtccatgcttctggacttgtctgaggttttagggtgttgcttcgagaaagaggagttgcatatatatatctacattccttcgatggaaatgttgatgttggagtgtaggatgccatgaagcagctggtagtacctgatgcatgttacatttttctttttgtttggtagtaattttttgttgggacaaaatgtagacagtaaaagatgcatgggaaaattaagactcataatacttgcacgttatgacatcctttataacatgcttctcgcaatttttgctcttgaccg

SEQ ID NO: 1278 - DNA, 2184 bp, Catharanthus roseus
tcaggctcagagggcttatcatcgagatctgcttctctctcttcttctctttctctctctctctctctcttgcatgagcaaattgaagacgagtatgatggaaaggaggtggtggaatccctacgccgttatatttatcgcagtcttaatttgcttcgcggttgaggtaagatcagatgcttcggatcacaaatacaatcctggagatcaggttcctctttatgctaacaaggtcggacctttccacaatcctagtgaaacctatcggtattttgatctcccattctgttctccagctcatgtcaaagagaagagagaagctcttggtgaagtcctgaatggtgaccgcttggttgtttctccttataagctggagtttttatctgataaagactctgaaattgtttgtaaaaagaattgtccaaggaagaagttgctcaatttcgaagtgctgtctcaaaggactactacttccagatgtactatgatgacttgcctctatggggtttcttagggaaggttgaaaaaaaggaaagctgatcccagtgaatataaatattatctatttaagcatcttcactttgaaatcttttacaacaaggaccgagttattgagattattgcacgaactgatcctaatgctctggtagatattactgaagacaaggaagttgatgttgatttcatgtactctgtgaaatggaaggagactactaccgcttttgaaaagaggatggagaagtattcgcagtcttcttcactgccacatcaccttgaaatccattggttttcaattatcaattcatgtgttacggtcctcctcttaactggttttctggccactattttgatgagagtccttaaaaatgattttgttaaatatgctcatgatgaggaggcagcagatgatcaagaagaaactgggtggaagtatattcatggtgatgttttcaggtaccctaagtacaaatctgtacttgctgctgctcttggatccggtacacagctattcacaattacaatctgcatatttatacttgcacttgttggagttttttatccttacaaccgaggagcgctgttcactgctttggtgatcatatatgcacttacatctggaattgctggctatactgcatcgtctttctattgccagctagagggaacaaattgggtgagaaacgtgttgttgactggaggcctgttctgtggaccactgtttttaactttttgcttcttgaacactgttgctatcgcttacagtgctactgcagctctgccttttggtactatcgtggtcatctttctcatatgggcacttatcacatcacctttgctagtcatgggtgggattgcaggaaagaatagcaaggctgaatttcaagctccatgtcgtacaacaaagtatccaagggagatcccaccattaccttggtatcgagcaacgctccctcaaatggcaatggctggtttcttgcctttcagcgccatatatattgaactctactacatctttgctagtgtgtggggtcataggatctacaccatctacagtatcttattcatcgtcttcattattctcgtcattgtcactgcatttatcacgatagcactgacatatttccagcttgctgctgaagaccatgaatggtggtggaggtctttcctttgtggtggatcaactgggttgttcatctatggttactgcttgtattactattatgcaagatcagacatgtcaggattcatgcaaacttcattcttcttcggatacatggcatgtatatgctatgctttcttccttatgcttggaacagttggtttccgtgcagcattgttctttgtccgacatatataccactcaatcaagtgcgaatgagaagttggatgacgaatcatcctttgttcagtaggtatgtcttctttgtagaaaagtctatttgcgttttagcgaactgaaaaatagttgttcaaacaccaatcgctagcagcagcagggagattacaaggcataccatttccggattttgtcaaaggctagggtgtttaatgtggtggtttgtcgctgcacagtgcataattttcaaactaggattagagattgtgttagtgcgatgtcaaataggaggacaaaatcgagtgagaaaggctgcaggcatagtaaaagcagagcagacttctatt

SEQ ID NO: 1279 - DNA, 2032 bp, Helianthus annuus
atctgtgggcgttgtgcagagaccaaagatgacgacgatgaccgtgatccggtggttgctggtggcgttaacggtgctacaagtccgatcaggtgcctccgatcacaaatacaaacctaacgatgaagttcctatctacgccaacaaagtcggcccctttcataaccctagtgaaacataccgcttttttgatcttccattctgtttaccagctcatttaaaggagaagccagaagcacttggtgaagtactgaacggagatcgtttagtaagtgctccttataagcttgagtttatgcgcgaaaaggactctgaacttgtttgcagaaaaaaactaacaaaagcggaagtatccaaatttcgaaaagctgttgccaaggattactatttccaaatgtactacgatgacttgcctttttggggctttctagggaaggttgaaaaagacaaaactgaccctagtgaggagaagtattacctgtttaagcatcttcattttgagatccactacaataaagatcgtgtgatagagataaacgcaaaagccgatcctaatgctgttgtggatctcactgatgataaagaagttgaggtggagtttctgtacactgtgaagtggaaagaaaccgatattccgtatgagagtcgaatggagaaatactcccagacttcttcacagccacatcacctggagatccattggttttcgattattaattcgtgtgtcacggttctccttttaactggttttcttgctaccattcttatgcgggttcttaagaatgactttgttaagtatgctcatgatgaagaggaagctgatgatcaagaggaaaccggttggaagtacattcacggtgatgttttcaggtacccgaagtacaagtctctgtttgccgctgcacttggttccggcacccagctattttcccttgcactttttatttttgggctagctctagttggtgtattttatccatataaccgaggaactctgtttaccgcactggttgtcatatatgcacttacttctgggattgcaggctacaccgcagcctcgttttatcaccagctagaaggaactaactgggtgaggaacttactaatgacaggctgtctattctgtgggcccctctttcttactttttgctttctaaacactgttgcaatcgcgtacaccgccactgctgctctacccttcggtacaatagtggtgattgtgttaatatggacattggtgacttcaccgttgttagtattgggcggtattgctggcaaaaacagcaaggctgaatttcaagcacccgttcgcaccacaaaatatcccagagagatcccgccgttaccgtggtaccgtaaaaccgtcccgcaaatggccatggctggttttcttcctttcagtgcaatctacattgagctttattacatctttgccagtgtgtggggccacaagatttataccatttacagtatcttatttatagtctttatcatcctcctaattgttaccgcctttataactgtggcattgacttatttccaacttgctgctgaagaccatgaatggtggtggaggtctttcttgtgtggggggtcaaccggtgttttcatctatgggtattgtttgtactattattatgaacgttctgacatgtcgggattcatgcagacatcgtttttctttggttacatggcttgtatatgttatggtttctttctcatgcttggaatggtcggtttccgggcggctttgttctttgttcgccatatctaccgctcaatcaagtgtgaatagaagcttagtgttcaaacagctgctgctgctgccgccgccgctgccagggtgaaaccatcaaaactatgaaaactagtttacttgatgagtgttttgatatactagtttatgttgtttcattttccgtttgataggaatcaaatcatacctagtcaattttggacatacattttaatatgtagcttgtaattagatttcagtttgtgcaactccagttactatatgcgcagattttct

SEQ ID NO: 1280 - DNA, 2129 bp, Arnica chamissonis
agcgccaacggcagcagacgtcaaagatgtggaagaagatgtcggtgatacggtggttgttggtggcgctgctagtgaccttttgcgttgacgaagtccgatcaggtgcatcagatcacaaatacaaacctggtgatgaagtacctatatacgccaacaaagtcggtcccttccataaccctagtgaaacataccgattctttgatctacctttctgtttgccagctcatttaaaggagaaaccagaagctcttggtgaagtactgaatggagatcgtttagtcagtgctccttataagcttgactttatggttgaaaaagactctgaaattgtttgcagaaaaacactgacaaaagatgaagtatctaaatttcgaaaggctgttaccaaagattattattttcaaatgtattatgacgacttaccattttggggctttctagggaaggttgaaaaggataaaaatgaccctaatgaggaaaaatgttacctttttaaacatcttcactttgagatccactacaataatgatcgtgtgatagagataaatgcaaaagctgatcctaatgctgtagcggatctcactgaagacaaggaagttgaggtggaatttatgtacacggtgaggtggaaagaaacaaatactccttatgaaactaggatggagaaatacgcgcagtcttcttcccaaccacatcacctggagattcattggttttcaatcatcaactcatgtgtgacagttctcctcttaactggtttccttgccaccattcttatgcgagtccttaagaatgactttgttaagtatgctcatgatgaggaggaagctgatgaccaagaggaaaccgggtggaagtacattcatggtgatgttttcaggtatccaaagtacaaatcgctgtttgctgctgcgcttggttctggtagtcagctatttgctcttgcgctttttatatttatactagcccttgttggtgtattttatccatacaatcgaggagctctgttcacagcactggttgtcatatatgcacttacatctgggattgctggctacactgcagcctccttttatcaccaactagaaggaactaactgggtgaggaacttactgttgactggctgcctgttttgtggacccctctttctgactttctgctttctaaacactgttgcaatcgcttatactgctactgctgccctgccctttggtacgatcgttgtgattgtcttaatatggacattggtgacatcaccattgttagtattggggggtattgctggaaagaacagcaaggctgagtttcaggcacccgttcgcaccacaaagtatcccagagagatcccacctttgccatggtatcgcaaaaccgtccctcagatggccatggctggttttcttcctttcagtgcaatctacatcgagctttactacatatttgctagtgtttggggtcacaggatttacaccatttacagtattttatttatagtttttatcatcctcctcattgttaccgcctttatcactgtggcattgacttatttccaacttgctgctgaagaccatgaatggtggtggaggtcttttctctgtggtggttcaacgggtgttttcatctttggttattgcttgtattactactatgagcgatctgacatgtcgggattcatgcaaacatcgtttttcttcggttacatggcttgcatctgttatggtttctttctcatgcttgggatggttggtttccgtgctgccctgttctttgtccgacacatatatcgctcaatcaagtgtgaatagaagctcaatattcaatctacagtactcagacaggcgctgatgcttctgctagggcccaatgtgaaagcgtaaaggtagcaagaaccatattacatgtcgctcggataatgaattggtctcaattatgtttattaggtcaataagatgaaatgatgtttaatatgttggtagtttgaactatacaggctcgatttttgagatatattgtttgaaactgtagcttgtaattgaactcttgtcttgtcctgttataaacatgtctttaccaccattggctttctatgtgacatctgctgatgggtgtttgactaggatgaaact

SEQ ID NO: 1281 - DNA, 2122 bp, Lactuca sativa
gggggatggagtctacaagtgaattcatctattttacatacacattttatctgcagcagacaccaaagatgctgaagaaaatggccgtgatccggtggttagtggtggcgttactgctggtttttcgcatccaagaagttcgttcaggtgccgatcacaagtacaaagaaaaagaggaagttcccatatacgccaacaaagtcggccccttccataaccctagtgaaacataccgcttttttgatctacccttctgtttaccagatcatttaaaggagaagccagaagctcttggtgaagtactgaatggagacagattagtcagtgccccttataagcttccatttatggttgaaaaagagtcagaaactgtttgcagaaaaaaactaacaaaacaggaagtattaaaattccgaagtgctgttgccaaggactattatttccaaatgtactatgatgacttgcctttctggggctttctagggaaagttgaaaaagacaaaaatgaccctagcgaggaaagattttacctttttaaacatcttcactttgagatcctctacaacaaagatcgtgtcatagaaataaacgcgaaagctgatcctaatgctgtggtggatctcactgaagacaaagaagttgaggtggagtttatgtatacagtcagatggaaagaaacaaatattccttttgagaatagaatggagaaatactctcaatcttcttcccaaccacatcatttggagattcactggttttcaattatcaactcatgtgtcactgttcttctcttaaccggttttcttgccaccattcttatgcgtgtcctcaagaacgactttgttaagtatgctcatgatgaagaggcagctgatgatcaagaggagactgggtggaagtacattcatggtgatgtgtttaggtatccaaagtacaagtctttgtttgctgctgcccttggttctggaacccagctatttgctctagcactttttatcttcatactcgcacttgttggtgtattttatccatacaatcgaggagctcttttcactgcactcgttgtcatatacgcgcttacatctggaatcgcaggctacactgcatcctctttctaccaccagctagaaggaagcaactgggtaaggaacctactgttaaccggatgcctcttctgtgggcccctctttctaaccttctgcttcctaaacacggttgcaatcgcatacacagccacagctgcactaccctttgggacaattgtagtgattgttttaatatggagtttggtgacatcaccattacttgttctcgggggcattgctggaaaaaacagcaaagctgagttccaagctcctgttcgcaccacaaagtatcccagagagattccacctctcccatggtacagaaaaaccatccctcaaatggccatggctggctttctcccttttagtgctatctacattgagctttactacatcttcgccagtgtgtggggccacaggatttacaccatttacagcatcttatttattgttttcatcattctcttgattgtcactgccttcatcactgttgctttgacatacttccaacttgctgctgaggatcatgaatggtggtggaggtctttcctatgtggagggtcaacgggtgttttcatatacgggtattgcttgtattactactatgaaagatcagacatgtctggattcatgcagacctctttcttcttcggttacatggcttgcatttgttacggcttctttctcatgctcgacatgatcggtttccgtgccgcccttttctttgttcgccacatctaccgctcaattaagtgtgaatagaagctcaaacctcaatgttcaggggctgtttcaaccaggggaaaagaaaaagatgaaagctatgagaacaaagtgtccgagttagatgtttgatggatgttttgatagtttatgttgttttttttttaatatatatttttaaagtttgacgagaggaagggaattgaaaagtagctactcaattttggctttgggcatacatacttgtctttttcatttttaaatctgtacttctgtagcttgtaattaatgtttgtattagttcttacttattg

SEQ ID NO: 1282 - DNA, 2203 bp, Populus trichocarpa
caaccgtgacaaaccaaaggagtctccaaatttataagtctcgcttcctcgatctatctctttatgcatctgtgtctgtgagatacagttagagaaagaaaatggagaagaaactagtgccttgtttggtagtctctattttgatattttgcagtgtgacccatgttagatcagatgcatctgatcatcgttacaaagtaggagaggatgtccctctttatgtcaacaaggttggaccgtttcacaatcccagtgaaacataccgctattttgatcttcctttctgttcatcaggtccgacaaaggacaagaaggaagcccttggtgaagtgttgaatggtgatcgtctagtcactgccccatacaaacttgactttttaaatgacaaagactctgaaattgcttgcagaaagaggttgacaaaggagcaagttgctcagttccgggaagttgtttccaaggactactacttccaaatgtattatgacgacttgcccatttggggtttcttagggaaagttgacaaggaaagaaaaaatgacccaagcgaatacaaatattacctctttaaacatcttcactttaccatcttttacaacaaggatcgtgtcattgagatcactgcacaatctgatcttaacaatgttgtggacctgactgaagataaggaagttgatgtggagtttatgtactcagttaaatggaaggaaacagaaattccatttgagaaaaggatggagaagtattcgcagtcttcttcactgcctcatcacttggaaattcattggttttccattattaactcatgtgtgacagttctcctcttgactggttttcttgccacaattctcatgcgagtcctgaagaacgattttgtcaagtatgctcatgatgaggagtcagctgaagaccaagaagagactgggtggaagtacatccatggtgatgtatttagatatccgaagtataagtctttgcttgcagcagcagttggctctggcacccagctgtttaccctcacaattttcattttcgtgcttgcacttgttggtgtcttttatccttataatcgtggagctctatttactgcactggttgtcatatatgctctgacagctgggattgcaggctacactgcagcctctttcttttgccaactggaaggaacaaattgggtcaggaacttgttgctaactggagccctgttttgtggtcctctgtttctcaccttttgctttcttaatactgttgcaattgcatatagtgccactgcagcattgccatttggaacaatagtggtgatatttcttatttgggctctggtaacaacaccattgctggtattgggtgggattgcagggaagaatagcaaggctgagtttcaggctcctgtccgcaccactaaatatcccagagagattcctcagttgccttggtatcggaaaacacttcctcagatggccatggcaggattcttgcctttcagtgcaatatatattgaactttactacatatttgccagtgtttggggtcacaggatctacaccatttacagcatcttgttcattgtcttcatcattctcttgattgtcactgcttttataacagtggcgttgacatatttccaacttgctgctgaagaccatgagtggtggtggaggtctttcctctgtggtggatcaactggcctgttcatttatggctattgcttgtattactactatgccagatcagatatgtccggcttcatgcaaacctcatttttctttggctacatggcctgtgtttgttacggtttcttcctcatgcttggcagtattgggttccgtgcttccttgttctttgtccgccacatctaccgttcaatcaagtgcgagtaggaagtcatatggtcttccttatgttcagagaagccacagttggctgggaaaacttgttctgggatcgcaggagctttatgctactcatggaggatgatggcacgttccgtggaggacttctgtaataaccctttttttataggagaggaacatgtagggctttagaatgctgttaaagaatttgcagtgcttcaatgtgagataatccatcattttgaatgtattctatcactgttagaagccgtagagtttgtgttactggtagcagtacttcgaaaattcttgtctccacaatttattatagttgcaaaatacatgttctg

SEQ ID NO: 1283 - DNA, 2351 bp, Populus trichocarpa
gaaccattttagatttgttggagccacaacccataaagtctccatctttataaatctctctcctctctctctcaccccataactatcttactctctcttctctttttgtgagttacagtaattgaaaatggagaagaaactagtgccttgtttggtttcatttgttttgatattgtgcagcgtgtcccatgttagatcagatgcatctgatcatcgttacaaagttggagatgatgtccctctctatgttaacaaggttggaccttttcacaatcccagtgaaacataccgctactttgatctgcctttctgctcatcaggtcctacaaaggacaagaaagaagcccttggtgaagtgttgaatggggatcgtttagtcactgccccatacaaacttgactttttaaatgacaaagattctgaagttgcatgcaaaaacacgctgacaaaggaacaagttgctcagttccgagaagcagtttccaaggactactacttccaaatgtattatgatgacttgcccatttggggtttcttagggaaagttgataaggaacgcaagaatgaccctagtgaatacaaatattacctgtttaagcatcttcactttaccatcttttacaataagtatcgtgtcattgagatctctgcacaatctgatctgaacaatgttgtggaccttactgaagataaagaagtcaatgtggagttcatgtattcagttaaatggaaggaaacagatataacatttgagaaaaggatggacaagtattcacaatcttcttcacttcctcatcacttggaaattcattggttctcaattattaactcatgtgtgacagttctcctcttgactggttttcttgccacaattctcatgcgagtcctgaagaatgattttgtcaaatatgctcatgatgaggagtcagctgaagaccaagaagagactgggtggaagtacatccatggtgatgtatttagatatccgaagtataagtctttgcttgcagcagcagttggctctggcacccagctgtttaccctcacaattttcattttcgtgcttgctctagttggtgtcttttatccttataatcgtggagctctatttactgcactggttgtcatatatgctctgacagctgggattgcaggctacactgcagcctctttcttttgccaactggaaggaacaaattgggtcaggaacttgttattaactggagccctattttgtggacccctgtttctcactttctgctttcttaataccgttgcaatcacgtatagtgccactgcagcattgccatttggaacaatagtggtgatatttcttatttgggctctggtaacaacaccattgctggtactgggtgggattgcagggaagaatagcaaggctgagtttcaggctcccgtccgcaccactaaatatcccagagagattcctcagttgccttggtatcggaaaacacttcctcagatggccatggcaggattcttgcctttcagtgcaatatacattgaactttactacatatttgccagtgtttggggtcacaggatctacaccatatacagcatcttgttcattgttttcatcattctcttgattgtcactgcttttataacagtggcgttgacatatttccaacttgctgctgaagaccatgagtggtggtggaggtcgttcctttgtggtggatcaactggattgttcatttatggctattgcttgtattactactatgcaagatcagatatgtcaggcttcatgcaaacctcctttttctttggctacatggcctgtgtttgctatggtttcttcctcatgcttggcagtattgggttccgtgcctccttgttttttgtccggcacatttaccgttcaatcaagtgcgaatagcaagccatatcatcttcagtatgttcaatgggtgaagcagcagttggctgggaaatctgctcctggattgatggagttcaatgtcacaacttttgagaatgctggcacatcacatgtaggacttttaagatcttttataggaagggaatcaagggattgtgtaggactttagaatgcagttaatgatttgtaagcacaagctgtctgtttggagtcaattgtaagctaccgccgttatttaacagaaaacaagtgccccattgtcggcaatggcgagtctcagacaattacagctatggtgccgatacataatggtaacggccgttattgtaaaaataactggtcaataacggactactcactcatatgattgttgtcttcgcattttggtttcaagtttcacacttcacctcttctgatagttataatatagtgcttaatgctt

SEQ ID NO: 1284 - DNA, 2208 bp, Plantago ovata
aacaaaatatacatctcactccatcacttcagatctgcaattgggattcacaccagcaaacgacgaggtggaaatcgaagatgtcgtcgtctaagcaagcttggtggtggtggtcctacgccgtggtcttggcgctcggatgcatcgccgtcggtgtgagatcggatgcatcggatcacaaatacaagatgggcgagacagtgcctctctacgccaacaaagtcggccccttccacaaccctagtgagacatacaggttctttgatctccccttctgttctacaggtgatgtgaaagataagagtgaagctcttggtgaggtgctgaatggagaccgattagtcagtgccccttacaagcttgactttctagttgataaagagtctgaagttatctgcacaaagaagttatcaaaggaagaagttgctgtgttccgaagtgcagttgcaaaggactactatttccagatgtactacgatgacctacccatatggggtttcctggggaaggttgacaaagaaggcaaatctgatcctagcgagtacaagtattatctattcaagcatctccatttcgaaatcttttacaacaaggatcgtgtgattgagatcaatgcgcgcacagacccaaacgccctcatagaccttactgaagacaaggaggtttcagttgaatttacctactcatcgaaatggaaagaaactagcataacttttgagaacaggatggagaagtactctcattcatcttcacttcctcgtcatctggagatacattggttctcaattatcaattcgtgtgtcactgtcctacttcttactggatttctggccactattctgatgcgagttctcaagaatgattttgtgaaatacgctcacgatgaagaggcagcagatgaccaagaagaaactgggtggaaatacattcatggtgatgttttcagatttccgaaatacaagtctgtatttgctgcagcccttggcagtggcactcagctctttgccctggcaactttcatattcttacttgctcttgttggcgtgttttatccatacaaccgaggggcactctttactgccttggtggtcatatatgcccttacatctggcattgcaggctatacagcagcatctttctactgccagttagaaggaacaaattgggtcaggaatttattgttgactgggggcctgttctgcggaccactgtttctgaccttttgcttcctgaacactgttgctattgcttatcatgcaacggcagctctgcccttcggaactattgtggtgattttcctgatatgggctcttgtgacatcacctctgttagtgatgggaggcattgctgggaaaaatagcaaggctgagtttcaagccccttgccgtaccacaaaatatcctagagaaatcccacccctaccttggtacaggagtaccattcctcagatggctatggcaggctttttgccattcagtgccatttatattgaactatactacatatttgccagtgtctgggggcacaggatttacaccatctacagtattctgtttatagtcttcatcatcctcctgattgtgactgcctttattaccgtggcattaacctactttcaacttgccgctgaagatcacgagtggtggtggagatcattcctttgtggtggatctacgggcttgtttatatacggctactgcctgtactactattatgcacggtcagatatgtcaggcttcatgcagacctcatttttcttcggttacatggcttgcgtgtgctatgctttcttcctaatgcttggagctgtaggattccgtgctgctctgttctttgtgcgccacatatatcgctccattaagtgtgaatgagaacattgaggacctgtatcctatctcagtgcagtagcggatgaagatggcaaaccggcattagacagagatagaatattgcagcattcagaagacaatttgttgttgtgagatgtggaaaaacatttccagggaagccaaaggaaattgtctattactcttatattaggacaaatgaacttattatatttttaatactagtatagatcttttattgtcctactgaatggttatgttcttgaaagttttgtattataagagatgtcagaggtgaaacatttgcacgctaactctgttgagatctttcgtttcattagagttttactagtgtatgaaa

SEQ ID NO: 1285 - DNA, 2217 bp, Plantago ovata
aacaaaatatacatctcactccatcacttcagatctgcaattgggattcacaccagcaaacgacgaggtggaaatcgaagatgtcgtcgtctaagcaagcttggtggtggtggtcctacgccgtggtcttggcgctcggatgcatcgccgtcggtgtgagatcggatgcatcggatcacaaatacaagatgggcgagacagtgcctctctacgccaacaaagtcggccccttccacaaccctagtgagacatacaggttctttgatctccccttctgttctacaggtgatgtgaaagataagagtgaagctcttggtgaggtgctgaatggagaccgattagtcagtgccccttacaagcttgactttctagttgataaagagtctgaagttatctgcacaaagaagttatcaaaggaagaagttgctgtgttccgaagtgcagttgcaaaggactactatttccagatgtactacgatgacctacccatatggggtttcctggggaaggttgacaaagaaggcaaatctgatcctagcgagtacaagtattatctattcaagcatctccatttcgaaatcttttacaacaaggatcgtgtgattgagatcaatgcgcgcacagacccaaacgccctcatagaccttactgaagacaaggaggtttcagttgaatttacctactcatcgaaatggaaagaaactagcataacttttgagaacaggatggagaagtactctcattcatcttcacttcctcgtcatctggagatacattggttctcaattatcaattcgtgtgtcactgtcctacttcttactggatttctggccactattctgatgcgagttctcaagaatgattttgtgaaatacgctcacgatgaagaggcagcagatgaccaagaagaaactgggtggaaatacattcatggtgatgttttcagatttccgaaatacaagtctgtatttgctgcagcccttggcagtggcactcagctctttgccctggcaactttcatattcttacttgctcttgttggcgtgttttatccatacaaccgaggggcactctttactgccttggtggtcatatatgcccttacatctggcattgcaggctatacagcagcatctttctactgccagttagaaggaacaaattgggtcaggaatttattgttgactgggggcctgttctgcggaccactgtttctgaccttttgcttcctgaacactgttgctattgcttatcatgcaacggcagctctgcccttcggaactattgtggtgattttcctgatatgggctcttgtgacatcacctctgttagtgatgggaggcattgctgggaaaaatagcaaggctgagtttcaagccccttgccgtaccacaaaatatcctagagaaatcccacccctaccttggtacaggagtaccattcctcagatggctatggcaggctttttgccattcagtgccatttatattgaactatactacatatttgccagtgtctgggggcacaggatttacaccatctacagtattctgtttatagtcttcatcatcctcctgattgtgactgcctttattaccgtggcattaacctactttcaacttgccgctgaagatcacgagtggtggtggagatcattcctttgtggtggatctacgggcttgtttatatacggctactgcctgtactactattatgcacggtcagatatgtcaggcttcatgcagacctcatttttcttcggttacatggcttgcgtgtgctatgctttcttcctaatgcttggagctgtaggattccgtgctgctctgttctttgtgcgccacatatatcgctccattaagtgtgaatgagaacattgaggacctgtatcctatctcagtgcagtagcggatgaagatggcaaaccggcattagacagagatagaatattgcagcattcagaagacaatttgttgttgtgagatgtggaaaaacatttccagggaagccaaaggaaattgtctattactcttatattaggacaaatgaacttattatatttttaatactagtatagatcttttattgtcctactgaatggttatgttcttgaaagttttgtattataagagatgtcagaggtgaaacatttgcacgctaactctgttgagatctttcgtttcattagagttttactagtgtatgaaaagactaaga

SEQ ID NO: 1286 - DNA, 2211 bp, Tabernaemontana elegans
gccctcgctctctcagactcttctacctcagggcttatcggcgagatctgcttctctctcttctcccctttctctctttctcttgcatgagcaaatttaggaccgagatgatggcgaggagatggttaaatccctacgcctttgtatttcttgtagtcttagtttgcttcgctgtagaggtaagatcagatgcttcggatcacaagtacaaacctggagatcaggttcctctttatgcgaacaaggtcgggcctttccacaatcctagtgaaacctatcgttatttcgatctccccttctgtgctccagctcatgtcaaagagaagagggaagctctcggtgaagttttgaatggtgaccgtttagttgttgctccttacaagctagaatttttatctgataaagactcagaaattgtttgcacaaaaaaattgtcaaaggaagaagttggtcaatttcgaagtgctgtctcaaaggactactacttccagatgtactatgatgacttgccgctatggggtttcttagggaaggttgacaaggaaaggaaagctgatcccagcgaatataagtattacctatttaagcatcttcactttgaaatcctttgcaacaaggaccgtgttattgaggttaatgcacgaactgatcctaatgctctggtggatattactgaagacaaggaagttgatgttgatttcatgtactctgtgaaatggaaggagacaaccacagcttttgaaaacaggatggagaagtattctcagtcttcttcactgccacatcaccttgaaatccattggttttcaattatcaattcatgtgttacggttctcctcttaactggttttctggccacaattttgatgagagtccttaaaaatgattttgtcaaatatgctcatgatgaggaggcagctgatgatcaagaagaaactgggtggaagtatattcacggtgatgttttcaggtatccaaagtacaaatctttacttgctgctgctcttggatctggtacacagctattcacacttacaatctgtatatttatacttgcacttgttggcgtattttatccttataaccgaggagctctcttcactgctttggtgatcatatatgcacttacatccggagttgctggatatactgcagcctctttctattgccagctggagggaacaaattgggtgagaaatgtattgttgactggaggcctattctgtggaccactatttttaactttttgctttttgaacactgttgctattgcttacagtgctactgcagccctgccctttggtactattgtggtaatctttctcatatgggcacttattacgtcacctttgctagtcatgggtgggattgcaggaaagaatagcagggctgaatttcaagctccatgtcgtacaacaaagtatccaagggagatcccaccattaccttggtatcgtggaactctaccccagatggcaatggctggtttcttgcctttcagcgccatatatattgaactctactatatctttgctagtgtgtggggtcataggatttacaccatttacagcatcttattcattgtcttcattattctcctgattgttaccgcatttattacggtagcgctgacatatttccaacttgcggctgaagaccatgaatggtggtggaggtctttcctttgtggtggatcaactgggttgttcatctatggttactgcttgtattactattatgcaagatcagatatgtcgggcttcatgcaaacatcgttcttctttggatacatggcctgtgtatgctatgccttcttccttatgcttggaacagtcggtttccgtgcagcattgttctttgtccgacatatatatcgttcaatcaagtgcgagtaagaagttggatgaccaattatcccctgttcagtaggtatgtcttctttgtagaaagcatgttgtgttttagtgcagcactgagaaatattgttcaaacactaatcacaagcagcaggagttaaaggctgtatggtccaggacgttgtgaaaggctaagaagttacttgtggtgagtgtttctgcttatggcataattttcaagctcgggttagtggccctgtcagcgcgaacatgaaatatgagaatacctctgtggaaaagccaaattgagtcaaagggctgcaggcattacgaggaaagcagacttttatttgtt

SEQ ID NO: 1287 - DNA, 2269 bp, Vinca minor
actgcttaaatcgagatctgtgccttcttatttttctatagacgcagagattagttgtggtctgtgcgtcggtgattgaatgtgaaaatggagctctggggaatggggagatggccggtcgtcgtcgttatgatcgtcttcttgtcaatggtagccggagtaaaatcggacggctccgatcacaagtataaagctaaggatcaggttcctctctatgctaacaaagtcggacctttccaaaaccctagcgaaacttaccgcttcttcgatctgccattctgtattccagatcatgtgaaagagaaaaaggaagctctaggtgaagtgctgaatggagatcgcttagtcagtgcgccttataagcttgactttttagtcgacaaagactctgagaaagtttgcaaaaagaagttgaccaaggatgaagttgagctatttcgaaaggcagtggcaaaggattactacttcgagatgtattatgatgacttacctgtctggggtttcttagggaaagttgataaggaaggaagatctgatccaagtgaattcaagtattacctttttaaacatctgcattttgagatattctacaaaaaggaccgtgtgattgagatcaatgcacggactgatccaagtgcccttgtagacctcactgaggataaggacgttaatgtagaattcatgtactcagtaagatggaaagagacaaatgttccttttgagaagaggatggataaatattcgaagacttctgcattgccacaccacttggaaattcattggttctcgataattaactcttgtgtgacagttcttcttctcactggctttcttgcaactattctcatgcgagttcttaagaatgactttgttaagtatgctcatgatgaggagactgctgatgaccaagaagaaactgggtggaagtatatacatggtgatgttttcaggtttcctcagtacaagtctctgtttgcagcagcccttggttgtggcactcagttatttatcctggtaacttttattttcattcttgcactggttggtgtattttatccatacaatcgcggagctcttttcactgcacttgttgtcatatatgcacttacgtctggcattgctggctatacagctgcttctttctactgtcaacttgaaggagcaaactgggtgaggaatgtcttattgactggggccctcttctgtggacccttctttcttacattttgctttctaaacaccgtggcgattgcttatagtgccacggctgcactgccatttggtaccattgttgtcatcttcttgatctgggcccttgtgacctcacctttgctggtccttggtggtgtagctggaaagaacgccaagacagagtttcaagctccatgccgtaccaccaaatatcccagagaaattcctccattgccttggtatcgcagcactctgccccagatggcaatggctggatttttgcctttcagtgccatctatattgagctctactacatatttgcaagtgtttggggtcacaggatttacactatctacagtatactatttattgtcttcattattctgataatagttaccgctttattaccgtggcattgacatatttccaacttgctgctgaagaccatgagtggtggtggaggtctttcgtttgtggtggatcaactggactgttcatctatggatactgcttgtactactattatgcacgttcagatatgtcaggcttcatgcagacatcattcttctttggatacatggcttgcatttgctatgggttctttcttatgcttggaactgttggtttccgcgcaacactcttttttgtccgtcatatataccgatctatcaagtgcgagtagtaatttgactatgttttcttctttactcatctttatgattcatgtttcttgtagaacaatattgggtccaagagaactatgtaggacattaatatcttactacagcaccactataggaaaccttgttagacttcggttttgcaattaaaaaaagttatattgatatgctagttttacagtctacccaatcccatcttacttgcaagggattagcactctttaacgcttaattttttctgtcttcatttgaagaaacagaattcttgggttatgcctggcattgtataagggtggtaaaccttagaatgtggaaattgttctattgtgatgctttccggcagggttcctccattgctatatctaaaaataggtagatgacgaaggcaacgaatggt

SEQ ID NO: 1288 - DNA, 1983 bp, Brassica napus
tgacgatgctgctccttctactcggagccctaatcttatccgacgccggctacgtcagatccgactcctcggaccaccgttacaaggaaggagacatcgttcctctctacgccaacaaggtcggcccatttcacaatccaagtgagacgtatcgctattttgatcttcccttctgtgttccagagggtgtgaaagagaagaaggaagctctaggcgaggttctgaacggtgatcgtctcgttagcgcaccgtacaagctcaacttcagagatgaaaaggactctgaggtatactgcaaaaagaagctaagcaaagaagaggtgaaacacttccgcaaagctgttgagaaagactactacttccagatgtactacgatgatctccctatctggggattcatcggcaaggttgacaaagatatcaaatctgatccgagcgagtacaagtattttttgtataagcacatccagtttgagattctgtataacaaggaccgtgtgatcgagatcagtgctaggatggatccgcattctcttgttgatctcagtgaggataaggaagtggatgcggagtttatgtatagtgtgaagtggaaggagaccgagactccgtttgagaagaggatggagaagtactctatgtcttcttctcttccgcatcacttggagatcactggttctccattattaactcgtgtgttactgtcttgcttttgactgggttccttgcaactatattgatgcgagtcctcaagaacgatttcatgaagtatgctcaagacgaggaagctgctgatgatcaagaagaaactggatggaagtacattcatggcgatgtgtttaggttcccaacgcacaactctttgtttgccgcttcactcgggagtggtactcagttgtttacactcaccatattcatcttcatgcttgctcttgttggagtgttctacccatacaaccgaggagcactctttaccgctctggtggtcatttacgctctaacttctggaatcgccgggtacgacatccgcctcttctactgcactcgagaaagactggtgagaaacttgttactcactggatgtctcttctgcggtcctttattcctaaccttctgcttcctcaacaccgtagccataacctacaccgcaaccgcagcattaccctttggaaccattgttgtaattgcccttatatggactctagtcacatcgcctttgctcgtgttaggtggcatcgccggtaaaaacagcaaagcggagttccaagcgccgtgccgcacgaccaagtaccccgcgagattccgccgctcccttggtacagaagcgcggttcctcagatggccatggctggttttcttcctttcagtgccatctacatcgagctttactacattttcgctagtgtgtggggtcacaggatctacaccatctacagcatcctcttcatcgtgttcatcatcctcatcatcgtcactgcttttataaccgtggcgttgacttactttcaacttgctgctgaagatcaccagtggtggtggagatcattcctttgcggtggatctacgggtttgtttatctacgcatactgcttatactactactacgcacgatctgacatgtctggtttcatgcaaacctcgtttttcttcgggtacatggcttgcatttgctacggattcttcttaatgctcgggactgttggcttccgtgcagccctcctcttcgtccgtcacatctaccgatcgatcaaatgcgagtaagaagtctatcttcttacactagtttcttcttctgcctccttagaattttgctagacaagaagacaaagagataggttgttagaacgaagagagagacacaatacattgtttgattatagtctaaagaagcatctcttctcgattaagtaggtttactttagggtgtagtctctctgcttctatatatatatttacagattgtaaaagacgatcaactactgt

SEQ ID NO: 1289 - DNA, 2366 bp, Tropaeolum majus
cggccgggggatgcacgacccgacgaccctttcttttataacaaaaaaattgcttctacaacccatttttatagatccgttcttcacaaactatactctggattcatttcaccactcattcttatttggttcgggactccaatctctgatccttcattgttactggattgaccgccatggatatggtgaagataacgccgtacttggttgcgctgaccgtaatgatcctatgcggtgtcacacatgtgagatccgacgcatctgaccatcgttacaaagtcggagacgatgttcctctctatgcaaacaaagtaggacccttccacaatccgagtgaaacatatcgttactttgatctcccgttttgttcttcagctcccatcaaggaaaagaaggaagctcttggtgaagtgttgaatggagatcgattagtaagtgccccctacaaattagactttttgaatgacaaagactctgaaattgcttgcaagaagagattaactgtagaagatgttactaagttccgagaatcagtttctaaagactactattttgaaatgtactatgatgatttgccaatatggggcttcttgggaaaagttgataaggaaggcaaaaccgattcatccgaatacaagtattacctttttactcatctacagtttgaaatcttctacaataaggaccgtgtcattgagattagtgtacgatctgatccacatacccttgtggatttgactgaggataaagaagtggaagtggacttcatgtacacagttagatggaaggaaactgaaatttcttttgagaacaggatggagaagtactcacactcttcttcattgccacatcatttggaaattcattggttctcaattattaattcttgtgtgacagttcttctcttgactggttttcttgctacaattctcatgagagtattgaagaatgattttgtcaagtatgcacatgatgaggaggaagcagatgaccaagaggagactgggtggaagtacattcatggtgatgtatttaggtatccaaagaacaactctttgtttgcggcagcacttggttctggaacacagctatttgctcttacacttttcatctttatgcttgctttagttggtgttttttacccttacaaccgaggagctctgtttacggcattggttgtcatgtatgcactcacttcaggagttgcagggtatactgctgcgtctttctattgccaattggaaggaactaattgggtgagaaatttgttgctaactggaggtttgttttgtggaccacttttcctcacattctgcttccttaatacggttgcaatagcttaccacgcgactgcagcattgccatttggaacaattgtggtcattttcttgatctggactttggtcacatcacctttactgatacttggtgggattgctggaaagaatagcaaggctgagtttcaagctccttgtcgcaccacaaaatatcctcgagaaattccaccattgccttggtacaggagaactcttcctcagatggccatggcaggctttttgccttttagtgccatatatattgaactttactacatatttgccagtgtgtggggtcacaggatctacaccatatatagcatcctgtttatagttttcatcattctcttgattgtcactgcgtttatcacggtggcattgacatattttcaactggctgctgaagatcatggttggtggtggaggtctttcctttgtggtggatcaacaggtttgttcatatatgcctactgcttgtactactactttgcaagatcagatatgtcaggtttcatgcaaacctcattcttcttcgggtacatggcctgcatctgctacggtttctttctcatgcttgggaccatcggtttccgcactgctttgttatttgtccgtcacatttaccgttccataaagtgcgagtaagaagttccaccaagttatacctctcttcaacaggttctgctagaccatcggttcttcagagttgtattcaagcttctgtcgtgattacacgtagagactcatttcgtgttctcgtttcgttttccatggtcaactgttgatggagaggatctgttaggatggtaggataccctaaaacaaaggtttgcagttcttgaatgcgagttcggagtacttgtttcatctgaagcggttgactcgtagttttattttgagaaaactatgtaaagactaggatattttaatacaaggttgtacaacgttatatggagtggagtcaaattgtaaattttgttcttgagatttaatgggtttcctttcttggtcacctttaccgttttctcactcaatagattactgatgctt

SEQ ID NO: 1290 - DNA, 1776 bp, Manihot esculenta
atgaaaatttcttcaataattcttcttctcgcgcttttaattgcctgttctgtaactcaagtgatatcggacgcctccgatcaccgttacaaggatggcgattctgttcccctctatgccaataaggtcggcccatttcacaatcccagtgaaacgtatcgctattttgatctgcccttctgtgttccagaacacctgaaagagaaaacagaagcccttggtgaggtgttgaatggagatcgtctcgtcagcgcgccttacaaactcaactttagagatgagaaagacacagcagttgtttgtcggaagaagcttagaaaggaagaagttgctcggttccgatctgcagttgacaaagactattactttcaaatgtactatgacgatttgccaatttggggtttcataggaaaagttgacagggaaggcaaggctgaccgaagtgaatacaaatacttccttcacaagcatatccaattcgatgttctttataataaggaccgtgtgattgaagtaagtgcccatatggatcctcattcactgttggatctgacagaggacaaggaaattgttgcggagttcctttatactgtgaagtggaagcaaacggatattccctttgagaagaggatggagaagtattccttgtcttcttcatcgccacatcacttggaaatccattggttctcaattataaactcttgtgtaactgttctccttttgaccggttttctcactacaattctcatgcgggtcttgaagaatgacttcatgaagtatgcacaagatgaggaagctgctgatgaccgggaagagactggatggaagtacatccatggtgatgtatttaggtacccaacatacaaatctttgtttgctgctgcccttggttctggcacccagttgtttacactcaccatttttatttttatgctagccttggtcggcgtattttatccatataatcgaggagctctatttactgcactagtggttatttatgcgcttacttctggaattgctggatatactgcaacctctttctattgtcagctggaaggaaagaactgggtgaggaatcttttgttaacaggatgccttttctgtggacctctgttcctcacattctgcttccttaacactgttgccataatttacagcgcaactgctgcattgccttttggcactattgtggtgatattccttatatggacattggtaacgtctccattacttgtattgggtggcattgctgggaaaaatagcaagggtgagtttcaagccccttgtcgaaccacaaaatatcctcgagagatcccacagttgccatggtacaggtgtgctcttcctcagatggcaatggcaggttttctgccttttagtgctatctacattgagctttactacatatttgcaagtgtctggggtcacaggatttacaccatctatagcatcctgtttatcgtcttcattattcttctaactgtcacgggtttcataactgtggcattgacgtacttccaacttgctgctgaagatcatgaatggtggtggaggtcttttctatgtggtggatcaactgggttatttatctatgcttactgcttgtattactactatgcacggtcagatatgtctggcttcatgcaaacttctttcttctttggatacatggcatgcatatgctatggcttctttcttatgcttggaacagtgggattccgtgcctcccttctctttgttcgccacatttactggtcgattaaatgtgagtag

SEQ ID NO: 1291 - DNA, 1958 bp, Solanum lycopersicum
atatatatatattcatgtatacaacggagatggagaagaagatgatgagttacgtcgtcgttttgatcgttttgtgttgtggggttactccggcgagatcggacggttccgatcataagtacaaggccggagatcaggttactatgtatgctaacaaggttggtcctttccataatccaagcgaaacgtaccgattctttgatcttccattctgtgcaccagctcatgtgactgagaaaaaggaagctcttggtgaagtcttaaatggtgatcgattggtcagtgctccttacaagctcgactttatgtacgacaaggactcagaaatagtgtgcaaaaagaagttatcgaaggaagaagtttctctattccgtaatgccgttgccaaggactattacttccaaatgtattatgatgacttgcccatttggggtttcttagggaaagtcgataaggagggaaaaacagatcccagcgagtacaaatattacctgtttaaacatctccattttgagatcttttacaacaatgatcgtgtggttgagatcaatgcacgaactgatcctaatgccttggttgatatcacagaggataaggaagtagatgttgactttatgtactctgtgaaatggaaggagtcaactactccttttgagaagaggatggaaaaatactcacagtcatcatcaatgccacatcacttggaaatccattggttctcaattatcaactcctgtgtgacagttcttctcttaactggttttctcgcaacaattcttatgcgcgttcttaagaatgactttgtcaagtatgcacatgatgaggaggcagctgatgaccaagaagaaactgggtggaaatacattcatggtgatgtttttaggtatccgaagtacaaatcgttgttggctgctgctgttggttctggtacccaactctttacaatgaccatctttattttcattcttgcacttgttggtgttttctatccttacaatcgtggagctttattcactgcactggttgtcatatatgctctcacgtctgggattgctggctatactgcatccgctttctactgtcaactagaaggaacaaactgggtcaggaacttgatattgactggggcattgttttgtggaccgctgtttctcacattctgctttcttaactccgttgctatcggctacactgccactgctgcgctaccttttggaaccatcatggtcatttttctaatatgggctcttgtaacatcacctttgctcgtattgggagggatagctggaaagaatagtaaatctgaattccaagctccttgtcgtaccaccaagtatccaagagagataccgccatcgccttggtaccgtggaactctgtctcagatggcaatggctgggtttttgccttttagtgccatatatattgaactttactacatatttgcaagtgtttggggtcacagaatttacacaatttacagtatcttgtttatagtcttcattatccttctaattgtcaccgcttttataaccgtggcattgacatacttccaacttgctgctgaagatcacgaatggtggtggagggctttcctttgtggtggatcaactggactgttcatctacggatactgcttgtattactattatgcacgttccgatatgacagggttcatgcaaacctcattcttcttcgggtacatggcttgcatctgctatggtttctttctcatgctcgggtctgttggtttccgtgcagccctattctttgtccgtcacatatatcgatcgatcaaatgcgagtaaagttgttgtctgtggtcttctacatctcacagattgctttccagatttggtaaaggccacaatcagctcaaaagtttacaacaatgatgtttgaggagggtaggatgtacgtagagtcgtagaccttatccctgcagccttacctttgct

SEQ ID NO: 1292 - DNA, 2971 bp, Musa acuminata
cgaatcttctcgctccgatcgcgcgcggtggggcgatggatctggtccgggtggcggcgctgctgctgtgcttcggggtcgccggcgtcgtatcagaagcctccgaccaccgatacaagcagggggaccccgtccccctgtacgccaacaaggtcggccccttccacaaccctagcgagacgtatcggttctttgatcttcccttctgcattccagaccatgtaaccgagaaaaaggaagcacttggcgaagttctgaatggggaccgtctggttggggccccatacaagcttgacttccgagttgattatgactctgaactgctttgcaagaagaagcttactaaaggagacgttggtaagttcagggatgcagtcacgaaggactactacttccagatgtattatgacgacctccccatatggggattcatagggaaggttgacaaagaagggaaggatctgagcaacgacaactactatctttacaggcatatccactttgatatcctctacaacaatgaccgtgtgattgagattaccgtgcacacggatcccaattctgtagctgacctcactgaggacaaggatattgaagcggagttcttgtattcggtcaagtggaaggagacaaccatgccatttgaaaagaggatggagaaatactcacagtcctcttcattgccccatcacttggagattcattggttctcaataataaattcatgtgtcacggttcttctcttgactggatttcttgccacaattctcatgcgggtgctaaagaatgattttgtcaagtatgctgatgatgaggagtctgccgaggaccaagaagagacagggtggaagtatatccatggtgatgtcttcagatttccaaagaacaaatcactgttggctgcttctcttggttctggaacacagttatttgccctcacggttttcatttttgttcttgcacttgttggagtcttttacccatacaatcgaggggcgctttttaccgctctggtggtcatatatgcactcacctccggcattgctggatttactgctacatccttctattttcaactcgaaggaacaaattgggtaaggaatttgctcttgacgggatgccttttttgcgggcctctgttcctcacattctgctttcttaatacggtcgcagttgtgtatagtgctactgcagcactaccatttggaaccattgttgttattgttctcatttggacactagtcacttcccccttgcttgttttgggtggaattgctgggaagaataacaaaacagaattccaggccccttgtcgaacaacaaagtttcctagagagattccaccactgccctggtttcgaagaactattccacagatggcaatggctggtttcttgccattcagtgcgatctacattgagctttactacatatttgccagtgtctggggccacaggatatacatcatctatggcattctcttcgtagttttcatcattctcctcgttgtcgctgcttttgtcactgtggcactgacctattttcagcttgcggctgaagatcatgaatggtggtggaggtctttcctatgtggaggatcaactggtctatttgtgtatgggtattgtttgtactactacttcgcccgctcagatatgtcagggtttatgcagacatcttttttcttcgggtacatggcttgcatctgttatggcttcttcctaatgcttgggacggttggtttccatgctgctttgttttttgtgcgccacatatatcgatcaataaagtgtgagtagcttattggcaccagatcagtttgagataggcccagaaagaaaataccatgcaacactcatgtgcaatagggaaggagcagcagtaagtctaagattagggatattgttatgagaaaaggtcactctctaataagttttatatgtttggtctcaaagtccttgttaggttttcttttccaccttcaaatgctcatttttcctattttgttaaaaagatgtattaaaaagatacaatttgcagctttattcacatttggatcttttatatggctcactgtgtctgatgaaattagttcttgtgtaaatgtgattgatgtcgtgcaatagtgagtccaaacttttgtgccatgcaatttaattttaggtacaggatcaagtggaatctcatgcatgcatgcatgcatcgaaatagagagttcaaagaagatgcaggagacctcttttttcttgataggaagtagtcaggagacatggaagagagcagatgaattacccgacatattttggatggaagctttctcggctgactataaatctcttgggaaatctagtttttcattcttgatatgagatcggccctttttcattctctggatgccacttatcactcgtttcactattctgatgtgccagatgggataaaaagattgttgcatatttgctaactattctacacttggcgatgaccataatagaactgggatttagatctcaatgatatagtcattacgggagctccttgtggcaggtatcattgtttttttcatcgatagataaatctgtttcatattcaagatcttattttcctgttttctaaggatttattctcaatatgactgcagcagaaacgatcatgaaagagaagtaacgaacaagaggccatagtgggagaagctagaaccaatttcctttcagaagttatccttgagtacacagtgagagagagaagctaagctgttaggaggaggaaggaaaaggactaagaagtcatcatagtggtgggagaaccaagaatcaatttccttgcagaagctatcctcgagtacctaccttccttgagagagagatttgtttccatcagtaaagatttgtttgaagggaacatcatttatttctgtgcttgatgatactggattaggtcatctctaaggtaaaactatatttgttggaaa

SEQ ID NO: 1293 - DNA, 2112 bp, Ambrosia trifida
acaatcatctatctgtgggcgttgtaacttgtaacagacaccaccaaagatgaagacgacgatgtccacgatccagtggttactggtggcgataacggtgctacaagttagatcaggtgcctccgatcacaagtacaaacctaacgacgaagttcctatctacgctaacaaagtcggcccctttcataaccctagtgaaacataccgtttttttgatcttccattctgtttaccagctcatttaaaagagaaaccagaagcacttggtgaagtactgaatggagatcgtttagtaagtgctccttataagctggagtttatgcgtgaaaaggactcagaagttgtttgcagaaaaaaactatcaaaagatgaagtatctaaattcagaaaagctgttgccaaggattattatttccaaatgtactatgatgacttgcctttttggggatttctagggaaggttgagaaggacaaaaatgaccctagtgaggaaaaatattacctgtttaagcaccttcattttgagatccactacaataaagatcgggtaatagagataaatgcaaaagcagatcctgatgctgtggtggatctcactgatgacaaggaagttgaggtagaatttctgtacaccgtgaggtggaaagaaactaatatcccctatgagagtagaatggagaaatactcccagacttcttcacagccacatcacctggagatccattggttttcaattattaattcatgcgtcacggttcttcttttaactggttttcttgctaccattcttatgcgggtccttaagaatgactttgttaagtatgctcatgatgaagaggaagctgatgatcaagaggaaactggttggaagtacattcatggtgatgtgttcaggtacccgaagtgcaagtccttgttcgccgctgcacttggttctggcacccagctattttgccttgcactttctatttttgggctggctctagttggtgtattttatccatataaccgaggagctctgttcaccgcactggttgtcatatatgcacttacttctgggattgcaggctacactgcagcctccttttatcaccagctagaaggaactaactgggtgcggaacttactattgactggctgtctgttctgtgggcccctctttcttactttctgctttctaaacacagttgcaattgcttacactgctactgctgctctaccctttggtacaatagtggtgattgtattaatatggacattggtgacttcaccattgttagtattgggtggtattgctggaaaaaacagcaaggctgaatttcaggcacccgttcgccccacaaaataccccagagagatcccaccattaccttggtaccgtaaaaccatccctcaaatggccatggctggtttccttcctttcagtgcaatatacattgagctatattatatatttgctagtgtgtggggccacaagatttatacaatttacagtatcttatttatagtctttatcatcctcctcattgttactgcctttatcactgtggcattgacttatttccaacttgctgctgaagaccatgaatggtggtggaggtctttcttgtgtggtgggtcaactggtgttttcatctatgggtattgtttgtattattactatgaacgttctgacatgtcgggattcatgcaaacatcgtttttctttggatacatggcttgcatttgttatggtttctttctcatgcttggaatggtcggttttcgggcgtcattgttctttgttcgccacatctaccgctcaatcaagtgtgaatagaagtttaatgttcattctggtgtgcccgcataggatctggctggtgttcatgctgcggccgcccagggtgaaaccgttaaagctatgaaaactagttttattgttgctgaatgtttcgatatactagtttatgttgtttcttgttttttttttcgtttaataggaatcatatcatacctagtcaattttggacatacatttttacgatgtagcttgtaattaaatttaagtttgtgtaactccagttactcgtacctttacgcacctacttttttaggtaattggataacaaa

SEQ ID NO: 1294 - DNA, 2257 bp, Quercus alba
atcatcatcatcgttacctaaaattttgttctttctctctctccgtgtctgtctgactctttactctctctctctctctcagtctgtgttgtgttaaggttaaacactgaggagaaatggtggtggacaagaagaagaagattatggcgtgtttggtggcagccatagtgatcctctgcagcctaacccacgtcagatccgatgcttccaaccatcgttacaaagaaggtgacgatgttcctctatacgctaacaaggtgggacccttccacaatcccagtgagacataccgttattttgatcttcctttctgttcaccagcccatatgcaagaaaagaaagaagctcttggcgaagtactgaatggggatcgcttagttgttgccccttacaaacttgaattcctaaaagataaagaatctgagattgtttgcaaaaagaagttgaaacaggaagaagtttctcagttccgcgctgcagtttcaaaagactattacttccaaatgtactatgatgacttgcccttatggggtttgttaggtaaatttgacaaggaaggaaaagatgaccccagtgagctcaaatattacctctttaagcatcttcatttcgacatcctttacaataaggattttgttattgagattattgtaaaaagtgatccagatgcccttctggacctgacagaagacaaagaagttgacgtggaattcacgtactctgtcaaatggaaggacacagagattccatttgagaagaggatggagaagtactctcaaatttcttcgctgcctcatcacctggaaatccattggttttcaataataaattcatgtgtgactgttcttctcttaactggattccttgccacgattctcatgcgagtccttaagaatgattttgttaagtatacccatgatgaggaggcagccgatgaccaagaggagactggatggaagtacattcatggtgatgtattcaggtatccaaagtacaagtcattgtttgcagcagcgcttggttctggcacccagctatttactctagcgattttcattttcttgcttgcactagttggtgtgttttatccctataaccgtggagctctattcacggcacttgtcgtcatatatgcacttacatcagggattgcaggctatactgcagcatctttctattgccagctagaaggacaaaattgggtgcgaaatttgttattgactggaagcctcttctgtggaccactgtttctcaccttctgctttcttaataccgttgcaattgcttacagttccactgcagcattgccatttggaacaattgtggtgatttttcttatattgactcttgtaacttcacctttattggtattgggtggaattgctgggaagaatagcaaggctgagtttcaagctccatgccgcacagcaaaatttcctagggagataccatctttgccttggtatcgtaaaacctttcctcagatggctatggcagggtttttgcctttcagtgctatctacattgaactttactacatatttgctagtgtatggggccaccggatttacaccatctacagcattctgtttatagtattcatcattctcttgattgtcactgcttttatcaccgtgtcattgacatatttccaacttgctgctgaagaccatgagtggtggtggaggtctttcctttgtggcggatcaactggcctgttcatctatggctactgcttgtattactaccatgcacgatcagatatgtcaggtttcatgcaaacatcgttcttctttgggtacatggcttgcatttgctatggtttctttctcatgcttggggttgtcggtttccgtgcttctttattctttgttcgtcacatataccgttctatcaaatgcgagtagcaagtcactcggtctccttgaagttcaacaggtggtctgttttttcctttagtgggctcatttccggatactaaaccaagttcatcaaaaaaggctgttgataatgtttctgatattctggagaagattgaggcaatgcaacacagacttgtgttcaagtattcttatcattccttcaagggattgattacacagtatgtgatccattaatgtggtaagaatatattagcggagacaatcttgtcgaactgtaggatttcttagaaacttatactgcttatccaaagcagcaccttgtaaaactttcttcattgccttgttcctagctccaaaagttatattaatacatt

SEQ ID NO: 1295 - DNA, 1915 bp, Ambrosia trifida
atgaagacgacgatgtccacgatccagtggttactggtggcgctaacgctgctacaagttagatcaggtgcctccgatcacaagtacaaacctaacgacgaagttcctatctacgctaacaaagtcggcccctttcataaccctagtgaaacataccgtttttttgtatcttccattctgtttaccagctcatttaaaggagaagccagaagcacttggtgaagtacttaatggagatcgcttagtaagtgctccttataagctggagtttatgcgtgaaaaggactcagaagttgtttgcaggaaaaactaaaaaaagatgaagtatctaaattcagaaaagctgttgccaaggattattatttccaaatgtactatgatgacttgcctttttggggctttttagggaaggttgagaaggacaaaaatgaccctagtgaggaaaaatattacctgtttaaacatcttcattttgagatccactacaataaagatcgagtgatagagataaatgcaaaagctgatccggaggctgtggtggatctcactgatgacaaggaagttgaggtagaatttctgtacactgtgaggtggaaagaaactaatatcccctatgagagtagaatggagaaatactcccagacttcttcacagccacatcacctggagatccattggttttcaattattaattcatgtgtcacggttctccttttaactggttttcttgctaccattcttatgcgggtccttaagaatgactttgttaagtatgctcatgatgaagaggaagctgatgatcaagaggaaactggttggaagtacattcatggtgatgttttcaggtacccgaagtacaagtccctgtttgctgcttcacttggttctggcacccaactattttgccttgcactttctatttttggactggctctagttggtgtattttatccatataaccgaggagctctgttcaccgcactggttgtcatatatgcacttacttctgggattgcaggctacactgcagcctccttttatcaccagctagaaggaactaactgggtgcggaacttactattgactggctgtctgttctgtgggcccctctttcttactttctgctttctaaacacagttgcaattgcttacactgctactgctgctctaccctttggtacaatagtggtgattgtattaatatggacattggtgacttcaccattgttagtattgggtggtattgctgggaaaaacagcaaggctgaatttcaggcacccgttcgcaccacaaaatacccccgagagatcccaccattaccttggtaccgtaaaaccatccctcagatggccatggctggtttccttcctttcagtgcaatctacattgagctatattatatatttgctagtgtgtggggccacaagatttatacgatttacagtatcttatttatagtctttatcatcctcctcattgttactgcctttatcactgtggcattgacttatttccaacttgctgctgaagaccatgaatggtggtggaggtctttcttgtgtggtgggtcaactggtgttttcatctatgggtattgtttgtattattactatgaacgttctgacatgtcgggattcatgcaaacatcgtttttctttggatacatggcttgcatttgttatggtttctttctcatgcttggaatggtcggttttcgggcgtcattgttctttgttcgccacatctaccgctcaatcaagtgtgaatagaagtttaatgttcattctggtgtgcccgcataggagctggctggtgttcatgctgcggccgcccagggtgaaaccgttaaaactatgaaaactagttttattgttgctgaatgtttcgatatactagtttatgttgtttcttttt

SEQ ID NO: 1296 - DNA, 1744 bp, Brassica juncea
cactgattgagagaaaaacgcaatgacgatgctgctcctttagtcggagctctaatcttctccggtgtcggctatgtcagatccgacgcctccgatcaccgttacaaggaaggagacaccgttcctctatacgccaacaaggtcggcccattccacaatccaagtgagacgtatcgctactttgatcttcccttctgtgttccagagggtgtgaaagagaagaaggaagctcttggagaggttctgaatggtgatcgtctcgtcagcgctccatacaagctcaacttcagagaagaaaaagactccgaagtctactgcaagaagaagctaagcaaagaagaggtcagaaagttcagacaagccgttgagaaagactactacttccagatgtactacgacgatctccccatctgggggttcattggcaaagtcgacaaggagatcaaatccgatccgagcgagtacaagtacttcctctacaagcacatcgagttcgagattctgtacaacaacgaccgtgtgattgagatcagtgctaggatggatcctcactcgcttgttgatcttaccgaggataaggaagttgatgcggagtttatgtatacggtgaagtggaaggagactgagactccgtttgagaagaggatggacaagtactctatgtcttcttctcttccgcatcacctggagattcactggttctctattattaactcgtgtgtcactgtcctgcttttgactgggttccttgcaactatcttgatgcgagtcctcaagaacgatttcaccaagtatgctcaagacgaggaagctgctgatgatctagaagaaactggatggaagtacattcatggtgatgtgtttaggttcccaactcgcaactctttgtttgctgcatcacttggtagtggcacacaattgttcaccctgaccatattcattttcatgcttgctcttgttggagtgttctacccttacaaccgaggagcactcttcaccgctttggttgtcatttacgctctaacctctggaattgctggatacacatccgcctctttctactgccaacttgaaggcaaaagctgggtgagaaacttgttactcactggatgtctcttctgcggtcctttactcctaaccttctgcttcctcaacaccgtagccatcacctacacagcaaccgcagcactaccctttggaaccattgtcgtgatcgtccttatatggacactagtcacatcgcctctactcgtcttaggtggcatcgccggtaaaaacagcaaagctgagttccaagcgccctgccgcacgaccaagtacccccgcgaaatcccgccgctcccttggtacagaagcgcgattcctcagatggccatggctggtttccttcctttcagtgccatctacatcgagctttactacattttcgctagtgtctggggtcaccggatctacaccatctacagcatcctgttcattgtcttcatcatcctcatcatcgtcactgctttcataactgtcgccttgacttacttccagctcgctgctgaagatcaccaatggtggtggagatcattcctatgcggtgggtcgaccggtttgtttatctacgcctactgcttatactactactacgcacgatcagacatgtctggattcatgcaaacatcgttcttcttcgggtacatggcttgcatttgctacgggttcttcttaatgctcgggactgtcggcttccgcgctg

SEQ ID NO: 1297 - DNA, 2093 bp, Centaurea maculosa
  misc_feature (136)..(136): n is a, c, g, or t
  misc_feature (180)..(180): n is a, c, g, or t
  misc_feature (204)..(204): n is a, c, g, or t
  misc_feature (1711)..(1711): n is a, c, g, or t
  misc_feature (1795)..(1795): n is a, c, g, or t
  misc_feature (1822)..(1822): n is a, c, g, or t
tgggatactttgttgattttatacgcaaatcgcaagagagaagaaaactccttttggggatccagttttttcattacacaaagagacagagaagagagagtgtgagatctagatctctattatatatccatatatnatatatatctatatatctatcagttagtagtatatgtgaagaangaagaagaagaagaagaagaagangaagaagaagaagatgatggagattgtagcattgtttgtgatatccagtctgctactactgggatcagtcacatctgatgcttcaaatcacaaatacaaaagtggagatgtcgttcctctctatgccaacaaggttggccccttccaaaatccaagtgaaacgtaccgctattttgatctaccattctgtttgccaggtgatttgaaagagaaaaaggaagcacttggagaagtattaaatggagaccgtttagttagtgctccatacaaactagatttcttggttgacaaagattctgagtttatttgcacaaagaaactgacaaagcaagaagtggctaagttccggaaatccattgcgaaggattactactttcaaatgtactttgatgacttgccactctggggtttcatcggcaaatatgagaaaaccgagtccaatgagcaaaaatactacctctttaagcatctgcagtttgaggtactctacaacaagaatcgtgttattgaggtgaatgtccggactgatccaagtgcccttgtggatgttacggaagacaaggaagttaacgtcgacttcatgtacacagtcagatggaaggagactagcattccttttgaaaagaggatggagaagtactcgcacaattcttctctaccacatcatttggaaatacattggttctcaattattaattcttgtgtgacggtgctccttttaactggtttccttgccacaattctcatgcgggtgctcaagaatgattttgtaaagtatgctcatgatgaggaaacggctgaggatcaagaagaaactggatggaaatacatacatggcgatgtcttcagatacccaaagttcaaatctttatttgctgcttcccttggttctggttcccagctatttgcccttacaatctttatcttcatacttgcactggttggtgtcttttatccatataatcgaggagctctattcaccgcattggttgtcatatatgctctcacatctggaattgctggatatactgcatcttctttctattgccagcttgaaggaacaaactgggtaaggaatttgctgttgactggaagcctcttctgcggacccctgttccttacgttctgctttctgaatacggttgcaattgcttacagtgcgacagcagcattgccgtttggaacgattgtggtaatagctcttatatgggcgttagtgacatcaccattgctggttttaggtgggattgcaggcaagaatagcaaggcggagttccaagctccatgtcgcacgaccaaatatccaagagagattccaccattgccatggtaccggggaactcttgctcagatggggatggctggctttcttccattcagtgctatctacatcgaactctactatatatttgcaagtgtctggggtcacagaatttacaccatctacagcatcttgtttatcgtcttcatcattcttgtgattgtcactgcctttattaccatagcnttgacatacttccaactggctgctgaagatcacgaatggtggtggaggtctttcctttgtggtggatcaacggggctgttcatntatgggtattgcttgtattactactanggccgttcagatatgacaggattcatgcagacctcattcttctttgggtacatggcatgcatctgctacggcttctttctcatgcttggcaccatcggcttccgtgctgcactcttctttgttcgacatatatatcgttcaatcaagtgcgagtgagtgagcgagtaacagacacatcatatatatctgtagaatttgtaagacagacgtattacatatgttcgatctaggagaccatttcatttttactatatatatatggagttcaatt

SEQ ID NO: 1298 - DNA, 1898 bp, Arnica chamissonis
agcagacgccgaagatgttgacgaaattgaccgtgaaccggtggttgctggtggcgttactggtagttttccacatcaaagaagttcgatcaggtgcctccgatcacaagtacaaacctaacgacgaagtccctatctacgccaataaagtcggcccctttcataaccctagtgaaacataccgattttttgatctaccgttctgtttaccagctcatttaaaggagaaaccggaagctcttggtgaagtactgaatggagaccgtttagtcagtgctccgtataagttacagtttatggttgataaggactcagaaattgtttgcagaaaaagattgacaaaagaggaagtatctaaattccgaagtgcggttgccaaggattattattttcaaatgtactatgatgacttgcctttctgggatttttagggaaggtcgaaaaggataaaacaaaccctgttgaagaaaagtattacctctttaagcatcttcactttgagatccattacaataaagatcgtgtcatagagataaacgcaaaagctgatcctaatgtggtggtcgatctcgctgaagacaaggaagttgaggtggagtttatgtacacggtgagatggaaagaaacaaatgttccgtatgagtctaggatggagaaatactcccaatctctttcacagacacatcaccttgagatccattggttttcaattattaactcatgtgtgacggttctcctcttaactggtttccttgccaccattcttatgcgggttcttaagaatgattttgtcaagtatgctcatgatgaagaagcagcagatgaccaagaggaaactgggtggaagtacattcatggtgatgtatttaggtacccaaagtataagtccctgtttgcggcttcccttggttctggtacccaactgttttccctggcactttttatttttgggctggctcttgttggtgtattttatccatacaatagaggagctttgtttaccgcactggttgtcatatatgcacttacatctgggattgcaggctacactgcagcctctttttatcatcagctagagggaactaactgggtaaggaacttacttttgactggctgcctgttttgtggacccctttttcttactttctgctttctaaacactgttgcaatcgcttatactgctactgctgccctgccctttggtacgattgttgtgattgtcttaatatggacattggtgacatcaccattgttagtattggggggtattgcgggaaagaacagcaaggctgagtttcaggcacccgttcgcaccacaaagtatcccagagagatcccacctttgccatggtatcgcaaaaccgtccctcagatggccatggctggttttcttcctttcagtgcaatctacatcgagctttactacatatttgctagtgtttggggtcacaggatttacaccatttacagtattttatttatagtttttatcatcctcctcattgttaccgcctttatcactgtggcattgacttattttcaacttgctgctgaagaccatgaatggtggtggaggtctttcctctgtggtgggtcaacaggtgttttcatctacgggtattgtttgtattactattatgaacgttctgacatgtcaggattcatgcaaacatcgtttttcttcggttacatggcttgcatatgttatggtttctttctcatgcttggaacggttggtttccgtgcttctttgttctttgttcgccacatctaccgctcaatcaagtgtgaatagaagtttgatgtccaatcttgaatgctcaggaaggagttgctgcagggtgaagccatgatgaaatatatgagaactagcttacatgttgatccattctttttaa

SEQ ID NO: 1299 - DNA, 2618 bp, Oryza sativa
ccaaaatgtgggctactactagcctttagcttagctgaccccattatactagtactacaatattagggccacagtacgcctccaccttcctcccccccacccaaccctgaaaacgccaccctctccagatctcccctccgcctcgtctcgtctcgtctcggtctctctctctattaaggagcaagcaaagcggccactccggctcagatctccgcgcgtgcatcccaccacccccaaaccctcgcgcgcgcgctctctctcctcgtcaacgcgcgcgcccccgcccccgccccgacgagagcgatggcctcgccggcagcggcggcccccgcggcgctgctcgtccttctcgccgcggccctcgcggcgaccggcgtcgtcgccgacggctccgaccaccgctacaaggccaacgagctcgtcccgctctacgccaacaaggtcggccccttccacaaccccagtgagacgtatcggtactttgacctgcctttctgctctccagagaaagtgaaggagaagagcgaggcactcggtgaggtcctcaatggggaccggttggttgatgcaccttacaagcttgatttccgtgtggattatgactccaagccggtttgctcgaagaagctcaccaaggaggaggtggccaagtttcggaatgcggtagcaaaggactactacttccagatgtactacgatgacctcccactgtggggattcattggtaaggtggagaagggaggcaagacagatccgaaagagtggaagtattacctgtacaggcacatcatctttgacatcctctacaacaatgaccgggttattgagatcaatgtgcacactgaccagagtgcactagttgacctgactgaggacaaggaagctgatgttcaattcctttactcagtcaagtggaaggagacacccacaccatttgagaagaggatggagaagtattccagttcctccaacctcccacaccatttggaggtccattggttctctatcataaactcttgtgttacagtcctccttttgactggattcttggcgaccatcctcatgcgagtactgaagaacgattttgtcaagtatgcccatgatgaggaagcagctgatgaccaagaagagtctggatggaagtatatccatggggatgtcttccggttccccaagaacaagtcctttttttcggctgctctcggcaccggaactcaactgtttgccctcacaacctttatattccttcttgcacttgttggagtattctacccgtacaatcgtggtgctctttttactgcattggttgtcatctatgctctcacttcaggaattgctgggtatattgcaacctctttctactgtcagctagagggaacaaactgggtgaggaacttgctgttgacaggatgcctgttctgtggacccctattcctgactttctgcttcctaaacactgttgctattgcttatagtgcaacagcagctttgcccttcggcactatctgtgtcattgtgctcatctggaccttagttacatttccccttctagttttgggaggcattgctggtaaaaacagcaagactgaattccaagctccctgccgtaccaccaaatatcctagggagattcctccacttccgtggtaccggcaaacaatcccgcagatggctatggctgggtttttacctttcagtgccatctatattgagctctactacatctttgctagtgtttggggccacaggatttacacaatttacagcattctcttcatagtcttcatcatcctccttattgttactgccttcattactgttgcactgacgtactttcagcttgctgctgaagaccatgaatggtggtggaggtcattcctatgtggaggatcaactggattttttgtctatgggtattgtctgtactactattatgcacgatcagatatgtctggatttatgcagacatcattcttcttcggctacatggcttgcatctgctatgctttcttcctgatgctgggcatgatcggtttccgtgccgcattgttctttgtccgtcacatatacaaatccatcaagtgtgagtaatactgttgtcaaaggctggagagcagcggagttgtactcctttttggtgccactaagaagtcccagtatagaaaaggttagctctcgcacaacaggagcagctagagattgccatgtttcaggttaggccattattcataggaacaggtaatgaacctataaatttgttctccttttgtgcgactgctgtgataaatcgtcttttctttggtcatgtaattctccctgtgatgtctagacattttcacgttgttgatgcatgacctacctgagcatctctggaagatcatgtcatgtcttatttcctatagcagaataactgaagtgtagagatgatgcctctagagcggcttgtctatttatacgtgtacccaccgctggttatgtattgtcaaatattgaaatactgaaccattctttttttttcacttttgagaatcatgatcattttgattgatagtgcgaagcagcttccaatgtgcaactaggcttgacacgttatatttgttgatgtgattcgttcttca

SEQ ID NO: 1300 - DNA, 2589 bp, Oryza sativa
agctgaccccattatactagtactacaatattagggccacagtacgcctccaccttcctcccccccacccaaccctgaaaacgccaccctctccagatctcccctccgcctcgtctcgtctcgtctcggtctctctctctattaaggagcaagcaaagcggccactccggctcagatctccgcgcgtgcatcccaccacccccaaaccctcgcgcgcgcgctctctctcctcgtcaacgcgcgcgcccccgcccccgccccgacgagagcgatggcctcgccggcagcggcggcccccgcggcgctgctcgtccttctcgccgcggccctcgcggcgaccggcgtcgtcgccgacggctccgaccaccgctacaaggccaacgagctcgtcccgctctacgccaacaaggtcggccccttccacaaccccagtgagacgtatcggtactttgacctgcctttctgctctccagagaaagtgaaggagaagagcgaggcactcggtgaggtcctcaatggggaccggttggttgatgcaccttacaagcttgatttccgtgtggattatgactccaagccggtttgctcgaagaagctcaccaaggaggaggtggccaagtttcggaatgcggtagcaaaggactactacttccagatgtactacgatgacctcccactgtggggattcattggtaaggtggagaagggaggcaagacagatccgaaagagtggaagtattacctgtacaggcacatcatctttgacatcctctacaacaatgaccgggttattgagatcaatgtgcacactgaccagagtgcactagttgacctgactgaggacaaggaagctgatgttcaattcctttactcagtcaagtggaaggagacacccacaccatttgagaagaggatggagaagtattccagttcctccaacctcccacaccatttggaggtccattggttctctatcataaactcttgtgttacagtcctccttttgactggattcttggcgaccatcctcatgcgagtactgaagaacgattttgtcaagtatgcccatgatgaggaagcagctgatgaccaagaagagtctggatggaagtatatccatggggatgtcttccggttccccaagaacaagtcctttttttcggctgctctcggcaccggaactcaactgtttgccctcacaacctttatattccttcttgcacttgttggagtattctacccgtacaatcgtggtgctctttttactgcattggttgtcatctatgctctcacttcaggaattgctgggtatattgcaacctctttctactgtcagctagagggaacaaactgggtgaggaacttgctgttgacaggatgcctgttctgtggacccctattcctgactttctgcttcctaaacactgttgctattgcttatagtgcaacagcagctttgcccttcggcactatctgtgtcattgtgctcatctggaccttagttacatttccccttctagttttgggaggcattgctggtaaaaacagcaagactgaattccaagctccctgccgtaccaccaaatatcctagggagattcctccacttccgtggtaccggcaaacaatcccgcagatggctatggctgggtttttacctttcagtgccatctatattgagctctactacatctttgctagtgtttggggccacaggatttacacaatttacagcattctcttcatagtcttcatcatcctccttattgttactgccttcattactgttgcactgacgtactttcagcttgctgctgaagaccatgaatggtggtggaggtcattcctatgtggaggatcaactggattttttgtctatgggtattgtctgtactactattatgcacgatcagatatgtctggatttatgcagacatcattcttcttcggctacatggcttgcatctgctatgctttcttcctgatgctgggcatgatcggtttccgtgccgcattgttctttgtccgtcacatatacaaatccatcaagtgtgagtaatactgttgtcaaaggctggagagcagcggagttgtactcctttttggtgccactaagaagtcccagtatagaaaaggttagctctcgcacaacaggagcagctagagattgccatgtttcaggttaggccattattcataggaacaggtaatgaacctataaatttgttctccttttgtgcgactgctgtgataaatcgtcttttctttggtcatgtaattctccctgtgatgtctagacattttcacgttgttgatgcatgacctacctgagcatctctggaagatcatgtcatgtcttatttcctatagcagaataactgaagtgtagagatgatgcctctagagcggcttgtctatttatacgtgtacccaccgctggttatgtattgtcaaatattgaaatactgaaccattctttttttttcacttttgagaatcatgatcattttgattgatagtgcgaagcagcttccaatgtgcaactaggcttgacacgttatatttgttgatgtgattcgttcttcataa

SEQ ID NO: 1301 - DNA, 2491 bp, Brachypodium distachyon
atcgccaccttccaccacccaacccgaaaacgccatccgggaagggggaggaggagccgggccaaacccaacacaaccccccagatctccttccttcccttcttctcccctctctattaagaagcgccactcagatctccccgcccgacccccccccccccccccccccccccccccccgcctctgcctccctcgtcaacgcagcacgaggacgagcgcgatggcatcgccggccgcgggcgcggcctcggcggtcctcctcttgctcgccttcgccgtggcgggggtgctctccgacggctcggaccaccgctacaagtccagcgagcccgtcccgctctacgccaacaaggtcggccccttccacaaccccagtgagacgtatcggtacttcgacctccctttctgctctcccgaaaaagtgaaggagaagagtgaagcccttggggaagtcctcaatggggatcgtttggttgatgcaccgtacaagcttgatttccgtgtggatcttgactccaagccggtttgctcaaagaagctcaccaaggaggatgttgcaaagttccggaactcagtagctaaggactactacttccagatgtattatgatgatcttccactgtggggtttcattggtaagctggaaaagacagccaaggccgacccgagtgagtggaagtattacctatacaggcacattatctttgacatcctctacaacaatgaccgggtgattgagatcactgtgcatactgaccagagtgcactggtcgacctgacggaggataaggaggctaatgtggagttcctttacactgtcaagtggaaggagacagcaacaccatttgagaagaggatggagaagtactccagttcctccaacctcccgcatcacctggaggttcattggttctcgattatcaactcttgtgttacggttcttctcctgacagggttcttggcgacaatcctcatgcgagtactgaagaatgattttgttaagtatgcccatgatgaagaagcagctgatgaccaagaagagtctggatggaagtatatccacggtgatgtcttccggttccccaagaacaagtcattgttttcggctgctcttggcactggaactcagctgtttgctctaacaacctttatattcttgcttgcacttgttggagtattctacccttacaaccgtggcgcacttttcaccgcattagtcgttatctatgcactcacttcaggaattgctgggtacattgctacctctttctattgccagctagagggaacaaactgggtgaggaacttgctattaacaggatgcctgttctgcggacctctattcctgacattctgtttcttgaacacggttgctattgcttatagtgcaacggcagcattgccattcggcactatctgtgtcattgtcctcatctggaccttagttacatttcctcttctagttttgggaggcattgctgggaaaaacagcaaaagtgaattccaagccccttgccgtaccaccaaatacccgagggagatacctccacttccctggtaccggacaacagttccacagatggctatggctggatttttgcctttcagtgctatatatatcgagctgtactacatctttgctagtgtgtggggccaccgaatttacaccatttacagcattctcttcatagtcttcatcatcctccttatcgtcactgccttcattactgttgcactgacatactttcaacttgctgctgaagaccatgagtggtggtggaggtcattcctatgcggaggatcaactggattttttgtttatggctattgtctgtactactactatgcgcgatcagatatgtctggcttcatgcagacatctttcttctttgggtacatggcctgcatctgctatgcattcttcctgatgctgggcatggttggtttccgtgctgccttgttcttcgttcggcacatatacaagtccatcaagtgtgagtaaactgttgttagaggatgaagagcagcagagtttgtactcctttttggtgccgctaagtcccagtatagaaaaggttagctcttgcgtgcaacaggaagcaactagagattgccatgtttcagattaggccattattcataggaacaggtaatgaacctataaatttgctctctttgtgcgactgctgtgataaattgtcttttccttcagcccgtgtatgatctctgtgacatcaagacggtattactttggaccataacctacatgaatatctgtgaaagttcttattatgttatgtcatatttcctatggcagaataacacgagtgtagagatgatgcctcaagaagggcatgtccagtcagagttgtaccgttatacgtgtatcctttgcttcctgtgtatgtattgtgagatgttccgatgttaaaatatagtataccccgttttcatgaccaatttctatgatttacttgcgctcaagcatgcc

SEQ ID NO: 1302 - DNA, 3056 bp, Phalaenopsis aphrodite
gatgacaatcgctgccatggcgacggtgttgatgtttttctgtgtcgggataatcggagtggtatcggacgcttccagtcatcgttataagcccgacgagacggtacctctctacgccaacaaggtcggaccattccataaccctagtgagacgtatcgctattttgatctccccttctgttccccagcacctgtgaaagataaatcagaagcccttggtgaagtcctgaatggcgatcgattggttgacgctccatacaaactagactttcgggttgattatgattcaaaatcagcctgcaaaaagcaacttacgaaagaagaagtggccaagtttaggactgcagtagataaggattattactttcaaatgtactttgatgaccttccaatttggggattcattgggaaggttgataaggaaggcaagtctgacccaagtgaatacaagtactttctgtaccggcacattctctttgaagttctccacaataatgaccgagttattgagatcaatgttcgcacggataccaattcaatggttgatattactgatgataaagacatagaggttgatttcatgtactctgtcaagtggcaagaaacagatacaccttttgagaagagaatggagaagtactctcagtcctcttctcaacaacatcacttggagattcactggttctcaattataaactcgtgcgttactgttcttcttctaactggattccttgcaaccatcctaatgagggtcctgaagaatgactttgttaagtatgctcatgatgaggagacaggtgacgaccaagaagaaacagggtggaagtatgttcatggtgatgtctttaggttccctaaaaacaagtcttttctagcttcctgtcttggttctggaacccagttatttgctcttacaaccttcgtatttctcctagccctggtgggagtcttctacccttacaatcgtggtgcactttttactgcattggtggtgatatatgcgctcacttcaggcattgctggttatactgccacttctttctattgtcagctggaaggaacaaactgggttaggaatcttcttttgaccggagttctattttgcgggcctctattcgtgacattcggttttctcaacactgtagccatcgcatataatgctactgccgcactgccgtttggcacaatcgttgttatcactctcatatgggcattggtaacatctcctcttcttgttttgggtggcattgctggcaagaacagcaaagcagagtttcaagctccttgccgcaccaccaaatatccccgtgaaattccgcagttgccgtggtatcgaggggctataccgcagatggcgatggctggttttcttcctttcagcgccatctacattgagctttactacatctttgccagtgtttggggccacagaatttataccatatatagcattctctttgtggttttcataatcctcctcattgtgacggcatttattactgtggcaatgacctactttcagcttgctgctgaagaccatgaatggtggtggagggcattcctgtgtggaggatccactggtctgtttatatacgcgtattgcttttactactaccacgcgcggtccgacatgtctggattcatgcagacatccttcttctttggctatatggcctgcatctgctacggtttcttcctcatgctcggcactgtaggtttccgagcctcgctcttgttcgtccgtcacatataccgctccatcaagtgtgagtagcagctcttcaaacgaaacacggcttaattttcttcatcatcctacaaacttccatgggttattttcttgatgagctttatgagcaccccccctatttcttcttcatcatgttttactgctgatatgcattattctttctgtgggagggtggtttgcaaaataggcagccgtggcacactatctggaggcttctactgcctccccctcttaaaaaactcctaggtgttttgtttgtaatgaaactgctcaacttgatttgttagttcatacgaattttccttgtaaaacgatcgctgtagcactgtgtacctcttttttaacttataaattcaaatgtgactttaaaagtctagccatattcgtgctcagcttgaacttataccaactaaaaaagcaaacttcaattgaataattttcaactcaactggtttattcaccatctacaaataatcagtgatatattgctgataatatagtttgaattaaaagcataatagccataagattcaattatgataaactatcaaatcctgtaagtttaggggacccttcgcagtacacattgcacagccttcttaatgccttctggatcgagtgtggttgtcaaatatacttcctgaacctgtcttccagctcgtgcaagaagcgtgaactgtttgtcttttgctggcacactagagagccacaactccaagtcttgtgagaccaccctcttctccaagccttgacgtccaagacgtacaccagttataccatcctcttgcagtagttctttgcatatgctttccagtcctgggagggattcaacgttgatgttatcgggaatcacaagagactcagattctgactgaccttcttgcggaattactttgtccaatgtctccaaaagaggatcttcttctaactgcttgattgaaagagttaaccttgacttctccctattaacatttataactttgaccttcacctgctgaccttcactaagaatatctctaacatcatgaaccaaatcccaagaaacctctgaaacatgcactagtccggtgagatgatagtgtccatcagggaaaagcaaatgcacaaatgcaccataatcttccaccgagccaaccttagcatcaaaagtatctccgaccttaacctgactagaatacttagaccagttagcatccttctcagagaaaatcagccttttttcttcttcgttcacttcaataacctttagagatatggatgaccccacaagctgcttcgctgtgtcttgaatggattttgtcggatc

SEQ ID NO: 1303 - DNA, 1865 bp, Silene vulgaris
ataccgctattttgaccttccgttttgtactccagctcatgtccaagagaagaaagaagctcttggtgaagtattgaatggagatcgtctagtcagtgctccctacaagcttgatttcctggtggataaggattctgaagtcatttgcaagaagaagttgacaaaggatgacgtaactaagttccgggatgcagtatcgaaagattactactttcaaatgtattatgatgacttgccgatttggggctttttgggtaaagttgacaaggaaggaaagctagaccctagtgaatataagtattatctatataagcacattcattttgacatcctctacaacaaggaccgggtgattgaaatcaatgttaggactgatcccaactctctggtggacattactgaggatagagacttggatgcagatgtagagtttatgtatacagtgaagtggaaagaaacagacactccttttgaaaatcgaatggataaatattcccagtcttcctctcttcctcatcatctcgaaattcattggttctccattataaactcctgtgttacagtgctcttgctgacaggatttcttgcgacgattctcatgcgtgtgctcaagaatgattttgtcaagtatgcacatgatgaggaaacagctgaagatcaggaagaaactggatggaaatatattcacggggatgtctttagatttcccaagtacaaatctgtcctggcagctgctctaggatcgggtacccagctgtttactctcacgatttttatatttctcctggcactagttggggtgttttatccatacaatcgaggagctctattcacagctttggtcgtcatttatgctctcacttctggaattgcgggctacactgcaacgtccttttattgccagcttgagggagctaattgggttagaaatttgctgttgacgggtttcctattttgcggacctttgtttctcaccttttgcttcctgaacaccgtggcgatagtttacactgccactgccgcccttccttttggtaccattgtggtgataatccttatctggacacttgtaacttcaccactgttggtattgggtggaattgctgggaagaatagcaaagcagagttccaagcacctgttcgcactaccaagtaccctagagaaattccactgctaccatggtaccgaggaacccttccccaaatggccatggcaggatttttgcctttcagtgcaatttatatagagctgtactacatatttgctagtgtgtggggccacagaatttacacaatctacagtatcttgttcatcgtcttcattattttgattatagtcacagccttcatcactgttgctttgacatactttcaacttgctgctgaggatcatgaatggtggtggaggtcattcctatgcggtggctccacagggctctttatttacggctattgcttgtactactactatgcacgctccgacatgacaggcttcatgcaaacatcgtttttctttggctacatggcgtgcatctgctacggcttcttcctcatgctcggaatggttggattccgagcagctctcctatttgtccgccatatatataggtctatcaaatgcgagtagatggatgttacaactttgacgtccgcacctacaatatctttttgtttactagatttagtagaaaggcgatgtttgtattttcacaaatgcctgatctcattcagcaaaagagtttataacctctatgtaaacttccccttgttatttttcttagtttgcaatacatcgacttctttcctcgcaaaactagctaaagtgtattgtttagttgaaagattaagaagcaatattttcactt

SEQ ID NO: 1304 - DNA, 2224 bp, Helianthus annuus
aaagcattggtatataatatccaatgattaggaaacaaaatgatatcttttttaccttgtttgtttgttgaattgaattgaatttaatattggtgaggaaggttttcagatctggtggaatgaacaggaaatcaaagtgttaatgttaggcatgaagtctactactagtatctagttcacattgcacgtcaacaccatttttaagaaaccctaaacctttgtttatcgaaccactgtatgtgagatctggatctggatctagatacatccatcttcatctctccgatctccgtccataataacacaccgaaatctgtgttgttcgtatgatggagaacattcatcaatggctggtggtagcattgttcgtcatttgcagcgtaatgacgactgtcaaatcagatgtttcaaatcacaaatacaaaagcggtgatgctgttcctctttatgccaacaaggttggccccttccaaaaccctagtgaaacataccgctattttgatctaccattctgcctgccagatgatttgaaagagaaaaaggaagcgcttggagaagtgttgaacggagaccgtttggttagtgctccatacaagcttgatttcttggttgataaagattcagagtcgatttgctccaagaaactttcaaagcaagatgttggaaagttccggaaagccatttcaaaggactactactttcaaatgtactttgatgacctgcctctatggggtttcatagggaaatacgatacaaaagaacaaaaatactacctttttaagcatctgcagtttgaggtactttacaacaagaatcatgttattgaggttaatgtccaaacggatcctactgctcttgtcgatatcactcaagacaaggaagtcgacgttgactttatgtacacagttagatggaaggaaaccaacattccgtttaaaaagaggatggacaagtactcacaaaattcttcacttccacatcacttggaaatacattggttctcaattattaattcttgcgtcaccgtgcttcttttaactggtttccttgccacgattctcatgcgtgttctcaaaaatgatttcgtcaaatatgctcatgatgaggagacagctgaggatcaagaagaaactggatggaaatacatacatggtgatgtcttcagatatccacaacataaatctttatttgctgctgcccttggttctgggacccagttatttgcccttacaatctttatcttcatacttgcattagttggtgtcttttatccatataaccgaggagctttgttcactgcattggttgtaatatacgcactaacatccggaattgctggctatactgcatcctctttctattgccaactcgaaggaaccaattgggtgaggaatttgatattgactggaggcctgttttgcggaccccttttcataacgttttgctttttgaacacggttgcaattagttacagtgcgactgcagcattgccgtttggaacaatagtgataataggtctgatatggggattggtgacatcgccattgcttgttttaggtgggattgcaggaaagaatagcaaagccgagttccaagccccatgtcggaccaccaaatatccacgagagattccaccgttgccttggtaccgtgggaccctccctcagatggcaatggcgggttttcttccgttcagtgctatctacattgagctttactacatatttgccagtgtttggggtcacagaatctataccatatacagcatcttgttcattgtcttcatcattctggtcattgtcactgcctttattaccatagctttgacatacttccaactagctgctgaagatcatgaatggtggtggagatctttcctatgtggtggttcaactgggctgtttatctacggatattgcttgtattactactatgggcgttccgatatgacgggtttcatgcagacctcattcttctttggttacatggcatgcatttgctatgctttctttctcatgctcggtactattggtttccgtgctgcgctcttctttgttcgacatatataccgttctatcaagtgtgagtaaacacaacatgcccttacagtttgtactaggagagggaacttcattttttccttattacaaaaaagttatatctatcatatattattattagacaattattttgcaacaatttgcccttcctatgttgtgattga

SEQ ID NO: 1305 - DNA, 2044 bp, Helianthus annuus
gaaatcaaagtgtgttaatgttaggcatgaagtctactactagtatctagttcacattgcacgtcaacaccatttttaagaaaccctaaacctttgtttatcgaaccactgtatgtgagatctggatctggatctagatacatccatcttcatctctccgatctccgtccataataacacaccgaaatctgtgttgttcgtatgatggagaacattcatcaatggctggtggtagcattgttcgtcatttgcagcgtaatcacgactgtcaaatcagatgtttcaaatcacaaatacaaaagcggtgatgctgttcctctttatgccaacaaggttggccccttccaaaaccctagtgaaacataccgctattttgatctaccattctgcctgccagatgatttgaaagagaaaaaggaagcgcttggagaagtgttgaacggagaccgtttggttagtgctccatacaagcttgatttcttggttgataaagattcagagtcgatttgctccaagaaactttcaaagcaagatgttggaaagttccggaaagccatttcaaaggactactactttcaaatgtactttgatgacctgcctctatggggtttcatagggaaatacgatacaaaagaacaaaaatactacctttttaagcatctgcagtttgaggtactttacaacaagaatcatgttattgaggttaatgtccaaacggatcctactgctcttgtcgatatcactcaagacaaggaagtcgacgttgactttatgtacacagttagatggaaggaaaccaacattccgtttaaaaagaggatggacaagtactcacaaaattcttcacttccacatcacttggaaatacattggttctcaattattaattcttgcgtcaccgtgcttcttttaactggtttccttgccacgattctcatgcgtgttctcaaaaatgatttcgtcaagtatgctcatgatgaggaaacagctgaggatcaagaagaaactggatggaaatacatacatggtgatgtcttcagatatccacaacataaatctttatttgctgctgcccttggttctgggacccagttatttgcccttacaatctttatcttcatacttgcattagttggtgtcttttatccgtataaccgaggagctttgttcactgcattggttgtaatatacgcactaacatccggaatagctggctataccgcatcctccttctattgccaactcgaaggaaccaattgggtgaggaatttgatattgactggaggcctgttttgcggaccccttttcataacgttttgctttttgaacacggttgcaattagttacagtgcgactgcagcattgccgtttggaacaatagtgataataggtctgatatggggattggtgacatcgccattgcttgttttaggtgggattgcaggaaagaatagcaaagccgagttccaagccccatgtcggaccaccaaatatccacgagagattccaccgttgccttggtaccgtgggaccctccctcagatggcaatggcgggttttcttccattcagtgctatctacattgagctttactacatatttgccagtgtttggggtcacagaatctataccatatacagcatcttgttcattgtcttcatcattctggtcattgtcactgcctttattaccatagctttgacatacttccaactagctgctgaagatcatgaatggtggtggagatctttcctatgtggtggttcaactgggctgtttatctacggatattgcttgtattactactatgggcgttccgatatgacgggtttcatgcagacctcattcttctttggttacatggcatgcatttgctatgctttctttctcatgctcggtactattggtttccgtgctgcgctcttctttgttcgacatatataccgttctatcaagtgtgagtaaacacaacatgcccttacagtttgtactaggagagggaacttcattttttccttattacaaaaaagttatatctatcata

SEQ ID NO: 1306 - DNA, 2543 bp, Avena sativa
tgaaaaaataacgccatccgaagaggacctgagccaaacccaacccccagtccccagatctccttccccctctcccgaggtctctctattaagaagcacacaagcaaagcgccactcagatctccccgccccttccaagttccacccctcgtgccccgagccctctctcgcctcgcccgcccgtcaacgctctgccgcccggggggacgcgagatggcatcgccggccgcgggcgcggcctcggcgctcctcgtcctgctcgccttcgccgtggccggcgtcttctccgacggctccgaccaccgctacaaggccggcgagcccgtaccgctctacgccaacaaggtcgggcccttccacaaccccagcgagacgtaccggtacttcgacctccctttctgctcccctgagaaagtgaaggagaagagcgaggcgctaggcgaggtcctcaacggggaccggctggtcgacgcgccttacaagctcgacttccgcgtggactacgactccaaggcggtctgctcgaagaagctcgccaaggaggacgtggccaagttccgcaactcggtggccaaggactactacttccagatgtactacgacgatctcccgctctggggtttcatcggtaaggtggacaaggggaccaagctgccccctaccgagtggaagtactacctctacaggcacatcatctttgacatcctctacaacaatgaccgggtgatcgagatcaatgtgcacacggaccagagcgcgctggtcgacctcacggaggacagggagaccgatgtggagttcctttacactgtcaagtggaaggagacgccgacgccctttgagaagaggatggagaagtattccagttcctccaacatgccgcatcacttggaggtccattggttctcgattataaactcttgtgttacggtccttctcctcacagggttcttggccacaattctcatgcgagtgctgaagaatgattttgtcaagtatgcccatgatgaggaagtagctgatgaccaagaagagtctggatggaagtacattcatggtgatgtcttccggttccccaagaacaagtctttgttttcagctgctcttggcactggaactcaactgtttgctctaacaacctttatattcctgcttgcacttgttggagtattctacccatacaatcgtggtgccctgttcactgcattggtcgtcatctatgcacttacttcaggaattgctgggtacattgcaaccgcgttctattgccagctagagggaacaaactgggtgaggaacttgctattgacaggatgtctgttctgtggacctctctttctgacattctgtttcttgaacaccgttgctattgcttatagtgcaacagcagcattgccattcggtaccatatgtgtcattgtgctcatctggaccttagttacatttcctctactggttttgggaggcattgctggtaaaaacagcaagagtgaattccaagctccttgccgtaccaccaaataccctagggagattcctccacttccctggtaccggacaacagttccacagatggctatggctgggtttttgcctttcagcgctatatatatcgagctctactacatctttgccagtgtttggggtcaccgaatctacaccatttacagcatcctcttcatagtgtttatcatcctcctcattgtcactgccttcattactgttgcgctgacatacttccagcttgctgctgaagaccatgagtggtggtggaggtcattcctatgtggaggatcaactggatttttcgtgtatggctactgtctgtactactactacgcacgatcggatatgtctggcttcatgcagacatctttcttctttggctacatggcctgcatctgctatgcgttcttcctgatgctcggcatgattggtttccgtgctgccttgttctttgttcggcacatatacaagtccatcaagtgtgagtaaaccgtgctggaggatgaagagcagcagagttgtaccccctttttggtgccgctaagaagtcccagtatagaaaaggttagctctcgcgtgcaacaggaagcaactagagattggcatgtttcagattaggccattattcataggaacaggtaatgaacctataaaatttgttctgttttgtgcgaccggtatgataaatcgtcttttccttcctcccttgtaccatgtgacatccagacactgtattactttgttgaaccatgacctacatgaatatctgtggaagttcttataatgttatgtcatattctccctatggcagaataatttagtgtagagatgatatgccgcctcaagaagggcatgccctgtcaacttgtactgctatatgtgtatcatttgcattctggttatgtatttatatcagaattttagtttccataattacttgctgagctcattgttatggctggtttgcaataattccatgtacctagccaaaaaccgatgcagatgaaggtcatgctgcttatatcttttcatgttgg

SEQ ID NO: 1307 - DNA, 2245 bp, Populus trichocarpa
ggcctctttttgacacgaaggttaaccgtttttgcgtcttgaagtcttcttcgagccacagcctgaaaagtattcatctttataactctctctctctatctctctatgctctgtgtatgagttacagagagcgaaaatggagatgaaactagtgccttgtttggtagtctctattttgatcctatgcaatgtgacccgtgttagatcagatgcatctactaatcgttacaaagtaggtgatgatgtccctctttatgttaacaaagttggaccttttcacaatcccagtgaaacataccggtatttcgatcttcctttctgttcatcaggtcctacaaaggacaagaaggaagcccttggtgaactgttgaacggggatcgtttagtcactgccccatacaaacttgactttttaaatgacaaagactctgaaattgcttgcaaaaacaagctgacaaaggagcaagttgctcagttccgagaagcagtttccaaggactactacttccaaatgtactacgatgacttgcccatttggggtttcatagggaaagttgaaaaggaaggcaagaatgaccctagcgaatacaaatattacctctttaagcatcttcacttcaccatcttttacaacaaggatcgtgtcattgagataactgcactatccgatccgaaaaatgttgtggagctgactgaaaataaggaagttaatgtggagttcatgtattcagttaaatggaaggaaacagaaattccatatgagaaaaggatggagaaatattcacaatcttcttcactgcctcatcacttggaaattcattggttctcaatcattaactcatgtgtgactgttctcctcttgactggttttcttgcaacaattctcatgcgagtcctgaagaatgattttgtcaagtatgctcacgatgaggagtcagctgaagaccaagaagagaccgggtggaagtacatccatggtgatgtatttagatatccgaagtataagtctgtacttgcggcagcagttggctctggcacccagctgtttactctcacaattttcattttcttactcgctctagttggtgtattttatccttataatcgcggagctcttttcaccgccctggttgtcatatatgccctcacagctggaattgcaggctacactgcagcctctttcttttgccaactggaaggaacaaactgggtcaggaacttgttgttaactggaggtctgttttgcggacctctgctcctcacattcagctttcttaatactgttgcaatcacatatagtgccactgcagcattgccttttggaaccatagtggtgatatttcttatttgggctttggtaacaacaccattgctggtacttggtgggattgctgggaagaatagcaaggctgagtttcaggctccttgccgcaccactaaatatccgagagagattcctttgttgccttggtatcggaaaacacttcctcagatggccatggctgggttcttacctttcagtgcaatctatatcgaactttactacatatttgccagtgtttggggtcacaggatctacaccatatacagcatcttgttcattgtcttcatcattctcttgattgtcactgcttttataacagtggcattgacatatttccaacttgctgctgaagaccatgagtggtggtggaggtctttcctctgtggtggatcaactggattgttcatttatggctattgcttgtattactactttgcaagatcagatatgtccggcttcatgcaaacctcatttttctttggctacatggcttgcgtttgttatggtttcttcctcatgcttggctccattggtttccgtgcttccttattttttgtccgccacatttaccattcaatcaagtgcgaatagcaagtgatatggtgttcatcatgttcaatgagaggagatgcagcaggtggcttggaagacatgctctgggatttcaagggctttatgccactgccttggagaatgattgcagattacatgtaggactttttgttatattatcttttatagtagaatatgtaggactttatatcatgcagtgcttgaatgtgagcacaagccctctgtttttagtgtattgtaaggcattaaccgttatttaacggaaccctttttcagtgctatattgctgttaagtgcgtgtgttacaaataattcaagataatgatagctacacatattattttaaca

SEQ ID NO: 1308 - DNA, 2090 bp, Flaveria ramosissima
attggggaataattttcagatctgaaagattgaaatatcaaatcgagacgtgtaaaatcaatgcattttatggtgaagcagtcggcaacatgtactagctagttcacatcacacgccaccaccattttcattttcaagcaatcgattacctttaaccacattacagttacagagatctggatctattcatcttcatcttcatctcttcgatcactgtgttcatatgatggcgattgatcaatgtatggtggtggcattgcttgtgatttgcagtgtaatgggtgcagtcacctccgatgtttccaatcacaagtacaagaacggagatgcggttcctctgtacgctaacaaggttggcccatttcaaaatccgagtgaaacgtaccgctattttgatctaccattctgcttgccaggtgatttgaaagagaaaaaggaagcacttggagaagtgttaaatggagaccgtttggttagtgctccatacaagcttgatttcttggttgataaggattcggagacgatttgctccaagaaacttacgaagcaagaagttgggaagtttcggaaagccatttcaaaggactactacttccaaatgtactttgatgacttgcctctatggggtttcatagggaaatatgattcgaatgaacaaaaatactacctttttaagcatttgcattttgaggtactttacaacaaagagcatgttattgaggttaacgtccaaacggatcccagtgctcttgtggatataacccaagacaaggaagtcaatgttgacttcatgtacacagttagatggaaggaaaccaatattccttttaaaaagaggatgaacaagtactcacaaagttcttcactaccacatcacttggaaatacattggttctcaatcatcaattcttgtgtcaccgtgctccttttaactggtttcctagccacgattctcatgcgcgttctcaagaatgattttgtcaaatatgctcatgatgaggaaacagctgaagatcaagaagaaactggatggaaatacatacatggtgatgtcttcagatacccacaattcaaatctttatttgctgccgcccttggttgtgggacccagttatttgcacttacaatctttatcttcatactcgcattggttggtgtcttttatccatataacagaggagcgctgttcactgcattggttgtaatatatgcgctaacatctggaatagctggctatacagcatcctctttctattgccagcttgaaggaacaaattgggtgaggaatttggtgttgactggaagcctgttctgtggaccccttttcataacattttgctttctgaatacggttgccatcggttacagtgcaacagcagcattaccatttggaacaatagtgataatatttctgatatggggattggtgacgtcaccattgctagttttaggcgggattgctggaaagaacagcaaagcagagttccaagccccgtgtcgcaccaccaaatatccaagagagattccgccattgccatggtatcgtgggaccctcccccagatggcaatggcgggttttcttccattcagtgccatctacattgaactttactacatatttgccagtgtctggggtcacaggatctataccatctacagcatcttgtttattgtcttcatcattctggtcattgtcaccgcctttatcaccatagccttgacatacttccaactagctgctgaagatcatcaatggtggtggaggtcttttgtatgtggtggttcaaccggtctgtttatctatgggtattgcttgtattactactatgggcgctctgatatgacaggtttcatgcagacctcattcttttttggttacatggcgtgcatttgctacgctttctttctcatgctcgggaccattggtttccgtgctgcactcttctttgttcgacatatataccgttctatcaagtgtgagtaacaaaacatgtcctcacaatttgtactagaagagaggacttcatttttgtcctttaaaacaaattatatatctatcttatattaatagacgcataattttgcaacaa

SEQ ID NO: 1309 - DNA, 1925 bp, Arabidopsis lyrata
cggagaacaaaaatcagtcttatctctaagtcataatcatgaaattgatcatcatcatcatcatcgacccaaccgcttaaacctctctctttctttctctctaatctcaaatggtactattgcattcgatgacgtcgcttcttctagtgttcttcttcctctccggcgtttctccggttatctctgacggttccgatcaccgttacaaggtcggtgatgatgttcctctttacgctaacaaagtcggtccgtttcataatcccagtgaaacatatagatactttgatcttccgttctgttcatcagctcctgttaaggagaagaaggaagctctaggggaagttcttaatggagatcggttagtcagtgcaccgtacaaacttgagtttttgggtgagaagaattctgaagttgcatgtaggaagaggttgagtagagaagatgttgctaagtttcgtgatgtgattgcgaaagactactactttcagatgtattatgatgacttgcccatctggggattcctggggaaagttttcaaggagggaaaaactgacccatctgagtataaatattatctcttcaatcatctacagtttgagattttctataataaggaccgagttattgaaattattgtgagaacagaccagaatttccttgtggacttgactgaggacaaggaagtccaagtggatttcacatatactgttcgatggaaggaaacagaaatcccattcgagaagaggatggagaaatactcactggcttcatcaatgccacatcacttggaaatccattggttctccatcattaactcatgtgtcacagttcttctcttgactggtttccttgcgacgattcttatgcgagtcttaaagaatgattttgtcaagtatgcacatgatgaagaggcagtcgatgaccaagaagagactgggtggaaactgatccatggtgatgtatttaggttccccaaacacaaatccctactggctgcagcccttggttctggcacacaattgtttacactagctgttttcatcttcatgcttgcgttagtcggtgtcttttatccctacaaccgtggagcgttgtttactgcattagtggtcatatatgcacttacttcagggattgccggttatactgctgcttctttctattgccagctagaaggaactaattgggttaggaatgttatactgactggaagccttttctgtggacctcttttgctcactttctccttccttaatactgttgcaattgcttaccaagccactgcagcattgccatttgggacaattgtggttattttccttatatgggcacttgttacttcaccattgttaatactgggaggtattgctgggaagaacagaaaatccgagtttcaagctccttgtcgtaccacaaaatatccaagagagatcccaccaatgcgttggtacaggagaacacttccgcagatggctatggctggttttttaccgttcagtgccatttacatcgagctttactacatatttgccagtgtttggggtcacagaatatacaccatctatagtattctgtctatcgtcttccttattcttgtcatagtcactgctttcatcacggttgcattgacatacttccaacttgctgctgaagaccatgagtggtggtggagatcattgctatgtggtggatcaacgggcttattcatatacgcctactgcttgtattactactatgcacggtcggatatgtcagggttcatgcagacttccttcttctttggctacatggcttgcatctgctacggattcttcctcatgctcggggcaatcggattccgtgcttcccttctctttgtccgtcacatttaccgctcaatcaagtgcgagtaaaacttggaagattattcactccctcaactactc

SEQ ID NO: 1310 - DNA, 2681 bp, Ambrosia trifida
agatctctatcccatccatccatccttctctcccaatctccatccctaacataaacctgtgttcatatgatggagaacaacgcactgatccatcaatggttgcttctagcattgctcgttatttgcagtgtaatgacgtctgtcacgtcagatgtttcggatcataaatacaaaagcggtgatgctgttcctctgtatgccaacaaagttggcccctttcaaaaccctagcgaaacataccgctattttgatctaccattctgtttgccagatgatttgaaagagaaaaaggaagcgcttggagaagtgttaaacggagaccgtttggttagtgctccatacaagcttgatttcttggttgataaagattcagagtcgatttgctccaagaaactttcaaagaaagaagtcgaaaagttcaggaaagccatttcaaaggactactactttcaaatgtattttgatgacctgcctctatggggtttcatagggaaatatgataaaaaagagcaaaaatattacctttttaagcatctgcagtttgaggtactttacaacaagaatcatgttattgaggttaatgtccaaacggatcctactgctcttatcgatatcactcaagacaaggaagtcaacgttgactttatgtacacagttagatggaaggaaacaaaaattccttttaaaaagaggatggacaagtactcacaaaattcttcactaccgcatcacctggaaatacattggttctcaattatcaattcttgcgtcaccgtgctccttttaactggtttccttgccacaattctcatgcgtgttctcaaaaatgattttgtcaaatatgctcatgatgaggaaacagctgaggatcaagaagaaactgggtggaaatacatacatggtgatgtcttcagatacccacaatataaatctttatttgcggccgcccttggttctgggacccagttatttgcacttacaatctttatcttcgtacttgcgttggttggtgtcttttatccatataaccgaggagctttgttcactgcattggttgtaatatacgcgctaacatctggaatagctggctatactgcatcctctttctattgccaacttgaaggaaccaattgggtgaggaatttgatactgactggaggcctgttttgtggaccccttttcgtaacgttttgctttctgaatacggtcgcgattacttacagtgcgactgcagcattaccatttggaacaatagtgataataggtctgatatgggcattggtgacatcgccattgcttgttttaggtgggattgcaggaaagaatagcaaagccgagttccaagccccatgtcggaccaccaaatatccacgagagatcccaccattgccatggtaccgtgggacgctccctcagatggcaatggcaggttttcttccgttcagtgccatctacattgaactttactacatatttgccagtgtttggggtcacagaatttataccatatacagcatcctgttcattgtcttcataattctggtcattgtcactgcctttattaccatagccttgacatactttcaactagctgctgaagatcatgaatggtggtggagatctttcgtttgtggcggttcaaccgggctgtttatctacggatattgcttgtattactattatgggcgttccgatatgtcaggcttcatgcagacctcattcttctttggttacatggcgtgcatttgctacgctttcttcctcatgctcggcactattggtttccgtgctgcactcttctttgttcgacatatataccgttctattaagtgtgagtaatacaacatgccctcaaatttgtactaggagagggaacttcaattttttcttattacaaaaatttatatctatcatatattattagacagattattttgcaacaaaaaagaaattcgtactttaagacgacaaacagagaatgttaacatgttcatagaacgatttacaccgtgtaaaagtttgattcacgaattagagtatccgcagtaatgatcattactgatcatactgcggatacatatctaaacttgcataaaattaaatctatcaccaaccaacctacctgaaaatcctgatcatcaacgagtagtagcatcagatgagaaaagtgttttatattttatgcacaaagctatttgctcatcatcttcttaaactcatcaaaattaacgcatccatcgccatcaacatcaaccgatttaatcatcttcctacaatccttcaacgaacacttctcacctaaactcttcaacaccgaatgcaactcattcgccgaaatcttcccgttcttatcctgatcgtacagatcaaacgcttcacgtaactctttatttataccagaagcatctgcaccattgcatcctcttttctggaactcaataaactcctttaggtcaataaaaccgtctttatcggtatctatttcatccattacaacttttaactcgttctctgacgtctcagagcccccgagggctctgagaatagagccgagttcggttatggagatttttccatccccgttcgcgtcgaacttgttgaaaacttttacgtagtcatgagtttcatcaatggcgcctgagttttttgcctattatgatattattattatctagttaata

SEQ ID NO: 1311 - DNA, 2149 bp, Arnica chamissonis
ataattgatgatgggggtttcagatctgattgattgaattgggacgtgggaactcagagtatgtaatggttaggcagtcggcaagatgtactcgctagttcacattacacgccaataccatttttaagaaagggtgtgtttggtgactcagttcttcgtttttatatacagttgcagttacagggagtgtgagatctggatctcgatccatccatctccgatctccgtctataacacaccataaatctgcgttcatatgatggacaacgcacggattcatcaatggctggcagtagcattgtttgtgatttgcagtgtaatgggggctgtcacatccgatgtttcaaatcacaaatacaaaaacggagatgctgttcctctctacgccaacaaagttggccctttccaaaatccaagtgaaacataccgctattttgatctaccattctgcttgccaggtgatttgaaagagaaaaaggaagcgcttggagaagtgttaaacggagaccgtttggttagtgctccatacaagcttgatttcttggttgataaagattcagagttgatttgctccaagaaacttacaaagcaagaagttgggaagttccggaaagcaatttcaaaggactactactttcaaatgtactttgatgacttgcctctatggggtttcgtagggaaatatgtgccaaatgaacaaaaatactacctttttaagcatctgcagtttgaggcactttacaacaaagaacatgtcatcgaggttaacgtccaaacagatcctagtgctcttgtggacatcaccgaagacaaggaagtcaatgttgacttcatgtataccgttagatggaaggaaaccaacattccttttcaaaagaggatggacaagtactcgcaaagttcttcactgccacatcacttggaaatacattggttctcaatcatcaattcttgtgtcactgtgctccttttaaccggtttccttgccacaattctcatgcgcgttctcaagaatgattttgtcaaatatgctcatgatgaggaaacagctgaagatcaagaagaaactggatggaaatacatacacggtgacgtcttcagatacccacaatccaaatctttatttgctgcagcccttggttctgggacccagttatttgcccttacaatctttatcttcatacttgcattggttggtgtcttttatccatataaccgaggagctctgttcactgcattggttgtaatatatgcactaacatctggaatagctggctatactgcatcctctttctattgccaacttgaaggaacaaattgggtgaggaatttggtgttgactgggagcctgttttgtggaccccttttcataacgttttgctttctgaacactgttgcaatcggttacagcgcgacagcagcactaccgtttggaacaatagtgataatcggtctgatatggggattggtgacctcaccattgctagttttaggtgggattgcaggaaagaacagcaaagcagagttccaagccccatgtcggaccaccaaatatccaagagagattccgccattgccatggtatcgtgggaccctccctcagatggcaatggctggttttcttccattcagtgccatctacattgaactttactacatatttgccagtatttggggtcacagaatctataccatatacagcatcttgtttattgtcttcatcattctcatcatcgtcaccgcctttattaccatagccttgacatacttccaactagctgctgaagatcatcaatggtggtggaggtcttttgtttgtggtggttcaacagggctgtttatctatgcgtattgcttgtattactactatgggcgttcggatatgacaggtttcatgcagacctcattctttttcggttacatggcatgcatttgctacgctttctttctcatgctcggcactattggtttccgtgctgcactcttctttgttcgacatatataccgttctattaagtgtgagtaatataacatgctcttacaatttgtactaggagagaagacttcatttttgtcaagtatatctatcatatattcgtagacacatgttgcaacaatataaccttttaatgtgatggagacatccttt

SEQ ID NO: 1312 - DNA, 2211 bp, Arabidopsis thaliana
gacaaaaagtggtttcgttaacaaaaagtaaaattgacatgacttgcattgcggagaacaaaaatcagtctctcatcactcactcataatcatgaatttgatcttcatcatcttcatcgacccaaccgcttaaacctctctctctctctttctctctaatttctaatggtacttcttccttcgatgacgtcgcttcttctggtgttcctcttcctctacggcgtttctccggttatctccgacggctccgatcaccgttacaaggtcggtgatgatgttcctctttacgctaacaaagtcggaccgtttcataatcccagtgaaacatatcgatactttgatcttccgttctgttcatcagctcctgttaaggagaagaaggaggctctaggggaagttcttaatggagatcgattagtcagtgcaccttacaaacttgagtttttgggtgagaagaactctgaagttgcatgtagaaagaggttgagtagagaagacgttgctaagtttcgtgatgtgattgcgaaagattattactttcagatgtattatgatgacttgcccatttggggattccttggaaaagttgtcaaggagggaaagactgacccatctgagtataaatattatctcttcaatcatctgcagtttgagattttctataataaggaccgtgttatcgaaattatcgtgaggacagaccagaatttccttgtggacttgactgaggacaaggaagtccaagtggatttcacatacacagttcgatggaaggaaactgaaattccattcgagaagaggatggagaaatactcactggcttcatcaatgccacatcacttggaaatccactggttctccatcattaattcatgtgtcacagttcttctcttgactggtttccttgcgacgattctcatgcgagtcttgaagaatgattttgtcaagtatgcacatgatgaagaggcagttgatgaccaagaagagactgggtggaaattgatccatggtgatgtatttaggttccccaaacacaaatccctgctggctgcagcccttggttctggcacacaattgtttacactagctgttttcatcttcatgcttgcattagtcggtgtcttttatccctacaaccgtggagcattgtttactgcattagtggtcatatatgctcttacttcagggattgccggatatactgctgcttctttctattgccagctagaaggaactaactgggttaggaatgttatactgactggaagcctcttctgtggacctcttttgatcacgttctccttccttaatactgttgcgattgcttaccaagccactgcagcgttgccatttgggacaattgtggttattttccttatatgggctctggttacttcaccattgttaatattaggaggtattgctgggaagaacagaaaatccgagtttcaagctccttgtcgtaccacaaaatatccaagagagatcccaccaatgcgttggtaccggagaacacttccgcagatggctatggctggttttttaccgttcagtgccatttacatcgagctttactacatatttgccagtgtttggggtcacagaatatacaccatctatagtattctgtctatcgtcttccttattctcgttatagtcactgcttttatcacggttgcattaacgtacttccaacttgctgctgaagaccatgagtggtggtggagatcattgctatgcggtggatcaacgggcttattcatatatgcctactgcttgtattactactatgcacgatcagatatgtcagggttcatgcagacttccttcttctttggctacatggcttgcatctgctacggattcttcctcatgctcgggacaatcggattctgtgcttcccttctctttgttcgtcacatttaccgctcaatcaagtgcgagtaaaacttgaagattcttcactccctcaactactagcgatggtgatgaggcgatccggcgaggttgtctatttttgttttgttttgttacccttctatttttttcagatcttatatttttagttattctcttgtggtatgatgtccttgagaacgatagtgagacagtaggtacgaacacaagtttctcgtagatattttttcccacaaaatagtgaaagactaatacgatgtctactaattctactgatacaagcaaaaattattt

SEQ ID NO: 1313 - DNA, 2374 bp, Elaeis guineensis
ctccagaatcccctctttcgcttttccaactggtcgtcaagctatccattcccgtgatcccatttctctgtgcctcccttaccaacactcagatctcaaagtctggtctcactactccccacaaatcctaggttcctcaaatcaaaaccaaccttttttgaggaaagatcccaccgttgtctgtagatcttgaagtcattgccccttttgaaagcagggcctgcttagagatccgtagaagagcggtaaggatttggttttgttttctggaaaagtacaaaatttgaaagagatgaagatacaatgggcagttctgctggtcctgttgttggtttgtgattggagagttaaagcggatgggtcggatcacaggtataaggaaggagatcgtgtccctctgtatgccaacaaggtgggaccttttcacaacccaagtgagacatatcgttactatgatttgccattttgttcaccagatcacgtgattgagaagaaggaagcacttggagaggttctaaatggtgatcgtttggttgatgcaccatatgagttgaactttcgggaagacagagagtcgacaactatttgtgaaaaatccttgtcagaaaaagatatcgcaaagcttagaaatgcagttgcaaaagactactactttcagatgtactatgatgacttgcccttttggggattcattgggaaggttgacaaggataatcttgacccaagcgagtacaaatacttgctatttaaacacatccacttcgatattttctacaatgatgaccgtgttatagaaataagtgtccaaactgacccaaatttaactgtggatattacggaggataaggcagttgatgtcatgtttgcatactctgtgacatggaaaaatactgatattccttttgagaaaagaatggaaaaatattcaaaatcttcttcactgccccaacacctagagatccattggttttctataattaattcgtgtgtaacagtccttcttctaactgggtttctggctacaattctcatgcgtgtgctcaagaatgacttcgtcaaatactcgcatgatgaagaatctcttgaagaccaagaagaaactggatggaagtatattcatggggatgtctttcgatttccaaagtacaagtccttgttttcagctgttattggatctggaactcagctcttaacccttgcaatgttcatcttcctccttgcactagttggagtgttctatccttacaacaggggagctctcttcacagctctggttgtcatatatgctctaacctctggtattgctggttacatagctacctccttctatctgcaactagaagggaccaactgggtgaggaatttgttattgacaggctgcttgttctgtgggccgctgttcttaacattttgcttccttaatactgttgccattgcatacaatgcaactgcggccttacctttcggtactatccttgtgattcttctcatatggacactggtaacttctcctttgcttgtgttgggtggaattgctggtaagaacagcaagacagaattccaagctccatgccgcaccacaaagtatcctagagaaattcctcagttaccatggtacagagggactgttcctcagatggcaatggcaggatttcttcctttcagtgcaatctacattgagctgtactacatatttgctagtgtgtggggtcacaaaatttacaccatatacagcatcctttttattgttttcatcattctcatcattgttaccgcatttatcacggtggcattgacatatttccagcttgctgttgaggaccatgaatggtggtggaggtctgttctttgtggtggttccactggtatattcatcttcttctactgcttatactactatcatgcaagatcagatatgtctggttttatgcagacatcgttcttttttggttacatggcttgcatctgctatggattcttcctcatgttggggaccgttggattccgtgcttccttgctatttgtgcagcatatatatcgttcgatcaaatgcgagtagatgtgccttggctactcaatctgagtgcctgatattttcagtaacttgagtcatgtggaaacccttctccactgaagctgcacggtggctggctgctagctgatcattcttcaattgttaataccaagaaatattcctcagcaagggctaaatgattttgtttatgatcattatacctttgttgcctatgtttgccctccatacatgttgtcgttacatgacaaatttctagttgtgaagatatgataatgttgttctttagacatcgtgttatgcaaaattaagacctggtaaacagtaactttttctctggat

SEQ ID NO: 1314 - DNA, 1985 bp, Phalaenopsis aphrodite
tggcgtcggtgacgctagcgctgctgctctgtttcgggattgttggagtcgcatcggacgcatccgatcacacctacaaacctgatgaagttgtccctttgtacgccaacaaggttgggcccttccataaccctagtgagacctacaggtacttcgatctccccttctgttccccagaacctgtaaaagataaactagaagctcttggagaagttctgaatggagatcggttggttgatgcaccatacaagcttgattttcgtgttgatcatgaatccgcatcggcgtgcaaaaaacatctcactaaagaagaagtggcgaaattcaggagcgcagttgataaggagtattattttcagatgtactatgatgaccttcctttgtggggttacattgggaaagttgacagggatggaaggaccgaccctagcgagtacaagtacttcctttacaggcatatcatgttcgaaatttattacaacaatgatcgtgttattgagatcaatgctcacgctgatatgaattcaatggttgacattaccgaggacaaagagatagatgtggagttcatgtattctgcaaagtggaaggaaactggcactccttttgagaaaaggatggagaagtactcacaaacttcttccctgccacaacacttggagatacactggttctcaataattaattcatgcgttacggtgcttctgctaactggattccttgccacaatcctaatgagagttttgaagaatgattttgttaaatacacacatgatgaagagacaggcgaagatcaagaggagactgggtggaaatatgttcacggtgatgtattcaggttccccaagaacaattctttgctagctgcttgtcttggttctggtactcaattgtttgctcttacaatttttgtttttgcacttgcattagtgggagtattctacccttacaaccggggagctctttttaccgcgctagtagttatttatgcacttacatccgggatcgcgggttatactgctacttctttctattgtcagatggaaggatcaaattgggttaggaatcttctattaacaggatttcttttctgcggacctctcttcttgacattctgcttccttaatactgttgctattgcatatagtgctactgcagcattgccgtttggtacaattattgttattgttctcatttgggcattagtaacatctcctttgcttgtttttggcgggatagctggcagaaacagcaagacagagttccaagctccttgtcgtaccactaaatatccgagagaaataccgccgctaccttggtatcgaagaaccataccgcagatggcaatggctggttttctaccattcagtgccatctacattgaactctactacatatttgccagcgtgtggggtcacagaatttacactatttatagtattctctctgtggttttcgtaattctgcttatcgtcactgcatttattactgtagcaatgacctactttcagcttgctgctgaagatcatgaatggtggtggagagcattcctttgtggaggatctactggtttgtttgtctatgcatactgcttttactactattatgctcggtcggacatgtcaggattcatgcagacatccttcttttttggttacatggcatgcatctgctatggtttcttccttatgctcggttccgtaggtttccgagcctcgctgttgtttgttcgtcacatttaccggtcgattaaatgcgagtaatcctaatactcgaacgaagacacgagtttcttataaatgctccagcgaagataaaaggatgatgaagaatatgtcacagtaagctgtaatttacatctttctttggtgttattgttcattataaagttaggatgctgccttttttattgtcttcgctttgcttccaagcctttttattattattatttttgtcacataggtaatttatgaaatgaacttttt

SEQ ID NO: 1315 - DNA, 1803 bp, Flaveria ramosissima
acaaacctgacgacgaagttcctatttaagctaacaaagttggcccctttcacaaccctagtgaaacatatcgtttttatgatctaccattctgtttaccagctcattttaaaggagaagccagaagctcttggtgaggtactgaatggagatcgtttagtgagcgctccttataagcttccgtttatgcgtgaaaaggactcagaaattgtttgcagaaaaaaactaacaaaagatgaagtatctaaattgagaaaggctgttgccaaggattattatttccaaatgtactatgatgacttgcctttttggggctttctaggaaaggttgaaaaggacaaaactgaccctagtgaggaaaaatattacttgttcaagcatcttcattttgagatacactacaataaagatcgtgtgatagagataaatgcaaaagctgatcctgatgctgtggtggatcttaccgatgacaaggaagtcgaggtagaatatctgtacactgtgaggtggaaagaaactaatattccctatgagagtagaatggagaagtactcccagacttcttcacagccacatcacctggagatccattggttttcaattattaattcatgtgtcacggttctcctcttaactggttttcttgccaccattcttatgcgggtccttaagaatgactttgttaagtatgctcatgatgaagaagctgctgatgatcaagaggaaactggttggaaatacatccatggtgatgttttcaggtacccgaagtacaagtctctgtttgctgctgcacttggttctggtacccagctattttctctggcactttctatctttgggcttgctcttgttggtgtattttatccatataatcgaggagctctgtttactgcgctggttgtcatatatgcacttacttctgggtttgcaggttacactgcagcctccttctatcaccagctagaaggaactaactgggtgaggaacttactattgactggctgtttgttctgtggccccctctttcttactttctgctttctaaacactgttgcaattgcttacaccgctactgctgctctaccttttggtacaatagtggtgattgtattaatatggacgttggtgacttcacctttgctagtattgggtggtattgctggaaaaaacagcaaggcagaatttcaggcacctgttcgcaccacaaaatatcccagagagatcccaccattaccttggtaccgtaaaaccatccctcaaatggccatggctggttttcttcctttcagtgcaatctacattgagctttattacatatttgccagtgtatggggccacaagatttataccatttacagcatcttatttatagtctttatcatcctcatcattgttactgcctttatcactgtggcattgacttatttccaacttgctgctgaagatcatgaatggtggtggaggtctttcttatgtggggggtcaactggtgttttcatatttgggtattgtttgtattattattatgagcgttctgacatgtcgggattcatgcaaacatcgtttttctttggttacatggcttgcatttgttatggtttctttctcatgcttggaatggtcggtttccgggcggctttgttctttgttcgtcacatctatcgctcaatcaagtgtgaatagaagtttaatgttcattctgccatgctccagacagggttgctgttgctgttgctcttgctgccggctgctgccaccactcagtgtgaagtcatgaaagctatgagactagtttacata

SEQ ID NO: 1316 - DNA, 2024 bp, Brassica napus
ttctctcatcgtcgctaatcatggagaaaccaccgcaccttctgctgcttctgcttgtttttttcatctacggcgtttctccggtgatatcggacggttccgatcaccggtacaaggtcggcgatgatgttcccctttacgccaacaaagtcggcccgtttcacaatccgagtgaaacgtaccgatactttgatctacccttttgttcttcagctcctgttaaggaaaagaaggaagctctcggggaagttctcaatggagatcggttagtcactgctccttacaaactagagtttttgggtgagaagaactctcatgtcgcatgcagaaagaggttgagtagagaagacgttgctcagtttcgagatgtcatctccagagactactactttcagatgtattatgatgacttgcccatctggggtttcctgggaaaagttgtcaaggacggcaaatctgacccgtccgagttcaaatattacctcttcaaccacctgcagtttgagattttctacaataaggaccgtgttattgagattattgtgagaactgaccagagcttcctcgtggacttgactgaggacaaggaagtcgaagttgatttcacttacacagttcggtggaaggaaacagaaatcccattcgagaagaggatggagaagtactcactcgcttcctcaacgccacatcacttggagatccactggttctcgattattaactcatgcgtcactgttcttctcttgactggtttccttgcaactattctcatgagagtcttgaagaatgattttgttaagtattcacatgatgaagagacggctgatgaccaagaagagaccgggtggaaattgctccatggtgatgtattcaggttcccaaaacacaaatcgctgctggctgcagcccttggttctggcacacaactgtttacactggcggttttcatatttatgcttgcattagtcggtgtcttttatccttacaaccgtggagcattgtttactgcattggttgtcatatatgctctcacttcagggattgctggatatactgcttcttctttctattgccagctagaaggaactaactgggttaggaatgttatgctgactggaagcctcttctgcggacctcttttactcactttctccttccttaataccgttgcgattgcttaccaagccactgcagcgttgccgttcgggacaattgttgttatcttcctcatatgggcactggttacctctccactgttaatattgggaggtatcgccgggaagaacagaaaatctgagtttcaagctccttgccgcaccacaaaatacccaagagagatcccaccgatgcgctggtacagaagaacacttccgcagatggccatggctggttttttgccgttcagtgccatttacatcgagctttactacatatttgccagtgtttggggtcacagaatatacaccatctatagtattctgtctatcgtcttccttattctcgtcatagtcactgctttcatcacggttgcattaacatacttccagcttgctgccgaagaccatgagtggtggtggagatcgttgctatgcgggggatcaacaggcgtattcgtttacgcatattgcttgtattactactatgcacgatcggatatgacagggttcatgcagacctcattcttcttcggctacatggcatgcatctgctacggattcttccttatgctcggggcagttggattccgtgcatcccttttctttgtccgtcacatctatcgctccataaagtgcgaataagaattgaagattcttcttgtactcctcctctctactggtgaagaagcgatgttggatgcggccgtgggcaatcgatccggtgaagttgtccagtttttttttttttttttcttttttgaggtaattttcattttcttctgatcttttatttttgttgtttgtattctctcctgggatcatgtccttgagaatgatagtgagacagtaagaaagaacatttcgagc

SEQ ID NO: 1317 - DNA, 1789 bp, Flaveria ramosissima
gtcacctccgactgtttccaaccacaaacacaaaacggaagatgatgttcctctgtacgctaacaaggttggcccattcaaaatccgagtgaaacgtaccgctattttgatttaccattctgcttgccaggtgatttgaaagagaaaaaggaaagcacttggagaagtgttaaatggagaccgtttggttagtgctccatacaagcttgatttcttggttgataaagattcggagacaatttgcttcaagaaacttacgaagcaagaagttgggaagtttcggaaagccatttcaaaggactactacttccaaatgtactttgatgacttgcctctatggggtttcatagggaaatatgattcaaatgaacaaaaatactacctttttaagcatttgcagtttgaggtactttacaacaaagagcatgttattgaggttaacgtccaaacggatcctagtgctcttgtggatatcacccaagacaaggaagtcaatgttgatttcatgtacacagttagatggaaggaaaccaacattccttttaaaaagaggatgaacaaatactcacgaagttcttcactaccacatcacttggaaatacattggttctcaatcatcaattcttgtgtcaccgtgctccttttaactggtttccttgccacaattctcatgcgtgttctcaagaatgattttgtcaaatatgctcatgatgaggaaacagctgaagatcaagaagaaactggatggaaatacatacatggtgatgtcttcagatacccacaattcaaatctttatttgctgctgcccttggttgcgggacccagttatttgcccttacaatctttatcttcatacttgcattggttggtgtcttttatccatataaccgaggagcgctgttcactgcattggttgtaatatatgcgctaacatctggaatagctggctatacagcatcctctttctattgccagcttgaaggaacaaattgggtgaggaacttggtgttgaccggaagcctgttctgtggaccccttttcataacattttgctttctgaatacggttgccatcggttacagtgcaacagcagcattaccgtttggaacaatagtgataatatttctgatatggggattggtgacctcaccattgctagttttaggcgggattgcaggaaagaacagcaaagcagagttccaagccccgtgtcgcaccaccaaatatccaagagagattccgccattgccatggtatcgtgggaccctccctcagatggcaatggcgggttttcttccgttcagtgccatctacattgaactttactacatatttgctagtgtctggggtcacagaatctataccatatacagcatcttgtttattgtcttcatcattctggtcattgtcaccgcctttatcaccatagccttgacatacttccaactagctgctgaagatcatcaatggtggtggaggtcttttgtatgtggtggttcaaccgggctgtttatctatgggtattgcttgtattactactatgggcgctccgatatgacaggtttcatgcagacctcattcttcttcggttacatggcgtgcatttgctacgctttctttctcatgctcgggaccatcggttccgtgctgcactcttctttgttcgacatatataccgttctatcaagtgtgagtaacaaaacatgccctcacaatttgtactagaagagaggactttcattttttgtcctttaaaacaaattatatatctatcatatattaatagac

SEQ ID NO: 1318 - DNA, 2286 bp, Brassica rapa
aaaaaagggaagtgtggtcttattaaatagagaaaatactgaaagcaagggaaagaaaataacaaaacggcagcgtatgatgatgagttgcatcgcggagaaacaaaatcaccctcactcgtacgtttatcgctcatgatcatcgaaccaaccgcttaaacctcattttctctcatcgtcgctaatcatggagaaaccaccgcaccttctgctgcttctgcttgttttcttcatctacggcgtttctccggtgatatccgacggttccgatcaccgttacaaggtcggcgatgacgttcccctttacgccaacaaagtcggcccgtttcacaatccgagtgaaacgtaccgatactttgatctacccttttgttcttcagctcctgttaaggaaaagaaggaagctctcggggaagttctcaatggagatcggttagtcactgctccttacaaactagagtttttgggtgagaagaactctcatgtcgcatgcagaaagaggttgagtagagaagacgttgctcagtttcgagatgtcatctccagagactactactttcagatgtattatgatgacttgcccatctggggtttcctggggaaagttgtcaaggacggcaaatctgacccgtccgagttcaaatattacctcttcaaccacctgcagtttgagattttctacaataaggaccgtgttattgagattattgtgagaactgaccagagcttcctcgtcgacttgactgaggacaaggaagtcgaagttgatttcacttacactgttcggtggaaggaaactgaaatcccattcgagaagaggatggagaagtactcactcgcttcctcaaccccacatcacttggagatccactggttctcgattattaactcatgcgtcactgttcttctcttgactggtttccttgcaactattctcatgagagtcttgaagaatgattttgttaagtattcacatgatgaagaggcggctgatgaccaagaagagactgggtggaaattgctccatggtgatgtattcaggttcccaatacacaaatcgctgctggctgcagcccttggttctggcacacaactgtttactctggcggttttcatatttatgcttgcattagtcggtgtcttttatccctacaaccgtggagcattgtttactgcattggttgtcatatatgctctcacttcagggattgctggatatactgcttcttctttctattgccagctagaaggaactaactgggttaggaatgttatgctgactggaagcctcttctgcggacctcttttactcactttctccttccttaataccgttgcgattgcttaccaagccactgcagcgttgccgttcgggacaattgttgttatcttcctcatatgggcactggttacctctccactgttaatattgggaggtatcgccgggaagaacagaaaatctgagtttcaagctccttgccgcaccacaaaatacccaagagagatcccaccgatgcgctggtacagaagaacacttccgcagatggccatggctggctttttgccgttcagtgccatttacatcgagctttactacatatttgccagtgtttggggtcacagaatatacaccatctatagtattctgtctatcgtcttccttattctcgtcatagtcactgctttcatcacggttgcattaacatacttccagcttgctgccgaagaccatgagtggtggtggagatcgttgctatgcgggggatcaacaggcgtattcgtttacgcatactgcttgtattactactatgcacgatcggatatgacagggttcatgcagacctcattcttcttcggctacatggcatgcatctgctacggattcttccttatgctcggggcagttggattccgtgcatcccttttctttgtccgtcacatctatcgctccataaagtgcgaataagaattgaaggttcttcatgtactcctcctctttactggtgaagcagcgatgttggatgcggccgtgggcaatcgatccggtgaagttgtccagttttttttttttttcttttttgaggtaattgtcattgtcttctgatcttttatttttgttgtttgtattttcttctgggatcatgtccttgagaatgatagtgagacagtaagaaagaacatttcgagcttcacttggatttgtagattgatcgacatacaagttgcccgttcatatacatctgcagtcaattgctattataatgatgatcactattcactagagtg

SEQ ID NO: 1319 - DNA, 1923 bp, Cannabis sativa
atatatcatttttgtttgaatatttaaaatattatctcttaatgttaatggtaggtgatgtgaaggagaagaaagaagctcttggagaggtgctgaatggagatcgccttgttagtgctccttataaacttgagtttagaaaagagaaggaatctgaggttgcctgctcaaaaaagctgaccaaggaagatgttgctaagtttagggaagctgtgaaaaaggattactactttcaaatgtactacgatgacttgccaatctggggttttataggaaaggttgataaagatggaaaatctgacccaagcgaatataaatattctctttacaagcatatccattttgctgtactctacaataaagatcgtgtgattgaaatcagtgctaagaccgatccttcatcagttgtagacttgacagaggacaaagaggctgatgccgatttcacatacactgtaaaatggacagaaactgatattccttttgagaagagaatggacaagtattcacaatcttcttcactaccccatcacttggaaattcactggttctcaatcataaattcatgtgtaacagtgcttcttttgactggtttccttgcaacaatcctcatgcgggttttgaaaaatgatttcatgaagtatgcacaagatgaggaagcagctgatgatcaagaagagacaggatggaagtatatccatggtgacgtttttcggttcccaaagtacaaatcagtgtttgctgctgcccttggttccggcacacagttgttcactctcactatattcattttcatgcttgcattggttggtgtattttacccatacaaccgaggcgctttattcactgctttggtggtcatttatgcactcacatctggtatcgcgggatacacagcaactgctttctattgtcagcttgaaggaacaaactgggtgagaaatctgttgcttacagggtgcctgttttgtgggcccctgttcctcacgttctgcttccttaacactgttgcaattgcttatagtgcaaccgcagcccttccttttggcactatcgtagtcattgtccttatatggacattagtaacctcaccattgcttgtgttgggtggtattgctgggaagaatagcaaagctgaattccaagctccttgtcgcaccacaaaatatcccagagaaattccacctttgccttggtacaggagtacacttcctcagatggcaatggctgggttccttcctttcagtgccatttacattgagctttactacatattcgcaagtgtttggggtcacagaatctacaccatctacagcattctgtttattgttttcatcatcctcttgattgtcactgcattcatcactgtggctttgacatacttccaacttgctgctgaagatcatgaatggtggtggaggtctttcctatgcggtggatcaactggtctgtttatctacgcatactgtttgtattactactacgcccgatcagatatgtctggtttcatgcaaacctcattcttcttcgggtacatggcatgcatctgctacggtttcttcctgatgctcgggatggtgggtttccgtgctgcactgctctttgttcgccatatttacagatcgatcaagtgtgagtaagcattgttggctcgatgctgctgctctgggtaaaatctgtgctggtttcttcttctgctgcatcatcatcaaatggaggaaggtctgtgatttttgttaggtggatttggtcttttaggaattctactctgcgtttgctccaacagggtttagggatatattgggctctacttatgttgactgtatgtatttacaatgttgatgtggggaagagattgtataaccacatttttaccttactctctaaaacgatattttccatgttagcaaaaagtgaccctct

SEQ ID NO: 1320 - DNA, 1993 bp, Eschscholzia californica
gtggttgttctattagttatggtttctggttttagagtagaaggaaatgggtcaactcacaagtataatgaaagagaacatgtacctctttatgctaacaaagttggtccctttcataaccctagcgagacatatcggtactatgatcttccattctgtgcaccagacaatgtgaaggagaaaatagaagatctcggggaagttctgaatggagatcgattggtcgatgcaccttatgaattgaacttccgggtcgataaacaaagtgaaactctttgtaggaagaaactatcaaaagaagaagttgccaaactgagggatgccgttttgaaggattattacttccaaatgtattatgatgatttaccattttgggggttcctagggaaagttgaaagggaaggcaagacggatccaagtgaatacaagtatttgctttttaagcacatacattttgatattttctataacaacgatcgtgtcatagaaattaatgtgcagactgacccaaaccagtctgtggatatcacagaggacagggaggttgaggcagagttttcgtattcggtcaagtggaaagaaaccgacattccttatgaaaacagaatggagaaatactcaaagtcttcgtcaatgccccaacacttggagatccactggttctctataataaattcttgcgtgactgttctccttttgactggttttcttgctactattcttatgcgggtgcttaagaatgacttcgtcaaatattctcatgatgaagaagctgttgacgaccaagaagagactggatggaagtatatccacggagatgtcttccgatacccaaaatataagtcattgttttcagctgttcttggatcaggaactcaactccttgcgctggcaatgttcatcttcctccttgcattggtcggggttttctacccgtacaatcgaggcgctctttttactgctttggttgtcatatatgcccttacctccggaattgctggttatactgcaacatctacctatctgcaactcgaaggaactaactgggttagaaacttactattaacaggttgtttgttctgtggaccattgtttttgacattctgttttctcaacactgtcgcaattgcctacagtgctactgccgctttacctttcggtactatacttgttattcttctcatctggacactggtcactgctcctttgctagtattgggtggtattgctggtaaaaatagtaagacagagttccaagctccatgccgtacaaccaaatatccaagagaaatacctcctttgccgtggtacagaggaactattccccagatggcgatggccggatttttgcccttcagtgcaatctacattgaactttattacatatttgcaagtgtgtggggccacaagatttacaccatctatagcatcttgttcattgtgttcatcattctcatcattgtgacggcgttcattactgtagctttgacatactttcagcttgcagttgaggatcatgaatggtggtggaggtccgttctttgtggaggatcaactggtgtatttatcttcgggtactgcttgtattactaccacgcaagatcagacatgtctggttttatgcaaacttctttcttctttggttacatgacttgcatctgctatggtttcttcctcatgcttggtactgttggtttccgtgcttccttgttgtttgttcgtcacatctatcgttcaatcaagtgcgagtaggtcctaattcattggagatttggagttacgtacttacagtggtcttaaaacaaagtttgtagtcgtagtagtagcagcagtagcagtaatagaaaaacgtcggtaattattctccatatgtaaaaggattgtaattccaaatttaatctatagtatatcctggctttgtttgcgcttctgttcttttgtttgagactttgagttcttatttctattatcagttccagtaaaatatttgttt

SEQ ID NO: 1321 - DNA, 2516 bp, Pinus pinaster
accgaggggcagatgtggaacctcaaagaacggtacccttcgtttgaaagagcagcctcgtgcttttactgtttgctggatctatccatatgcctaattacctgattattggcttaaacagagtctaacatgggagcgggagaagcagaagtagaaagatcatttacagtagagtgaactagggctttcagtgaatataaggctcagggtttctgaacaaaccctgagggtccggggaagcaaattcaatggcaatgggaaggtttctggtgctggcgttggcattagcgcttttgtttggatatggagttgaagggagcgcctctgatcacagatacagcaaaggagatcatgtcccgctttatgccaacaaagttgggccctttcacaaccccagtgaaacataccggtattttgatttgccattctgccctccagataaggtgaccgagaaaagggaagatcttggagaagtgttaaatggtgaccgaatggttggtgctcgatataagcttcatttccaggaagacaaaaattctgaacttctttgcaggaaaaaattaactacggaggatttggggaagtttagagaagcagtgaagaaggattattattttcaaatgtattatgatgacttgcctatctggggttttataggaaaaaccgataaagaaaataatggagttccaattttactttacaaacatctccactttgaaatcctgtacaacaatgatcgtgtcatagaaattactgttcgtacagatccaaattttactgttgacattactgaggacaaggaggttgaagttgatttcacatactcagttaagtgggtggagactcagactccatttgaacggcgaatggataaatattcaaagtcttcatccttgcctcagcatttggaaatccattggttctctattataaattcttgtgtaacagttcttcttctgactggatttcttgccacgattctcatgcgtgttctaaagaatgacttcattaaatattctcatgacgaggaatcgactgatgaccaagaggagacaggatggaagtacattcatggagatgtcttcagatatcctccatacaaatctttgttttgtgctgttcttggttctgggactcagctttttacccttgccatatttatcttcatgcttgcactggtgggtgttttctatccatacaacaggggagctctatacacagcccttgtagttatatatgcccttacatctggcattgcaggttacacagcagcctccttctatcgtcagcttgaaggatcaaattgggtgcgaaatttgttgctgactggctgccttttctgtgggcccctgttcctaaccttctgctttcttaatacagtggccattgcttacaatgcaactgcagcattaccatttggaactattgttgtcattcttctcatctggacacttgttacctctcctttgcttgtgttgggtggtattgcgggtaagaatagcaaggctgagtttcaggctccttgccgcaccacaaagtatcccagagaaattccacttttgccttggtacagaggaacaattcctcagatggctatggcgggttttttgccattcagtgcaatatacattgaactatactatatttttgcaagcgtgtggggtcacaaaatttacacaatatacagcatcctcttcattgttttcattatccttattatcgtgacagcattcataaccattgcattgacatacttccagctggcagtcgaggatcatgagtggtggtggaggtctgtcttatgtgggggatcaactggtgtcttcatctttgggtactgcttatattattattttgcacgatcagacatgaatggtttcatgcaaacctcctttttctttggttacatgacttgcatctgctatggctttttcttaatgctcggaacagtgggcttccgtgcatctttactgtttgtccgtcatatctatcgctcaattaagtgcgaataattatattcctaggtgtagtgaacttctaggcttcatcggacattgttcggaggtgcagttgcatgtaatggccatattttctcttttcaagatgacgggttatgactcaaggatacatgaactcgatgatcatagagaagaaaatgaaaggaaatttcaaacgagaatcatgtagtcttttattgtaatttgttaggtttccaaagctttagtgttagcggactgactaacaaggttgttgcggaagagtaaaaacattgaaatctcaaaagaaggttattaatgtatcctggctcagtagccgttattgttcactttgttgaatgggccaaatttatgttatgcctagagtacagtgaggttatagataaatctctgttatgcctcggggaatttcacgtgttaggttgcaaatactctgtatcatgctgccttgtatctgttttcaaaaagtgcaaaagggcacaatgtgtttattcatatggtatccttctttaatactag

SEQ ID NO: 1322 - DNA, 2347 bp, Amorphophallus konjac
cctacagagtatacggcctgcagtcccctagatctgaagtaccccatttcgtctctctattctctttctctctctctctttgtcacttcagttcttacaatctttcatggtcgatcggtagaaaccaggcgtgcagagtgatttcagtagccaaagtttcatttggggcttggatctgcaggaaaggaggggtcttttgatggcggaaggaatgggggccgtcgttgtcgtgttgggtctcttgttgttctgtggttcgagagttgaggcggatggatcggatcacaagtatcacgaacgggatcacgtccctctttatgcgaacaaagtgggtcctttccacaaccccagtgagacatatcggtactatgatctgccattctgcgctccagatcatgtgactgataagaaagaagctctaggtgaagttctaaatggggatcgtctggtggatgctccatataagttgaactttagggaagacaagcaatctaaaactatctgtaggaaaacattgtcaaaggaggatgttgcgaagcttagagatgcagtttcaaaagactattacttccagatgtattatgatgacttgcccttttggggattcttggggaaggttgataaggatgacaagcttgatcccagtgaccacaaatacttgctttttaaacatatccactttgatatcctttataatgatgatcgtgtcatagagataaatgtacagactgatccaaatttggctgtggatatcacggaggaaaaggaggttgatgtggacttttcttattcggttgcatggaaatcaactgagattccttttgagaagaggatggaaaagtattcaaaggcttcttctttgccccagcacctggagatccattggttctccattattaactcttgtgtaacagtactcctcctgactgggttccttgctaccattcttatgcgtgtcctcaagaatgatttcacaaagtactcacatgatgaggactccgctgaagaccaagaggagactggatggaagtatattcatggagatgtcttcagattccccgatcacaagtctctattttctgctgttcttggttcaggaacccagctcctagctctttctatatttatcttcctccttgcactggttggggtgttctatccatacaacagaggagctttattcacagctcttgttgtgatatatgctcttacatctggaattgcgggctacactgcaacctccatgtatttacagttagaaggaaccaactgggtcaggaatttgttgtggacagggtgcttattctgtggtcctttattcttgacattctgtttcctgaatacagttgccattgcatatagtgctacagcagcattaccatttggtaccatccttgttattatccttatatgggctttggtaacttcaccattgttggtattaggtggtgttgccggtaagaggagtaacaccgaatttcaagctccatgccgcaccaccaagtatcctagagaaattcctgctcttccatggtacaggggaactattccacagatggcaatggcaggatttcttcctttcagtgctatctatattgaactctactacatttttgcaagtgtgtggggtcacaaaatttacaccatatatagcatccttttcattgtgttcattattctcattattgtcacggcattcatcactgtggcattgacatacttccagcttgctgttgaggaccaccagtggtggtggagatctgttctttgtggaggctccactggcatattcatcttcctctactgtttctactattaccacgccagatcagatatgtcgggctttatgcaaacatcattcttcttcggctacatggcttgcatctgctatggcttcttcctcatgctggggactgttggtttccgtgcatcccttctgttcgtgcggcacatctaccggtccatcaagtgcgagtagctgcaatctgggctaccagccaaggatttccttctccagtctcagctcctggtcttaagaagcctgcggtagtggcagtaacaattagtggtagtagtgtagcactggccatttgccaaaattattcttcagctcagttccacggttccagattcttctcataggaagactgcagattttcaccaccaccattctaagatcatattctctcggtactgttacgcattgcctaaatgcaggccaacgtctatctatagattagataagaaggatgcctatcaatctcttgtaaaactgttaaacataaaacttggtagtagcttctgcagatcacatgcaacatcatattctggaattcttaagcagagg

SEQ ID NO: 1323 - DNA, 1975 bp, Vinca minor
agatcagatgcgtgggatcacaaatacaaacctggagatcaggttcctctttatgctaacaaggtcggacctttccacaatcctagtgaaacctaccactattttgatctcccattctgttctccagctcatgtcaaagagaagagggaagctctaggtgaaattctgaatggtgaccgcttagttgttgctccatataagctagagtttttatctgataaggacgcagaaattgtttgcaagaagaaattgtccaaggaagagtttgctcaatttcaaagtgctgtctccaaggactactactttcagatgtactatgatgacttgcctctatggggtttcttaggaaaggttgacaaggaagggagagctgatcccagtgaatataaatattatctatttaagcatctccactttgaaatcttttacaacaaggaccgtgttattgagattaatgcacgaactgatcctaatgcattggtggatattaccaaggaaaaggaagttgatgttgatttcatgtactctgtcaaatggaaggagacttccacggcttttgaaaagaggatggagaagtattcacagtcttcttctctgccacatcaccttgaaatccattggttctcaattatcaattcctgtgttacggtccttctcttaactggttttctggcaacaattttgatgagagtccttaaaaatgatctcttcaagtatgctcatgacgaggatgcagcagatgatcaagaagaaaccggatggaagtatattcacggtgatgttttcaggtacccaaagtacaaatctttacttgctgctgctcttggatctggttctcagctattcacaatgacaatatgtatatttatacttgcacttgttggtgttttttatccttacaaccgaggagctctcttcactgttttggttatcatatatgcacttacatctggagttgctggctatattgcatcctctttctattgtcagctagagggaacaaattgggtgagaaacgtgttattgactggaggactgttctgcggaccactatttttaaccttttgctttttgaacactgttgctattgcttacactgctactgcagctctacccttcggtaccattgtggtcatctttctcatatgggcacttattacttcatctttgctagtcatgggcggtattgcaggaaagaatagcaaggctgaatttcaagctccatgtcgtacgactaagtatccgagggaaatcccaccattaccttggtatcgtggaacgcttcctcagatggcaatagctggtttcttgcctttcagtgccatttatattgaactgtactatatctttgctagtgtgtggggtcataggatttataccatctacagcatcctattcactgtcttcacatatttccagcttgctgctgaagaccatgaatggtggtggaggtctttcctttgtggtggatcgactgggttgttcatctatggttactgcttgtattactattatgcaagatcatatatgtcgggcttcatgcaaacatccttcttcttcggatacatggcatgcatatgctatgcctttttccttatgctcggaacagttggtttccgtgcagcattgttctttgtccgacatatataccgctcaatcaagtgtgagtaagaagttggacgacaaatcatcctttgtttggtaggcatgtcttctttgtagaaagcttgtgttttagtaaagtgagaaatgttgttcaagcactaattgcgagctgctggggactgaaagccgttgtatctggaatttgtgaaaggataagattttacgtgtcgagtgttgctgcatggtgcataattttgaagctagggtgagagaccctgtcgttacgaacgtgagacaggaatatacctcttaggcaccatgccaaattgagtcaaagggatgagggcggggcggggcatattatgaggaa

SEQ ID NO: 1324 - DNA, 2416 bp, Abies balsamea
tctatggatttgtctaattacacggcaaagtggtagcctcagtacagtctgatatgggagcgggagaaggagaagcagaaacatcatttacgctggactgaaccagggtttctaggccaagggattctggtaaaaccccgaggagctgtggaagcaaattcaatggcaatgacgaggtttctggtgctggcattgtcgttagtttttgtgtttgcatatggagtggaggggagcgcttctaatcacaaatacagtaagggagatcatgtcccactttatgccaacaaagttgggccatttcacaaccccagtgaaacgtaccggtattttgatttgccattctgtccgccagataaggtgactgagaagagggaagatcttggagaggtgttgaatggtgaccgaatggttgatgctcgatataagcttaatttccaggaaaacaaaaattctgaagttctttgcaagaagaaattgacaaaggaggatttggaaaagtttagagaagcagttaagaaggattattactttcaaatgtattacgatgacttgcctatctggggctttataggaaaagctgataaagaaaatagtgcagatccgtttttactgtacaaacatctccactttgaaatcatgtacaacaatgatcgtgtcatagaaattagtgttcgtactgatccgagtttttctgtcgacattactgaggacaaggagattgaagttgatttcacttactcagttaagtgggtggagactcaaattccatttgaacgacgaatggataaatattcaaagtcttcatcgttgccccagcatttggaaatccattggttctccattataaattcttgtgtaacggttcttcttctgactggatttcttgccacgattctcatgcgtgttctaaagaatgatttcattaaatattctcatgacgaggaatctaatgatgaccaagaggagacaggatggaagtacattcatggagacgtcttcagatatcctccacacaaatctttgttttgtgctgttcttgggtctgggacacagctttttacccttgccatctttatcttcatgcttgcgctagtgggtgttttctacccatacaataggggagctctatacacagcccttgtggttatatatgcccttacatctggcattgcaggttacactgcagcctccttctatcgtcagcttgaaggatcaaactgggtgcggaatttgttgatgaccggctgcctattttgtgggcccctattcctaaccttctgcttccttaatacagttgccattgcttacaatgctactgcagcattaccatttggcaccattgttgtcattcttctcatctggacacttgtcacctctcctttgcttgtgttgggtggtattgctggtaagaatagcaaggctgagtttcaggctccttgccgcaccacaaagtatcccagggaaattccgcctttgccttggtacagaggaacaattcctcagatggctatggcgggctttttgccattcagtgcaatatacatcgaactgtactatatttttgcaagcgtgtggggtcacaaaatttacacaatatacagcatcctcttcattgttttcattattcttattattgtgacagcattcataaccattgcattgacctacttccagctggcggttgaggatcacgagtggtggtggaggtctgtgttatgtgggggatcaactggtgtattcatctttgggtactgcttatattattattttgcacgatcagatatgaatggtttcatgcaaacctcctttttctttgggtatatggcttgcatatgctatggatttttcttaatgcttggaacagtgggcttccgtgcatctttactgtttgtccgtcatatttaccgctcaattaagtgcgagtaattctattcctaggcatatgaacaactagggttcatctgacattgttgggaggggcagttgcaaattgtaatggctttattttcttttttcaagatagtgggttatgactggaggatacatgaactcgatgatcacaaagaagaaaatgaaaggaaacttcaatcgagaatcatgtagtcttttgtcttaatttgttaggtttccaataccgtagtgtcaatggaccgattatcaaggttgttgcagaagggtaaaacattaaaagctcaaaagaaggttattaatgtatactggcctagtagcagttattgttcactttgttagattggccaaatttatgcctaaaggatagtgaggtttcagataaatctttgccaagcctcaggcaatttcacatgttaggttgcaatactatgtatcatgctgacttgtatctgttttcaaaaagtgcaaaaaggcacaacgagcttataaatatgcaacattttct

SEQ ID NO: 1325 - DNA, 2371 bp, Sequoia sempervirens
aatttagacacattgggagctatatcagggttttgttccaagcccaggcagggtttctttcctttaacataggaaaataatggcagggagtctgaatatatcgactgccattttagcactggtattggcgtttgtatgcggagttaatggcggcgcgtcagatcacaaatacagcaagggagagcatgttccgctttatgccaacaaagtcggtccctttagtaatcccagtgaaacatatcgatattttgatttgcctttctgcctaccagataaagtcaatgagaagagggaagatcttggagaggtcttgaatggtgataggatggttgatgctcgatacaagcttgattttcaggaaaacaaagattctgaactactttgcagtaagaaactgacaaaagaggatttagaaaagtttagggaagctatcaaaaaggattattattttcagatgtactacgatgatctacccatctggggcttcattggaaagtttgagaaagaaagcaaggcagttccaaatggtgccagatatttactatataaacatatccactttgaaattttctacaacaatgaccgagtcatagaaataaatgttcgcacagatccaagttttacagttgacattactgaggacaaggaagttgaagttgatttcatgtactcagtgaagtgggtggagactaaggttccttttgaacggcgaatggataaatatgcaaagcaatcttctttgccacagcatttggaaattcactggttctccattatcaattcttgtgtaacagttcttcttctgactggattccttgccactattcttatgcgggttctcaagaatgacttcatcaagtattctcatgatgaggagtctactgatgaccaagaggagacaggttggaagtacattcatggggatgtcttcagatatcctcgacacaagtctctgttttgtgctgttcttggatctgggactcagctctttgctcttgccatcttcatcttcatgcttgcactggtaggtgttttttatccgtacaacaggggagccctatacacagcccttgtggttatatatgcccttacatctggcattgcaggctacactgccgcttctttctatcatcaacttgaaggatcaaactgggtgaggaatctgttgttgactggctgcctattttgtgggcctctgttcctaaccttttgcttcctgaatacagttgctatagcttacaatgcaactgcagctctaccatttggcacaatcatggttattctccttatctggacacttgtgacatctcctctacttgttttaggtggtattgccggtaaaaacagcaaggccgagtttcaagctccttgccgcaccacaaagtaccccagagaaattccccctctgccattttacagagggaccatctctcaaatggccatggcaggatttttgccatttagtgcaatctacattgagctatactatatatttgcaagtgtatggggtcacaaaatttacacaatatacagcatcctcttcattgttttcatcatccttatcattgtgacagccttcattaccattgcattgacctacttccagctagcagttgaggatcatgagtggtggtggaggtctgtgttatgtggaggatcgactggtgtctttatctttgggtactgcttatattattattttgcacgatcagatatgactggattcatgcaaacctcctttttctttggttatatggcttgcatatgctatgggtttttcttgatgcttggaacagtgggattccgtgcctctttactgtttgtccgccacatatatcgttcaataaagtgtgaataatttcacttggcatgggacatggtggcgctttctggttcatccaatattgttgggtggtgcagttgcaaactgtaatggccattggttttgttccaggctggtgggttttgattcagtattgtatggtcagaactcgttgtcatgaaaaggaatatggaatacactttgacctagattaacagttttttaatcgtacttagatttctaaaactttagtggtaatgtaccaactatttttaaagaggttgctgaagagtaataaaattgcgatctaggaaggaggtcgttaaatattctcatctagaagcaggtatggttggaagtggccaaatcttttcctcaattgaccgaaggcttagatatatcaacactatgcaagcctcagggaatttgatttcttattgtttagtacaatactaacttatatattgtttcggagactggaaaataacacggtgaactatttcccttgtcatcctttgtgcattttatgataaaacaataacatgttaa

SEQ ID NO: 1326 - DNA, 5090 bp, Brachypodium distachyon
atggctttcccgtcttccatttcatacatctcctccgtcgtcgccgttgtcgttctcgtagcagcgaccacggcggtcgcccagacgcgcacctcctccttccctgccgttgacgacgtcaccggtaatgccacggtagcggccgccaacggaactaccgtaaagacaggctgccctgccgccgccgcggtatcgtcggcggcggcagccaacaacgactactactcgaaccggtacatctgctacctctgctaccaacgcaacaccatgatgatcaaatggtgcccgctctacaaggaccactgccacgtcgcctgcctatcatccccgtactcgtctcgccgcgcgctgcagccccccggccccgatggacgcgcgctgcaggtgcccggcagccggctccccgggcccgaagactgctacgtcatgaagctgtacccggatggcagctggatcatcgttgacgtggtcaactgctatgccgtcgcgggctgccagctcgtgtgcggttacgccgatgccatccccgcacgtaaggacgtcgacggtggagccaacaccaccggccgccgcctgccgccgccccgcttcgaatgttgggtacaaaatccggtttccctccctcctcccccgcagccgctgccgcagaaccgaaccccaagcggaggagagaaggcgaggcggaggcagacatgagggaggaggcggtggagcggctgcgcggggtggtgcgggacagcgtcgggaagcacctctacacgtccgccatcttcctcgccgacaaggtggccgcggccacgggcgaccccgccgacgtgtacatgctcgcgcaggcgctcttcctcggccgccacttccgccgcgcgctccacgtgctcaacaactcccgcctcctccgcgacctacggttccggtacctcgccgccaagtgccttgaggagttgaaagaatggcatcagtgtttgatcatgcttggggatgccaaagttgatgagcacggtaatgttgttgatcaagatgatggcagtgacatctattttgataaggatgccgaagatcacgagatcaatataaagtcagctatttgtttcctacgtggcaaggcgtacgaagcattgcataatcgggatcttgcccggcaatggtacaaggcagcagttaaagttgatccgttgtgttatgaggccctcgaatgccttgttgataattacatgttaacatgtgaggaagaatctgagttgttgtcctctctgaaatttgggaaagaagatgggtggctatcagcattctactcatgtttgattaggaagcacgaaaaagaatatgtagtggaagcaaaattcaaggaacttgaacgagaatcttgcagcatatcttcttcaagttctggccaaatgatgaaaaacaacattgatgttttggcttgcaaagctgaatactaccatcagagtggagaataccaaaaatgttttgagctcacatctgtgttacttgagagagatccttttcatttgaaatgcacgttagtgcatttggctgctacaatggagcttggtcattccaatgatctttatcttttgtcatgcaatttagtgaaggactatcctcaaaaagctctttcctggtttgctgtcggctgctattattactgtattatgaagtatgatcaagcgaggagatactttggcaaagccacagggttagaagggacatttcctcctgcttggattggtactggtattgcttatgctgctcaagaggaaggtgaccaggccatggctgcatttaggacagcagctcgactatttcctggatgtcatctcccaactttatacatgggtatgcaatatgtgcgaatgcataatttcaaacttgcagagcagttcttcatgcaagcgaaatccatctgcccatctgatccacttatatttaatgagttgggggttgtagcttataatatgaaagagtatcaaaatgcagttcagtggtttgagttaacactggatcatacctcatcctccctgaatgaaatgtgggaaccaacattggtgaatcttggacacgcactgcggaaactgaagaaatatgaaaaggcaatatcatattatgaaaaagcgctcacctttccaataaaaagtctgagtgcgttttctggtcttgcctattgttaccagcttatggataattttgaggccgctataacttactaccacaagcgggcaactttggtgtggattgggcggatcgcaactgatttagtgcactctggatcttctcgtagggttctagcatcctgtttttctcctcgaaaatgtcggtttgtattggtttgggcgcgaactcttgatgtaatcggatctgttcctaaagcaccttttttttatcttcctagacgatattctcatgccatgctccttttacttgcagtgagacgtatcggtacttcgacctccctttctgctctcccgaaaaagtgaaggagaagagtgaagcccttggggaagtcctcaatggggatcgtttggttgatgcaccgtacaagcttgatttccgtgtggatcttgactccaagccggtttgctcaaagaagctcaccaaggaggatgttgcaaagttccggaactcagtagctaaggactactacttccagatgtattatgatgatcttccactgtggggtttcattggtaagctggaaaagacagccaaggccgacccgagtgagtggaagtattacctatacaggcacattatctttgacatcctctacaacaatgaccgggtgattgagatcactgtgcatactgaccagagtgcactggtcgacctgacggaggataaggaggctaatgtggagttcctttacactgtcaagtggaaggagacagcaacaccatttgagaagaggatggagaagtactccagttcctccaacctcccgcatcacctggaggttcattggttctcgattatcaactcttgtgttacggttcttctcctgacagggttcttggcgacaatcctcatgcgagtactgaagaatgattttgttaagtatgcccatgatgaagaagcagctgatgaccaagaagagtctggatggaagtatatccacggtgatgtcttccggttccccaagaacaagtcattgttttcggctgctcttggcactggaactcagctgtttgctctaacaacctttatattcttgcttgcacttgttggagtattctacccttacaaccgtggcgcacttttcaccgcattagtcgttatctatgcactcacttcaggaattgctgggtacattgctacctctttctattgccagctagagggaacaaactgggtgaggaacttgctattaacaggatgcctgttctgcggacctctattcctgacattctgtttcttgaacacggttgctattgcttatagtgcaacggcagcattgccattcggcactatctgtgtcattgtcctcatctggaccttagttacatttcctcttctagttttgggaggcattgctgggaaaaacagcaaaagtgaattccaagccccttgccgtaccaccaaatacccgagggagatacctccacttccctggtaccggacaacagttccacagatggctatggctggatttttgcctttcagtgctatatatatcgagctgtactacatctttgctagtgtgtggggccaccgaatttacaccatttacagcattctcttcatagtcttcatcatcctccttatcgtcactgccttcattactgttgcactgacatactttcaacttgctgctgaagaccatgagtggtggtggaggtcattcctatgcggaggatcaactggattttttgtttatggctattgtctgtactactactatgcgcgatcagatatgtctggcttcatgcagacatctttcttctttgggtacatggcctgcatctgctatgcattcttcctgatgctgggcatggttggtttccgtgctgccttgttcttcgttcggcacatatacaagtccatcaagggcccaagccggagcccgtccggcgcgccgtgctccgcgccatcgagctcgggtatcgccacttcgacaccgccgcgcactacgagaccgaggcgcccatcggcgacgccgctgccgacgccgtgctgtcgggcgccgtcgcatccagggccgacctcttcatcacctccaagctctggtgcagcgacgcgcaccgcgacagggtcctccccgccctcaagcagactctccgaaacttgaaaatggagtacgtggacctgtaccttgtccactggccggtgtccatgaggccagggcggttcaaggcccccttcacggcggaggacttcgtgccattcgacatgcaggccgtgtgggaggccatggaggagtgccaccgcctgggcctcgccaaggccatcggcgtctgcaatttctcctgcaagaagctcgacaccctactctccttcgccaccatccctcccgttgtcaatcaggttgaagtgaaccctgtgtggcagcagaggaagctaagggagttctgcagggggaagggcatccagctctgcgcatactcgccactgggcgccaagggcacgcactgggggagcgactccgtgatgggcgccgacgcgctgcacgagatcgccgcgtccaggggcaagacggtggcgcaggtgtgcctgaggtgggtgtacgagcaaggggactgcatgatcgtcaagagcttcgacgaggcccggatgcgggagaacctcgacgtcgaaggctgggagctcacggaggaagagcaccggcggatcgccgacatcccgcagcggaagatcaaccaggggctgcgctacgtgtccgagcacgggccctacaagtcgcttgaggagctctgggacggcgagatatgaccgtgctctctctctaccgtgttctgtgagacgtactcttggcagggatggctgatcctggctagaagcccggaacggttttacaccgatctcccttggaataaactgttgtctgcgttgtgtttcaaatgaataaaaaggttgctgaccatttcatggcatca

SEQ ID NO: 1327 - DNA, 1183 bp, Cicer arietinum
cttccttgtggtcttctctctttcttccaaatcccaataaaactaaccgtttccctacattctctcccgccaaccgtaaactctcaaccgcattcgccatccccccgctctcaaccgcaacagccgccgacgtttccggcgcaatagacggcaccacaatcgccgtagtaagcggaggtttcgtagccggcctcaccgcacttctctctctaacagaccccgagaaacggcggcgtgaacaggcggaggaagttggcggcggcgacaaagaagttgtgaaggaatatttcaacaactccgggttccaacggtggaaaaagatatacggtgatactgatgatgttaatagagttcaacgagatattaggttaggtcattctaagactgttgagaatgctttacagatgctgaaagatgaaggctcgctcaagggtgttaccgtttgtgacgccggttgcggtactggttcactttctattcctttagccaaggaaggtgccattgtatgtgctagtgacatatctgctgccatggtcgctgaagctgagaaacaggcgaaagaacaactcgtgtctagtgagaatggggtgtcatctttgatgccaaagtttgtggtgagtgatttagagagtttggatggaaagtacgatacagtggtgtgccttgatgttttgattcattaccctcaaaataaggcagatgggatgattgctcaccttacttctttggcggaaaagcgattgattctgagctttgcacctaagacattttattatgatgcgctgaagagggttggtgagttgttccctgggccttccaaggcaaccagggcatatcttcactccgagggagatattgaaagggcactgcgtaaggttgggtggactataaagaagagaggcttaaccactactcaattttacttttccaggcttatcgaggctgttcctatgtagcgaggccagaggcttcagaggtaagttttgcatcattaaaggaaattccttcgacatggatcgaatacgtaataattgacagaacactgacataatttgatcccatgtagccaaccctatttagaggaaattccgtatgtatattgtaagccattttttgttgtgcttttgtatgttatgtcatcctatgatttgctggatatgtatattttatttcttctcagtgt

SEQ ID NO: 1328 - DNA, 1416 bp, Cajanus cajan
aaggcatggaaagtggaatgctatcttatccaggataacatttcaattttcaagcactaagcttcttcacactcgaggctagcaccgccgggtaacgtcacaatggccttttcatcttccttatggtcttccctcttcgttcccaacccaaaccaaaccaacattctccctcgcttctctcccaaaccctccaagctcccgctcccgcccgcattcgccatccccccgctctccaccgccgccgcagccgacgtctccggcgccatcgacgggaccaccatcgcggtgctgagcggggggttcgtggcggcggtggcggcggcggtgtcgctgacggacccggagaggcggcggcagatgcaggcggaggaggtgggcgggggcgacaaggaggtggtgcgggagtacttcaacaactccgggttccagcggtggaagaagatttacggcgacaccgacgaggtgaaccgggttcagcgcgacattagggtgggccacgccaagaccgtggagaacacgctcttgatgctcaaggacgaggggtcgcttcagggtgtcacggtttgcgacgctggctgcggcacgggttcgctctctattccccttgccaaagagggcgctgttgtttacgccagtgatatctccgccgctatggtcgccgaagctgagaaacaggcaaaagaacaacttgtgggaagtgagaatggatctgcgcctgtgataccaaagtttgtagtgaaggatttggagagcttggatggcaagtatgacactgtggtctgccttgacgttttgattcattacccccaaagcaaagcagatgggatgattgcccaccttgcatcactggccaacaaccgattgattctgagttttgccccaaagacattttattatgatctcctaaagagggttggagagttgttccctgggccttcaaaggcaacaagggcatatcttcactccgaggcagatgtagagagagcattgcgaaaggttggatggaccataaggaagagaggcttaatcactactcaattttactttgctaagcttgttgaggccgttcctatgtaatgaggacttaaaaggtaagctttgtataattagaggaaattcttagtgtaaattgtaaggccttctttttcgtgattttgtatgcaattattctccgcatgtaattctattatgtatatttattcgtagtttagaagatactgatgaattgaggtatgtttttgggggagatagagtggggtggtgggttaccagtgcattggatgagcttcctacatattgaagttacaactgagggagagcagttagttcctgtatggcattttttgtaataataatagcacaatctggtttctagaatgtaacacaattaactaatatattgaagataaatttaag

SEQ ID NO: 1329 - DNA, 1504 bp, Lotus japonicus
caagtcatctttgaaaagtaggacccacaaaaatcagagaaaagcatggaagctgaaggctatcttatcctggataacatttctacttccactccacactcccaccggccggtgacacaaaccggaaccaaaaaaaaaccaaaatggcgttctcaccgtcgttaggatcttccctcttcgctccaaatcctaacagaaccaaccgtttccctagattctctccctctcccgccaatcccaaactcccactctcaaccgcattcgccattcccccactctcaaccgcaaccgccgccgacgtcaccggcgcaatcgacgggaccacactcgctgtagtcagcggaggcttcgtcgccggccttgccgctctcctctccctgacagaccccgagagacggcggcagacccaggccgaggaggtcggcggcggcgacaaggaagtggtgagggagtatttcaacaacaacggcttccagcgctggaagaagatctacggtgacactgacgatgtcaacagggttcaacgagacatcagagtgggccacgccaaaacggttgagaacgttcttcaaatgttgaaagatgaaggctctctgaacggagttactgtctgtgacgctggttgtggcaccggttctctgtctattcccctcgccaaggagggagctgttgttcttgccagtgatatctccgctgctatggtctctgaggctgagaaaaaggcgaaagatgaacttgtagggagtgcgaatggggcagtgatgccaaagtttgtggtgaaggacttagagagcttggatggcaagtatgacacggtggtatgtctggatgttttgattcattacccgcaaagtaacgcagatgggatgattgggcaccttgcatcgttggcggagaaccgattgattctgagctttgccccgaagacgttttattatgatctgctgaagaggattggagagttgttccctggaccttcaaaggcaacaagggcatatcttcactctgagggagatgtggagagggcattgcaaaaggttgggtggaagataaggaagagaggcttaatcgctactcaattttactttgctaagcttgttgaggctgttcctatgtagtgcagaaagattagaggaaggataaaaatcttccctcccaaaattgtgtctcatttgtctgtcccaccaacaagattttgccatatatcaactaaaaagtattcatgtatgtttgtaatcatctcacctatgtcttcttcagtggcatgcaaatacaggtaagaagggaaatggaacagaaaaatagagacagaaaattttcatccattagaggaagttcctaatgtaaattgtcaggcatatttttgtgtgcttttgcatgctctcctatggttcattgcaaataattatatcattatgtatatttcttcttagtgtagaagatgctgatgtattattttcttaatttcaaattgaaattcaagtttgaaactgaagaatgttga

SEQ ID NO: 1330 - DNA, 1309 bp, Vigna unguiculata
tccttcatgctccacgctgtcaccgcccggtaacctcacacaaacccaaaatggcgttctcgtcgtcgctatggtcttccctcattgttccaaaccctaacagaaccaccatttcccctcgattctctcacaaaccgcacaaactgccgctgtcgccggcatttgccatcccgccgctctcgacggcaaccgcggccgatgtcgcgggtgctatcgacgggaccacagtggcggtggtgagcggggggttcgtggcggcactggcggcggtgctgtcgctgacggaccccgagcggcggcggcagatgcaggcggaggaggtggggggaggagacaaggaggtggtgagggagtacttcaacaactccgggttccagcggtggaagaaaatctacggcgacacggacgaggtgaaccgggttcagcgcgacattcggttgggacactcgaagaccgtagagagcacgctgaacatgttgaaggacgaagggtcgcttcagggcgtcacggtttgcgacgccggttgtgggaccggttcgctctcaattcctctcgcgaaagagggtgctgtcgtgtacgccagtgatatctccgcagctatggttgctgaagctgagcaacaggcaaaagaacaacttgtagccagtgagaatggatccgcccctgtgttgccaaagtttgtagtgaaggatttagagagtttggatgggaagtatgacacggtggtctgccttgatgttttgattcactaccctcaaagtaaagctgatgggatgatcggccaccttgcttcactggccaacaaccgattgattctgagttttgctccgaagacgttttattatgatatactaaagaggattggagagttgttccctggtccttcaaaggcaacaagggcatatcttcattccgaagcagatgttgaaagagcattgaaaaaggttggctggaccataaggaagaaaggcttaatcactactcaattttactttgctaggcttattgaggctgttcctatgtagtgggactgaaaggtaagttttgtataattggaggaaaatgtaagccattatatgttgtgattttgtatgctattattctccgcatataattctatcatgtatatttcttcttagtgtagaagatgctgatgaattgaggctatgttgttttctgggggaaaatggagtgaagtggttcactgtaaatttgtgtgcagctggtgagtaattggtccattaggttggtggaatggaggcaagctactcatatgctgtccatacagaagtaataactactatcaccg

SEQ ID NO: 1331 - DNA, 1247 bp, Vigna unguiculata
tccttcatgctccacgctgtcaccgcccggtaacctcacacaaacccaaaatggcgttctcgtcgtcgctatggtcttccctcattgttccaaaccctaacagaaccaccatttcccctcgattctctcacaaaccgcacaaactgccgctgtcgccggcatttgccatcccgccgctctcgacggcaaccgcggccgatgtcgcgggtgctatcgacgggaccacagtggcggtggtgagcggggggttcgtggcggcactggcggcggtgctgtcgctgacggaccccgagcggcggcggcagatgcaggcggaggaggtggggggaggagacaaggaggtggtgagggagtacttcaacaactccgggttccagcggtggaagaaaatctacggcgacacggacgaggtgaaccgggttcagcgcgacattcggttgggacactcgaagaccgtagagagcacgctgaacatgttgaaggacgaagggtcgcttcagggcgtcacggtttgcgacgccggttgtgggaccggttcgctctcaattcctctcgcgaaagagggtgctgtcgtgtacgccagtgatatctccgcagctatggttgctgaagctgagcaacaggcaaaagaacaacttgtagccagtgagaatggatccgcccctgtgttgccaaagtttgtagtgaaggatttagagagtttggatgggaagtatgacacggtggtctgccttgatgttttgattcactaccctcaaagtaaagctgatgggatgatcggccaccttgcttcactggccaacaaccgattgattctgagttttgctccgaagacgttttattatgatatactaaagaggattggagagttgttccctggtccttcaaaggcaacaagggcatatcttcattccgaagcagatgttgaaagagcattgaaaaaggttggctggaccataaggaagaaaggcttaatcactactcaattttactttgctaggcttattgaggctgttcctatgtagtgggactgaaaggtaagttttgtataattggaggaaaatgtaagccattatatgttgtgattttgtatgctattattctccgcatataattctatcatgtatatttcttcttagtgtagaagatgctgatgaattgaggctatgtttagtatattgtatatctcagagataaacccgcagcagaaacaaaacctatggtaaaatataaaaaaaagaaaaaaa

SEQ ID NO: 1332 - DNA, 1336 bp, Phaseolus coccineus
gcatggaaactggaatgctatcttatcctggataacatttcaactacttcctccactcttcagtccttcacgttccacgctgtcaccgcccggtaaccgcacacaaacccaagatggcgttctcgtcgtccctgtggtcttcactcatcgttccaaaccctaacagaaccaccagtctccctcgattttctcacaaaccgcacaaactcccgctatcgccggcatttgccatcccgccgctctcgacggccaccgcggccgatgtctcgggtgctatcgatggtaccacggtcgcggtggtgagcggggggttcgtggcggcgctggcggcggtgctgtcgctgacggaccccgagcggcggcggcagttgcaggcggaggaggtgggcggaggagacaaggaggtggtgagggagtacttcaacaactccgggttccagcggtggaagaaaatctacggtgacacggacgaggtgaaccgtgttcagcgcgacattcggttgggacacgcgaagaccgtggagaacacgctgaacatgttgaaggacgaagggtcgcttcagggcgttacggtttgcgacgctgggtgtgggaccggttcgctatcgattcctctcgcgaaagagggcgctgtcgtgttctccagtgatatatccgctgccatggttgctgaagctgagaaacaggcaaaagaacaacttgtagccgatggaaatggatctgcccctgtgttgccaaagtttgtagtgaaggatttagagagtttggatggaaagtatgacactgtgatctgccttgatgttttgattcattaccctcaaagtaaagctgatgggatgatcggtcaccttgcgtcattggccaacaaccgattgattctgagttttgctccgaagacgttttattatgatatactaaagaggattggagagttgttccctggtccttcaaaggcaacaagggcatatcttcactccgaagcagatgttgaaagagcattgaaaaaggttggctggaccataaggaagaaaggcttaatcactactcaattttactttgctaagcttattgaggctgttcctatgtagtgaggactgaaaggtaagttttgtataattggaggaaagtcttagtataaaatgtaaggcattatatctcgtgattttgtatgttaatattctccgcatataattctatcatgtatatttcttcatagtgtagaagatgctgattaattgaggctatgtttagtatattgtatatctcagagataaatccgtagcagaaacaaaacctatggtaaaatgtattttagatccctcaatatttggttcta

SEQ ID NO: 1333 - DNA, 1297 bp, Phaseolus coccineus
  misc_feature (11)..(11): n is a, c, g, or t
ttcaactactncctccactcttcagtccttcacgttccacgctgtcaccgcccggtaaccgcacacaaacccaagatggcgttctcgtcgtccctgtggtcttcactcatcgttccaaaccctaacagaaccaccagtctccctcgattttctcacaaaccgcacaaactcccgctatcgccggcatttgccatcccgccgctctcgacggccaccgcggccgatgtctcgggtgctatcgatggtaccacggtcgcggtggtgagcggggggttcgtggcggcgctggcggcggtgctgtcgctgacggaccccgagcggcggcggcagttgcaggcggaggaggtgggcggaggagacaaggaggtggtgagggagtacttcaacaactccgggttccagcggtggaagaaaatctacggtgacacggacgaggtgaaccgtgttcagcgcgacattcggttgggacacgcgaagaccgtggagaacacgctgaacatgttgaaggacgaagggtcgcttcagggcgttacggtttgcgacgctgggtgtgggaccggttcgctatcgattcctctcgcgaaagagggcgctgtcgtgttctccagtgatatatccgctgccatggttgctgaagctgagaaacaggcaaaagaacaacttgtagccgatggaaatggatctgcccctgtgttgccaaagtttgtagtgaaggatttagagagtttggatggaaagtatgacactgtgatctgccttgatgttttgattcattaccctcaaagtaaagctgatgggatgatcggtcaccttgcgtcattggccaacaaccgattgattctgagttttgctccgaagacgttttattatgatatactaaagaggattggagagttgttccctggtccttcaaaggcaacaagggcatatcttcactccgaagcagatgttgaaagagcattgaaaaaggttggctggaccataaggaagaaaggcttaatcactactcaattttactttgctaagcttattgaggctgttcctatgtagtgaggactgaaaggtaagttttgtataattggaggaaagtcttagtataaagtgtaaggcattatatctcgtgattttgtatgttaatattctccgcatataattctatcatgtatatttcttcatagtgtagaagatgctgattaattgaggctatgtttagtatattgtatatctcagagataaatccgtagcagaaacaaaacctatggtaaaatgtattttagatccctcaatatttggttct

SEQ ID NO: 1334 - DNA, 1302 bp, Glycine max
gacgctatcaccggccggtaacgtcacacaaacccaaaatcacaatggcgttctcatcgtccctatggtcttccctcttcgttgcaaacccaaacagaaccgccatttccactcgattctctcacaaaccgcccaaactccctctctcgccggcgttcgccatcccgccgctctccacggccactgcggcggacgtctcgggcgccatcgacgggactacgatcgcggtggtgagcggaggattcgtggcggcactggcggcggtgctgtcgctgacggacccggagcggcggcggcagttgcaggcggaggaggtgggcggcggcgacaaggaggtggtgagggagtacttcaacaactccgggttccagcgctggaagaagatctacggcgacaccgacgaggtgaaccgggttcagcgcgacattaggttgggccacgccaagaccgtggagaacacgctgagcatgttgaaggacgaaggttcccttcagggcgttacggtttgcgacgctgggtgcggtaccggttctctctctattcctcttgccaaagagggcgctgttgtgttcgccagtgatatctccgccgctatggttgccgaggctgagaaacaggcaaaagaacagcttgcaaccagtgaagatggatctgtgcccgtgatgcctaagtttgtagtgaaggatttagagagcttggatggcaagtatgatacggtggtctgcctcgatgtcttgattcattacccacaacataaagccgatgggatgattgcacaccttgcatcattggccaacaaccgattgattctgagttttgccccaaagacgttttattatgatctgctaaagagggttggagagttgttccctggtccttcaaaggcaacaagagcatatcttcactctgaggcagatgtagagagagcattgcaaaaggttggctggaccataaggaagagaggcttaaccactacccaattttactttgctaggcttattgaggctgttcctatgtagtggggattgaaagcctagaagatgctgacgaattgaggctatgttttctgggagaaatagagtgaagtggttcatgataatttgtgtggagctagtgcctagtgagttaccggtccattgggttggtggaatggaggcaagctccctttaagctgttcagaagttacagcgattattactcaagggtagtaattagttcctgtattgcattttttttataaaagtgataatgataataataataataataataataatatcacactttttgatactcttttta

SEQ ID NO: 1335 - DNA, 1282 bp, Glycine max
catacaaactcaaaatcacaatggccttctcatcgtccatatggtcttcttccatctttgttcccaacccaaacagaaccaccatttccactcgattctctcacacaccctccaaaccccctctctcgccggcattcgccattccgccgctctccacggccaccgccacggacgtctcgggcgtcatcgacgggacgacgatcgcggtggtcagcggggggttcgtggcggcacttgcggcggtgctgtcgctgacggaccccgagcggcggcggcaaatgcaagcggaggaggtgggcggcggcgacaaggaggtggtgagggagtacttcaacaactccgggttccagcgctggaagaagatctatggagacaccgacgaggtgaaccgggttcagcgcgacattaggttgggtcacgccaagaccgtggagaacacgctgagcatgttgaaggacgaagggtcccttcagggaattacggtttgcgacgctgggtgcggtacgggctcgctctctattcctcttgctaaagagggcgctgttgtgttcgccagtgatatctccgccgctatggttgctgaagcagagaaacaggcaaaagaacagcttgtaaccagtgaagatggttccgggcctgtgatgccaaagtttgtagtgaaggatttggagagcttagatggcaagtatgacacggtggtctgccttgatgttttgattcattacccccaaagtaaagctgatgggatgattgcacaccttgcatcattggccaacaagcgattgattctgagttttgccccaaagacgttttattatgatctgctaaagagggttggagagttgttccctggtccttcaaaggcaacaagggcatatcttcactccgaggcagatgtagagagagcattgcaaaaggttggctggaccataaggaagagaggcttaaccactactcaattttactttgctaggcttattgaggctgttcctatgtagtggggattgaaaggtgagttttgtataattagaggaaattcttagtgtaaattgtaaggccttctattaaatgattttgtatgctattattctcccacatggaccgcatataattctattgtgtatatttcttcgtagcgtagaatatgctgacgaattgaggctatgttttcttggggaaatagactgaagtggttcataataaatttgtgtggagctagtgagttggcggtccattgggttggtggaatggaggcaagctccctataagttgttcagacgtt

SEQ ID NO: 1336 - DNA, 1074 bp, Arachis hypogaea
tcacactgaccggccggttatagaaaccagaatatctaaaacccaaaaaattataaagaaaagagaatatggcgttctcagcgtcgttctggtcttcgctaattcctccaaacagaggatttcgttttgctagagcacctcccgccaatcaaaaaccgacgaccaaacaacatccactcacaactgcatttgccattgacccgctctcgactgcaaccgcggccgaagtaaccggtgcaattgacgggacgacgatcgccgtgatcggcgggggatcggtggctgcgctggcggctgtgctgtcgctttcggaccctgagaggcggcggaaggagcaggcggaggtggttggagggggcgacaaggaggttgtgagggaatacttcaacaacacgggattccagaggtggaagaagatctacggtgacacggaggacgtgaaccgggttcagttggacataaggttggggcactcgaagacggtggagagcacgcttatgatgttgaaggacgaagggttgctggaaggtgtgacggtgtgtgacgccggttgcggcaccggttcccttgcgattccgctggccaaggagggtgccattgtttcagccagcgatatctccgctgctatggttgctgaagctgagaaacaggcaaaagaacaacttggatcaagtgaagatagtgtatcccctgcagctgcgatgccgaaatttgtggtgaaagatttggaaagcttagatggcaagtatgacacggtggtgtgcctggatgttttgattcactatccgcaaaataaggcagacggcatgattgctcaccttgcatcattggccagcaaccggttgattctgagttttgctccaaagacattctattatgatctgctaaagaggattggagagttgttccccggaccttcaaaggcaacaagggcatatcttcattcggaggcagatgtagagagggcattgcaaaaggttggctggaagataaggaagagaggcttaatcaccactcagttttactttgctaagcttgtcgaggctgttcctatgtagtgatccttggaaggtg

SEQ ID NO: 1337 - DNA, 1323 bp, Medicago truncatula
atggctactttgaatgttttctctcaaccattgcaccctacaactatttcatcttctttatgttcttcttcttcttctaattctactttttcatgtcacttttctcttctttcttctcactcatcccccacactgtctaagctctctaatcatgttcacacccacttctctaagtcaggcaatggaagttcatggctgcaaagtagttccaccgctgacagcattgcgcacaagaagggtcctgtatattcagtatttccttcatcacctgcccaagtttcatctgtccaagatctgtatgaatttatttgctcaggacctttgctttacaaaattggtttgacgccagagaaggtggccgagtctatagataagtggttgtcttatgggcggcaactatgtcgactgtttcagcttaatgaattgttcttgacagagcctcaaaaagttaggctttatcattactatataccagtcttcctctggtgtgaaagtgagattgctcagcatcaggccaaattcaaagataaagaagatattcctcctttagtgattggatttagtgcccctcaaggctgtggaaagacgaccctcgtctttgctcttgattaccttttccaaatgattggcaggtatgcttttagctttgaagcaatattgatcgaatttatcttttattttgatgactacataaattttcaggaagtctgccagaataaactaagagaggctaatccaggaaatgcacttcttgagtatcgtggaaatgctggaagccatgatcttcctttttctgttgaaactttgacagctttaaccaaaatgtctagagaaggtaccaagatgaagttaccaagatatgataaatctgcttttggtggaagaggtgatcgtgctgatccttcgacatggcctgaaattgaaggcccccttactgttgtgttgtttgaaggctggatgcttggtttcaagccccttccagttgaagctgtaaaagctgttgatccgcagctagaaattgtaaataaaaacctcaaagcgtattatgatgcgtgggacaaatatatacagtcatggatagtcattaagattaaggacccaagctgtgtctatcagtggcgcttgcaggctgaaattgctatgagggaggcaggcaatcctggaatgtccgatgatgaggtgagagattttgtttctcgctacctgccagcatacaatgcataccttcctactctttactcggagggtccgagtggatcagaccctcaacatctactaaacatcgaaatagatgaaaagaggaaccctatcctaggtgtctag

SEQ ID NO: 1338 - DNA, 1405 bp, Cicer arietinum
ctggtgctccatttccaatttccaatctgtgaagttgtttgtttggccaagaatacgtggcggctaagcttcgttgctaatttttgtgttgcaaattagagaaaaatggcgactttgaatgtgttctctcagacactgcaccctacaatttcatctttttgctgtttttctaattctaacaattctaaatttcatttcttttccaattccctttcctcccacttctcaaagtcaggcagtggaagttcatggatgcaaagtagctcccctgcagccagcattgagcacaagaagggtcctgtatattcagtatttccttcaacacctgcccaagtttcctctgtgcaagacctgtttgaatttatttgctcaggacctttggttgaaaaaattggtttgacgcaagagaaggtggccgagtctatagataagtggttatcgtatgggcggcaactatgcagactatttcagcttaatgaattgtttttgacagagcctcaaaaagttaggctttatcattactatataccagtcttcctctggtgtgaaagtgagattgttcagcatcagtccaaattcaaagatgaagaagatatacctccattagtgattggatttagtgctcctcaaggctgtggaaagacaacccttgtctttgctcttgactaccttttccaaatgattggcaggaagtcagcaacaatatcgatagatgatttttatttgacggctgaaggtcagaataaactaagggaagctaatcaaggaaatgcacttcttgagtttcgtggaaatgcaggaagccatgatcttgctttttctgttgaaactctgacagccttaaccaaaatgtccaaagaaggtaccaagatgaagttaccaagatatgataaatctgcatttggtgggagaggtgatcgggctgatccatcgacatggcctgaaattgaagggcccctaacagttgtgttgtttgaaggctggatgcttggtttcaaaccccttccagttgatgctgtaacgtccgttgatccccagctagaaacagtaaataaaagccttgaagcttattatgatgcatgggacaaatatatagattcatggatagtcattaagattaaggacccaaattgcgtctttcagtggcgcttgcaggctgagattgcaatgagggaagcaggcaatcctggaatgtctgatgatgaggtgagagattttgtttctcgctacctgccagcatacaatgcataccttcctacactttattcgcagggtccgaatggatcagatcctcaacatctactatccatcgaaatagacgaaaagagaaacccaatcctaggtgtctagtttaactagatgataggatattgctggctcttccattctttgagagaatctgaat

SEQ ID NO: 1339 - DNA, 956 bp, Medicago truncatula
aagcagtggtatcaacgcagagtcgccattacggccgggattcttagcgagagtgtgagagaaaagagaaaatggttccaaaaatgttgaagttctctcgcatgcttcattcatcttccaggaatcatctattggaagttctttacgctagggatttctctactgccacaaataacaactattctgctaaagggtatacttcagatcgtatctttgctccttattctgtttacaagggcaaagctgcgttctcactcagtccttgtcttcctacttttactaagttggattctggggctcttgtggttgatcgtcacggttccataatgatgagtttcatgcctgctattggcgagcgcaaatatgactgggagaagagacaaatatttgccctatcagctactgaagtcggttctttgatagccattggtccccaagattcatgtgaattctttcatgacccctcaatgaaatcaagtaatgctggtcaagtaaggaaaagtttgtcaattaagcctcatagcaatggctactttgtctctctgtctgttgttaactccgtgttaaataccaaagacaattttagtgttcctgttacaactgctgagtttgctgtgatgaagacagcttgcagttttgcattgccacacattatgggttgggatcgtctaactaatcagcagtccagtgggacagtcagctttcaaccaaagatgaactcacaaattttagacttggagtgggaaaagtgagttactgttgggaaatatgaaatggatccttctttgtgctgtcaattccattttgtgtattatcaatccaaagactaggattgtttgtggaagataacctgtaaattgtaatacttaagaaagaagcatgggaaggatgaattatgaaatgtctgacgttgtttcagaattagtcgtgttattattttgatgtttccttgttta

SEQ ID NO: 1340 - DNA, 1062 bp, Trigonella foenum-graecum
cggccgggggacacggtgtgtggaagaagatttgaaggtgaaaaaacaaataacattcttttgctgaggcttggaccggaactgggcctgcttatgaagtttctagtttattaaaaacgacgcctcagcattttgaacactactaacaaacacataaaccctttccctattattgagagaaaagagaagaaaattgttcgaaaaatgttgaagttctctcgcatacttccttcatcttccagttccaggaatcagctattggaagttctttccgctagggatttctctacttccacgaataacaactactctgctgctaaaggttatacttcagatcgtatatttgctccttattctgtttacaagggcaaagctgcattctcactcagtccttgtcttcctactttcactaaactccattctggatctctcgtggttgatcgtcgcggttccataatgatgagtttcgtgcctgctattggggaccgcaaatatgactgggagaagagacaaagatttgccctatcagctactgaagtcggttctttgatagccattggcccccaagattcatgtgaattctttcatgacccctcaatgaaatcaagtaatgctggtcaagtaaggaagagtttgtcaattaagcctcatagcaatggctactttgtctctctgactgttgttaacaccgtgttaaataccaaagacaatttaagtgttcctgttacaactgctgagtttgctgtgatgaagacagcttgcagttttgcgttgccacacattatgggttgggatcgtctaactaatcagcagtccagtgggacagtcagctttcaaccgaagataaactcgcaaagtttagacttggagtgggaaaagtgaatcactgttgggaaatatgtaacgaatccttctttgcgttggcaatttcattttgtgtattatcaatccaaggactaggatggtttggggaagataacttgtaaattgtaatatttaagaaagaatcatgagaattatgaattgtctgacattatttcgcaattagtcatgtttttgtta

SEQ ID NO: 1341 - DNA, 1091 bp, Cicer arietinum
gctatctcgcgcgcttcgttcatattccaggcatcaactattggaagtggtgtcgtctacgaaagttgaagttgcgggattctctactgcaacaaataactattctgctaaaggatataataataattataatagttcagatcgtatttttgctccttattctgtttacaagggaaaagctgcattctcactcagtccttgtcttccaactttcactaagttggattctggggctcttgtggttgagcgtcgcggttccataatgatgagtttcatgcatgctattggggagcacaaatatgactgggagaagagacaaagatttgctctatcagctactgaagttggttctttgatagccattggtcctcaagattcatgtgaattctttcatgacccctcaatgaaatcaagtaatgctggccaagtaaggaagaacttatcaattaagcctcatagcaatggctactttgtctctctgaatgttgttaacatcgttttaaataccaaagacagtttcagtgttcctgttacaactgccgagtttgctgtgatgaagacagcttgcagttttgcattgccacacattatgggttgggatcgtctaactaatcagcaaatgcagtccaatgggacagttggctttcaatcgaagacaaacccacaaattttagacttggaatgggacaagtgaattactgttgggaaacattaaatgaatccttctttgtgctgcagttccattttggttattatcaatccaaatactaggattgctatgggaagataacttgtaaattgtaatatttaagcaagagatatgagaaggacgattgattaaatatcgatgctgttttgcaattagttgtgttattgatattttgttgatgtttcttgtcttctcttttgtttcttttgtttactttaggctgttagaagttagaacatagtcaatcccatgttcatggcaatgtatattctggaaggcagtttaatggttagttgtgttaatgattatttctgtccattctacttgagtagtgataattttctgtcacgctctgaataaatagtatgcagcatgtggatga

SEQ ID NO: 1342 - DNA, 1203 bp, Cicer arietinum
gtccccctccaataaaacaacacactattcatatttatctcaaatctcaatccccaaaaaaacacacactatttcaaactaaatatttaattaaaaatatgtcaggcgccgttcagaaaacgccgtacaatatcagtagggcatacgtcattcttatcacccgtttcaccccacacgtctcatcacccggcggctctcccaataggtcccaccactttctttctccatcaaatcacaaccgtccatcataaatcaacggctctcctttattttatccaaatttgcttcccaccccgtgtgacatggtttgtctatataaacaaaagaaaagagatgcagaggaggtggtgccggccagccgacaattacgggagcaaatgtgggtcccatcacttttataaacatccatccattccaacacaatcacttcaaatctctttttcttttctttgttaatggattcttcatcttcatcttcttcagctaaccgcgaaggacactacagaggtgttagaaagcgaccatggggacgctatgcagctgagattcgcgatccttggaagaagacacgtgtttggttgggaacatttgatactcccgaggaagctgctcttgcttacgacggcgccgctcgttccctccgtggagctaaggctaaaactaactttcctccggcgccggttgccgctggtctttgtcttgatctcaacgctccttcatctgatcaccgatggccgcctgtcccttcgcgcagcttcgtcgtgactgagtttcttcagactggagttctcaaggattttaacactcctcagcctccacctgttgctgcggtcgctggacttaggcgtcatgacggtgctttttctgtctccggtggagttcaggtggctgagcacacctcaactgcgtcttatttaggactcgtccgacgtgggattccgattgatttaaacgaacctccaccgttgtggctatgaatatcctaaaaaatgagaagcgtaaatgagatcctttatcctaggtttttaacggcgtcgttttgcactctcttttaagatattatttagtaattaattaggcttccatgtcttttcctctcattagtttggtagagttatcatttgtggagtatctatctatctatctttgtaatttatgtaacgctaacattttagaaaaaatgaaaaagagtaacctatgaac

SEQ ID NO: 1343 - DNA, 810 bp, Lotus japonicus
ggaagaaggtggtgccggctagccgacaattacgggaggttacgtgggtccctccaccattatataccccatcacaacactcttgagtttcttcactccctctttctttctgtttttctcttctctgtttttgttgcttccatccatggcttcttcatcttcttcagcctctcgtgaaggacactacagaggagtaaggaagcgaccatggggacgctacgcagctgagattcgcgacccgtggaagaagacacgtgtctggcttggcacattcgacactccagaagaagctgccctagcctacgacggcgccgctcgttccctgcgtggagccaaggccaaaaccaacttccctccagctccgctcgctgctggtctctgcctcgacctcaacgccccctcctctgatctccaccaccaccgctggccctccgtcccctcccgtggccttgccctcagtgagttcctccacaccggcgtcctcaaagacatcaacccgcctcagcctccgccagtcaccgtcgctgtcagcgccccttacgtcaccgtcgctcaagttgcagaaccttcccctacggcgtcgtttcttggactcatccggcgtggaatccccatcgacttgaacgagcctccaccactgtggctttgaaccgtgaaaataatgagttagcgtaactgagatctatgtatcgtaggctttgaacggcgtcgttttgcagttttctaattaaattgtgttattttccctcttgaatcttcatggtcatgtttcattagagatgaacacgtttgttataatcaatcatagag

SEQ ID NO: 1344 - DNA, 1523 bp, Medicago truncatula
acatgtcttttgcactaacaacaacaatgtttgcttttcttctcttcactttcatgtactttctattcaaactctacttacatccaaaacaaaaaaccctaaaccataaaaaaccaccaggtccaccatcactaccaataattggaaatcttcacatattaggcaaacttccacatagaacacttcaatcactctccaaaaaatatggtccaatcatgtccttacaacttggtcaagttccaactattatcatttcatcttcaaaagctgcagaatcatttctcaaaacccatgacatcgtttttgcaagccgaccaaagagtcaaggatctgagctcatgttatatggttccaaagggatagttttttctgactatggtccttattggcgtagtgtgaggaaattttgcactttgaaacttcttagtgcttcaaaagttgagatgtctggtcctattagaaaagaggagttgagtattttggttaacactttgaagaaagctgctttggttggtgaggttgtgaatgttagtgaggtagtagagaatctaatagaagatattgtgtataagttgatgtttggacggagtaagtatgagcaatttgacttgaaaaatttggttcaacaagaattggttttgattggagcttttaatctggctgattatgttccttggctaaagattttttgacctttcagggattaacacgatcttgccagaaactcagtaaagaaattgatgaggtgctagaggtgattacaagctgctaatgtaaacaaaactcatcataaagatttcgtagacatacttctttcaattatgcatcaaaccattgatgtcgagggtgaacaaaatctcgtaattgatcgatctaacatcaaagctattttgctcgacatgatagtggcagcaattgatacatctgctacctcgattttaatgggctttatctgcacttttaaggcatccaagagtgatgaaaattcttcaagatgagatacaaaatgaagtaggaaataaaagaatggttgaagagaaggatttgaagaagttgaattacttagatatggtggttgatgaaaccttaagactgtatcctgttgcacccttactagtccctcctaaatgtagagagaacataacaattgatgattattttataaaggaaaagacgagaattatggtaaatgcatgggcaatagggagagatcctaatgtttggtcagaaaatgctgaagaattttatccaaagagatttattgaaaagaaaatgaattatcaaagacaagagtttgaaagtttaccatttgattatggtcgtagacgttgccctggaattcaattgggtttaactactgttaagttggttatagctcaatttgtgcattgctttaattgggaactttcacataatattagtccattcaatttgaatatggaggagaaatttggactcactataccaagagctcagcatttgcacgcaataccaagttatcgtttggattatgctaagcataa

SEQ ID NO: 1345 - DNA, 1413 bp, Medicago truncatula
aaaccattcattgtagacatgtcttttgcactaacaacaacaatgtttgcttttcttctcttcactttcatgtactttctattcaaactctacttacatccaaaacaaaaaaccctaaaccataaaaaaccaccaggtccaccatcactaccaataattggaaatcttcacatattaggcaaacttccacatagaacacttcaatcactctccaaaaaatatggtccaatcatgtccttacaacttggtcaagttccaactattatcatttcatcttcaaaagctgcagaatcatttctcaaaacccatgacatcgtttttgcaagccgaccaaagagtcaaggatctgagctcatgttatatggttccaaagggatagttttttctgactatggtccttattggcgtagtgtgaggaaattttgcactttgaaacttcttagtgcttcaaaagttgagatgtctggtcctattagaaaagaggagttgagtattttggttaacactttgaagaaagctgctttggttggtgaggttgtgaatgttagtgaggtagtagagaatctaatagaagatattgtgtataagttgatgtttggacggagtaagtatgagcaatttgacttgaaaaatttggttcaacaagaattggttttgattggagcttttaatctggctgattatgttccttggaccaaagctgctaatgtaaacaaaactcatcataaagatttcgtagacatacttctttcaattatgcatcaaaccattgatgtcgagggtgaacaaaatctcgtaattgatcgatctaacatcaaagctattttgctcgacatgatagtggcagcaattgatacatctgctacctcgattttaatggatgagatacaaaatgaagtaggaaataaaagaatggttgaagagaaggatttgaagaagttgaattacttagatatggtggttgatgaaaccttaagactgtatcctgttgcacccttactagtccctcctaaatgtagagagaacataacaattgatgattattttataaaggaaaagacgagaattatggtaaatgcatgggcaatagggagagatcctaatgtttggtcagaaaatgctgaagaattttatccaaagagatttattgaaaagaaaatgaattatcaaagacaagagtttgaaagtttaccatttgattatggtcgtagacgttgccctggaattcaattgggtttaactactgttaagttggttatagctcaatttgtgcattgctttaattgggaactttcacataatattagtccattcaatttgaatatggaggagaaatttggactcactataccaagagctcagcatttgcacgcaataccaagttatcgtttggattatgctaagcataaatag

SEQ ID NO: 1346 - DNA, 2025 bp, Cicer arietinum
gttgtcgaccacaacccaagtcaagaccgaagtcaacaacaccttgttcagttctgttcctcattgctttctactttcctaaatctttcttattcagcaacacaaattaattaactctttttcctttgcttaaaacttggcttaatcataattaagtatgatacttgagtagagcttcaattaattgtgaaataaagaaatggcagtttcttcacgttttgaagcagcccagaaagcaataaactcaattggattaggttttgacataacattagatatcaactttcacaattgtaaaactgctccacccttgatcttcatcaatgctaatcaacaaaactaccgacatttggagattcctggaggagtttcaattccagatgttccaaactctatcaaatgtgtcagaggtgaatctattagaatccattcggatgttctcaccttgcaccagatgttggaacatttcaaccatgaaatgcatcttgtaggagatactgcatctggtcatttttgtgcttcatttggattatctggtcgatgtatcaaagaattgggttctattaagtctcttgcgtatgatggttggttcatcaaacggtatgctgttgaattagaaaggtatcatggtaaactcaatgatcatgtcaaagaagctgtgccatcatcatgggaccctgaggccttggcaaggttcatagaacattttggaactcatgttatagtcggggtgagcatgggagggaaggatgtgttatatgttagacaacatgaagatacatcagatatcaatgatccagctagtatccaaaaacttttgaaggaacagctagcatgaagttcaaggattctgcagacaatcatctctcagcttctgaagacttaagtaacaaaaagaagaatgtttttatgatacatagaaggaggggtggaagcagtaaaaaaatgtatcatagtgaatggttggatactattgattcagaacctgacatcatatcgatgcatcttctccctctgacatcccttttgttgggtatccgtggaagtggatttgtgacccatgctataaatctctaccttcgttacaaacctccaattgaagacctccatcaatttttcgagtttcagctaccaagacaatgggctcctatactcagtgagatgcgtctcggttcttactggaaacatcaaatgaacacgtggctacgatttaatatctttggtccaaagctttacataaatacatatccagtagatgttggtaatagaccagtaattgggctgagattacaattggaagggcgaagaagcaaccggttagccattcatctgcagcatctgacttctctacccaaatccttaccgctcgcagacaatgcaaatgcctatttgtcttgtgactcgtatagctgcagtttccataagaaagtgaaatggagctgcttttcgtatatttgtactgcaccggttgaatcagatgatagtctttccattgtcacaggagctcagttacaagttgaaaagaagtgtcttcttttacggctgcgcttctccaaagttattggtgctacacttcagaagccacctgagtgggatcaatcctgcaatattggccagttcaagagcatgtctaggggcgtcttagcttttgttccaaaagagggacagaggggtcgtccgaagccgggcgatgttaccatcggttctactacatattctgctgcacttcctgcacctgtgaatacacctaagcttcaaaggtacgtggacataacggaaatgatgagaggaccggaagatactccgggatattgggttgtgtccggagcaaggctttatgttcagaatgggaaaatatatctccttgttaagtattcactattgaactttgttattatgcagtgtgaaaatgaagcttcatagtattgctgtaatgctcagttgaaatccttttcatgtttgttgttggtggatttgtgatgctatgcgccaaaagttgtattcatttttatttgatacccgtta

SEQ ID NO: 1347 - DNA, 1605 bp, Cicer arietinum
cattaatctcttcacgccattctcctcaattcactcctattcaagaggaacatgaatttgatgaatattgcagtgaaaacagaagccaaagcagaagaacaacaccgagtggttcaacaccaaaacaccaataccaccctccaacacctattgttaacaaaatcaacaaatcaaatcacaaaaagaaaagatcagaaactgaagaagatggttctgtttcctgcaacaaatgtagaccacattctcgtgacaaaatcttcatccttccctttgatcatagcaacaataacaatagcaacaacaacaaatattcatctttgttacaaagtccaaatgggattttcaaatccattgtttcaaagttaacaaggaagagtccaatgtcaacaacatcgacaacaacaaccaacaacaataacaatgaccctttatcatcctcaagagaagaacaatggaaaattgcagtggctgaactttcacacaaacttgttcatgctactaggaaaagagatgaagctcttcaagaagcttcaaggttgatgcattcaatgtctgagttagagaagaaacttaacaaacttgaattgtattgtcacagtttgaaatctggtcttgaagaatgtagtagtattaatagcccccatgtgtttgatacaaagtctctgagtaattttcatcatgttcaagatactgataatgttgttcaacatttcttggtgtctgtttctgaagcaagatcttctgtgaggcttttaagtcgttctcttacaatgcaacttaggcatattggtagcaaagtgtttgaaaaagtttcattacttttgcaaccttatgatataaaaatctctttttctaagaatccaagaagtttgcttttttacttggaagcacttttgaataagactttctttgaggattttgagtcaattgggtttcaaaagaatgcttataataggatactaaacccaatggaaaggtgtgaggcaagtttagcttctttcaatatgattcatggtttgacttgggaagaagtgttgagtaaagggacaagacatttcagtgaggattttagcagattttgtgataggaaaatgagtgagattgtggctatgttgggttggaatagggcttggcctgaacctcttttgcaagctttctttgttgcttcaaagagtgtttggatggttcatttgttggctaattcggttcatccaagtttgccaatttttagagtggataaaggtgtgaactttgattctgtttacatggaggatatgggtggggacaagtcttcaaggttggtacctaacatggttaggataatggttgcaccaggtttttatgtctatggtagtgctgtcaaatgtaaggttctttgcaggtacttgaccagtgccaacaacaacaacatcaataaccacagttatggtaacaaagaaaacaaaggtttaaccccttcaccttaaacctctcaagccttttcatttattcattttgattttaatatgaaattggaaactgtactctttggtttggaatttggatcagcttctattgttgttatattggccaatttaatcaatgtgtatagtattatattggtgc

SEQ ID NO: 1348 - DNA, 2340 bp, Glycine max
acactgacatcaccaaagttttcctttcattttcgttcattctctcgccagcgagaagaagaagaagaagaatcccctgcggtcgcgctctctctctccttctctactcctcctctggtcatcagattcatcatcatcatccatggcggttcatccgtcggtcgccgccgctccggcgtcgctctatgtcggcgacctccaccccgacgtctccgacagccacctcgtcgacgcattctccgagttcaagagcctcgcgtctgttcgcgtctgcaaagactcctccacggggaaatccctctgttacggttacctcaacttcgtttcccctcaagacgcaattcgtgcaatcgagctgaaaaataactccacgcttaatgggaaagcgatgagggtgatgtggtcgcgtcgtgatcctgatgcgaggaaaagcgctatagggaacttgtttgttaagaacttacccgaatcgatagataatgctggactgcaagatatcttcaaaaaatacgggaatattttgtccagcaaagttgtcacgtctgaggatgggaagagcaaaggatacggctttgttcaatttgaatcagaagaatcttcgaaagttgctatcgagaagctgaatggctatactgttgctgataaggagttatatgttgggaagtttgtcaaaaaaagtgatcgcattttgcctggccctgatgctagatatacaaatttgtacatgaagaatttggacctggatgtttcagaagcaacactgcaggagaagttttcctctttcgggaaaattgttagcttggttattgcaaaggacaacaatggaatgtccaagggctttggctttgtgaactatgataacccagatgatgctaaaaaggcaatggaagcaatgaatggatcacaattaggttctaagattctgtatgtagccagagcacaaaagaaggctgaacgtgagcagatcttgcaccaccaatttgaggagaagcagaaggaacaaatcttgaaatacaagggatcgaacatttatgtgaagaacattgatgaccatgtaagtgatgaagaactgagggatcattttagtgcatgtggcactataacttctgcaaaaattatgcgagatgacaaagggataagtaaagggtttggctttgtctgcttctccactcctgaggaggccaataaagctgtgaacacatttcatggattcatgtatcatggaaaaccactatatgttgctcttgctcagaggaaagaggataggaaagcacaattgcagctccagtacgcacaacaactggcacgactatctggaccttcgactgccattatccctagtggatatcctccttactactatgcagctagtggcgttatttcacacgtgcctcctcgagctgggctgatgtatcaacatctggcattgagaccgggatggggggctaatggctttgcaccccctgctagatcatttcaacaatcaccagttcctgcagtttctaacaatactaggcagcataggcaaaacaggggcaagttgaatgggaattcaatagcacagggaaatactcactctggtacttatttaccacaagcccagcagatttctcagccagtgatctcttcaagagattcaagtactcagcagagaaccggacaggctaggtacatacctagtggacgccagcgtgatgtggaaaaaggatctggatcctcatctgttggttcaaactctggcagaggaggatcccaggggtcagaaatgctgcatagcttgcttgctggtgctgctcctgagcagcagaaagagattctcggggagcatctttacatgcttgttcataaactaaagcctaccctagcagcaaaaataacagggatgcttctggagatggacaatggagaattactgcttctcctggaatcgccagagtctctttctgccaaggtggaagaagctgtccaagtgcttaagaactctaagaccaaagtttctggccaggacgtacttcattcaaatttcctttcagctgaggttgcagttaactgaagactttaactgattcttgtttgagcagataacgaagagcttgaagcctcctagaactcagaaatttgagacatgagttttgacatcaatgattacttgagtgtttcttctacagtatatttccctataaaaaaaaaaaactgttttcttgccttaggtctgacaaaaattggtagtgactataaaaatcagggacggcttagttttctggattttgattacatggattaacttcgatgaaatcttggttcaatatttttcatttcgcatccatatgctatgcacaa

SEQ ID NO: 1349 - DNA, 2440 bp, Glycine max
acactgacatcaccaaagttttcctttcgttttcgttttcattctctcgccagcgagaagaagaagaatcccctgcagccgtgctctctctctctctctctctctctctctctactcctcctccgttgatcatcatcatcatccatggcggttcctccgtcggtcgccgccgctccggcgtcgctctacgtcggcgacctccaccccaacgtctccgacaaccacctcgtcgacgcattctccgacttcgagagcctcgcgtctgttcgcgtctgcaaagactcctccaccggcaaatccctctgttacggttacgtcaacttcgtttctcctcaagacgcaattcgtgcaatcgagctgaaaaataactccacgctgaatgggaaagcgatgagggtgatgtggtcgcgtcgcgatcctgatgcgaggaaaaatgctatagggaacttgtttgttaagaacttacctgaatcgatagataatgctggactacaagatatgttcaaaaaatatggcaatattctgtccagcaaagtcgtcatgtctgaggatgggaagagcaaaggatacggctttgttcaatttgaatcagaagaatcttcaaatgttgccatcgagaagctgaacggctctactgttggtgataagcagttatatgttgggaagtttgtcaaaaaaagtgatcgcattttgcctggccctgatgctagatatacaaatttgtacatgaagaatttggacctggatgtttcagaagcaacactgcaggagaaattttcctcttttgggaaaattgttagcttggttattgcaaaggacaacattggaatgtccaagggttttggctttgtgaactatgataacccagatgatgctaaaagggcaatggaagcaatgaatggatcaaaattaggttctaagattctgtatgtagccagagcacaaaagaaggctgagcgtgagcagatcttgcaccaccaatttgaggagaagcggaaggaacaaatcttgaaatacaagggatcgaacatttatgtgaagaacattgatgaccatgtaagtgatgaagaactgagggatcattttagtgcatgtggcattataacttctgcaaaaattatgcgagacgacaaagggataagtaaagggttcggctttgtctgcttctccactcctgaggaggccaataaagctgtgaacacatttcatggattcatgtttcatggtaaaccactatatgttgctcttgctcagaggaaagaggataggaaagcacaattgcagctccagtatgcacagcaagtggcaggactatctggaccatcaactgccattatccctggtggatatcctccttactactatgcagctactggtgttatttcacatgtgcctcctcgagctgggctgatgtatcaacatctgccaatgaggccaggatggggggctaatggctttgcactccctgctagatcattccaacaatcaccagttcctgcagtttctaacaataccaggcagcataggcaaaacaggggaaggttgaatgggaatccaatagcacagggaaatactcactctgttacttatttaccacaagcccagcagatttctcagccagtgatctcttcaagtactcagcagagaaccggacaggctaagtacttacctagtggacgccagcgtgacatggaaaaaggatctggatcctcatctagtggttcaaactctggcagagggtcccaggggtcagaaatgctgcatagcatgcttgctggtgctgctcctgagcagcagaaagagattctcggggagcatctttacatgcttttattgaaggttaaatttttaaattcttatgtttatttactgtgctatgttgagcagcctaccctagcagccaaaataacagggatgcttttggagatggacaatggagaattgctgcttctcctggaatcgccagagtctctttctgccaaggtggaagaagctgtccaagtgcttaagaactctaagaccaaagtttctggccaggacgtacttcattcaaatttcctttcagctgaggttgcagttaactgaaagactttaacctgatgattcttgtttgagtatagatcatgaagagcttgaagcctccaagaactcagaaatttgagacatgagttttgacatcaatgattactttagtgtttcttctacagtatatttccttatgaaaaatgactttctgttttcttggcttaggtctgacaaaaattgttggtgactataaaaatcagggacaaattttttttttcggattttgattacatggattaacttcgatgaatcttggttcaatatttttcatttcgcattcatatgttatacacatgtagggtatattcaacgcatgtaagcaattctgaatagacaacaatatgcaagcacatca

SEQ ID NO: 1350 - DNA, 786 bp, Medicago truncatula
aagcagtggtatcaacgcagagtggccattacgccggggagagcggcacaatcgagcaagcaatccctacttcacatattttcattttcattttgtgataaaaaataaaaagaagctaagagaagaggcatatccagaatcaatcaatcaatcaatcgaacatgaacatgaacatgactagcatcacttcttcaattgcaacattggtgactccgttaccgttgttcatgaatacgaagaacaagattcagagcagaagcagcaaaatgactcggataagatgtgatgttggagaagaagattcatcatcatcaacagcgaagattggatcgcgtgttagggttaaggttcctctcaaagtctatcacgttcccaaagttcctgaagttgatctaactggtagagaaggacaaatcaaacagaacgtgactttctggaaagataataagcgaatctctgctaatcttccttataaggttgagtttgttgctgatgatattcaaggtcctcgtggtcctctcaagttcgttgctcatctcaaagatgatgaattcgaatttctagaatagagtatttcataaataattacgcatatcaattactacattagagagaggtattcatgttatctcatctcttctttaatcaaattctgtcaactatctatctattactacattttcactatcatttttatttttagtgtaaacactccaattcagtctccgactgaacacatacgaaaatgtaaggactaatatgagttttattttagtcagactaaag

SEQ ID NO: 1351 - DNA, 1647 bp, Triticum aestivum
atcggccatctgtggcggcagctcgggatagggctcgcggggatgaggctgcatggggatgtgtcggatgatgaagaggagggtgcggtgatggatccggcactgctgtcgtcgtcatcgccgcccgccggtgcggcggcggcggctgcgtcgaggctggtggtgggctacgccctcacgaagaagaaggttaagagcttcctccagcccaagctgctcttgctggcgaggaagaaaggaattagtttcataccaattgatgagactcgtcctctctccgaacaaggcccatttgatattatcttgcacaagaaaactagcaaggagtggcagcggtttctggaggattatcatgaagtgcatccagaagtcactgtcctcgacccacccaatgccattgagcatctgaacaatcgacaatcgatgcttgaagaagtagcagatttgaacctgtccagtttctatgaagaagtttgcactccacgccaactggtcattatgaaagatccgtcctctataccaactgcagttgccatggctgggctaaccttgccattggttgccaagccattggttgttgatggaacatctaaatctcatgagctatctctggcatacgatgaggcgtccttgccaatgcttgatcctcctctggtactccaggaatttgtgaatcatggtgggatcctctttaaggtgtacatcattggtgaagctatacaggttgtccgcaggttttctcttcctgatgttaatacctatgacttactaaacaatgttggcatctatcgacttccaagagtttcatgcgctgcagcaagtgcagatcatgcagaccttgatcctcgtattgcagagcttcctccgagaccacttctagagaaactaggcagggagcttcgtggtcgtctgggtctaagattgttcaacatagatatgattagagagcttggagcaaatgaccggtactatataattgatatcaactacttcccaggatatgggaaaatgcctggctatgagcacatattcaccgatttcttgcaaagtcttgggcaaaacaaataccaaaggtgcttgagcggaggctgaagcgctggtagccatacttgttcactaatgtgcatatcttggatacataagctggagcccaaggcttgaagtcccaaacttacatgttttgtcagaagtggcgccacatacacagggtcgggagtagggggagagaaagaagaactcgaatggccttgtgcccatcttgtataaatcacggttgttttgatcatagtttggtctcaaatgctttcatcaaacaggatcagcaccatcaacccaccatgtatgatattgatcagttaagctacatacagtgcatcacagtaagcaatattcaaaataagacagcatcacctgcttccaggtatagtttgacactacagagaactaaatgctcttctagggggaaattcaatcagattgcaaagcttctaacctgcagtcagaaaatcttgataaattgaagcaggtagccatgacttggtgcaggcttcgagcatgagctgctccttgttccgcggcagtttttagccgctgcagactggacacacaaggagtgtttgcatgtgccagcatttcccagtaaaccta

SEQ ID NO: 1352 - DNA, 1612 bp, Triticum aestivum
ccacaccccagcaaactctcacgcgcgcgcgaagcatcggctctgctggatcccccctttgcctggacatttgattccccccgaatttcccatcattttgggtttatcggccatctgtggcggcagctcgggatagggctcgcggggatgaggctgcatggggatgtgtcggatgacgaagaggagggtgcggtgatggatccggcactgctgtcgtcgtcatcgccgcccgccggtgcggcggcggcggctgcgtcgaggctggtggtgggctacgccctcacgaagaagaaggttaagagcttcctccagcccaagctgctcttgctggcgaggaagaaaggaattagtttcataccaattgatgagactcgtcctctctccgaacaaggcccatttgatattatcttgcacaagaaaactagcaaggagtggcagcggtttctggaggattatcatgaagtgcatccagaagtcactgtcctcgacccacccaatgccattgagcatctgaacaatcgacaatcgatgcttgaagaagtagcagatttgaacctgtccagtttctatgaagaagtttgcactccacgccaactggtcattatgaaagatccgtcctctataccaactgcagttgccatggctgggctaaccttgccattggttgccaagccattggttgttgatggaacatctaaatctcatgagctatctctggcatacgatgaggcgtccttgccaatgcttgatcctcctctggtactccaggaatttgtgaatcatggtgggatcctctttaaggtgtacatcattggtgaagctatacaggttgtccgcaggttttctcttcctgatgttaatacctatgacttactaaacaatgttggcatctatcgacttccaagagtttcatgcgctgcagcaagtgcagatcatgcagaccttgatcctcgtattgcagagcttcctccgagaccacttctagagaaactaggcagggagcttcgtggtcgtctgggtctaagattgttcaacatagatatgattagagagcttggagcaaatgaccggtactatataattgatatcaactacttcccaggatatgggaaaatgcctggctatgagcacatattcaccgatttcttgcaaagtcttgggcaaaacaaataccaaaggtgcttgagcggaggctgaagcgctggtagccatacttgttcactaatgtgcatatcttggatacataagctggagcccaaggcttgaagtccaaaacttacatgttttgtaagaagtggcgccacatacacagggtcgggagtagggggagagaaaaagaactcgaatggccttgtgcccatcttgtataaatcacggttgttttgatcatagtttggtctcaaatgctttcatcaaacaggatcagcaccatcaacctaccatgtatgatattgatcagttaagctacatacggtgcatcacagtaagcaatattcaaaataagacagcatcacctgcttccaggtatagtttgacactacagagaactaaatgctcttgtagggggaaattcaatcagattgcaaagcttctaaccttcagtcagaaaatc

SEQ ID NO: 1353 - DNA, 1617 bp, Secale cereale
aataccggccgctctgttctcgtgctccctcttccactcgtctcgccattaattaaagccccggaaaacaatttccctctcccaaatcctccagatacagcccctaccacacctcagcaaactctcacgcgcgcgcgaagcatcggctctgctggatcccccctttgcctggacatttgattccccccgaatttcccatcattttgggtttatcggccatctgtggcggcagctcgggatagggctcgcggggatgaggctgcatggggatgtgtcggatgatgaagaggagggtgcggtgatggatccggcactgctgtcgtcgtcatcgccgcccgccggtgcggcggcggcggctgcgccgaggctggtggtgggctacgccctcacgaagaagaaggttaagagcttcctccagcccaagctgctcttgctggctaggaagaaaggaattagtttcatatcaattgatgagactcgtcctctctcagaacaaggtccatttgatattatcttgcacaagaaaactagcaaggagtggcagcggtttctggaggattatcatgaagtgcatccagaagtcactgtcctcgacccacccaatgccattgagcatctgaacaatcgacaatcgatgcttgaagaagtagcagatttgaacctgtccagtttctatgaagaagtttgcactccacgccaactggtcattatgaaagatccgtcctctataccaactgcagttgccatggctgggctaaccttgccattggttgccaagccattggttgttgatggaacatctaaatctcatgagctatctctggcatacgacgaggcatccttgtcaatgcttgatcctcctctggtactccaggaattcgtgaatcatggtgggatcctctttaaggtgtacatcattggtgaagctatacaggttgtccgcaggttttctcttcctgatgttaatacctatgacttactaaacaatgttggcatctatcgacttccaagagtttcatgcgctgcagctagtgcagatcatgcagaccttgatcctcgtcttgcagagcttcctccgagaccacttctagagaaactaggcagggagcttcgtggtcggctgggtctaagattgttcaacatagatatgattagagagcttggagctaatgaccggtactatgtaattgatatcaactacttcccaggatatgggaaaatgcctggctacgagcacatattcaccgatttcttgcagagtcttgggcaaaacaaataccagaggtgcttgagcggaggctgaagcgcgggtagccatacttccactagtgtgcatatcttggatacataagctggagcccatggcttgaagaagtcccaaactggcattacacgttttgtcagaagtggcgccacatacacagggtcgggggtaggggagaaaaaaaaaagaactcgaatggccttgtgcccatcttgtataaatcagagttgttttgatcatagtttggccatcttcctcttagcgatctcaaatgctctcatcaaacaggatcagcatcattaactgtagcatcccaattttcaatttggatgttaatatagatcattcatatg

SEQ ID NO: 1354 - DNA, 1978 bp, Sorghum bicolor
ggatgctcgatggtctatgccgacgagagtaatggtagagatgcggcaggtgaattgtagacacaaagaatgacccactctccgtcgtctacaaatacccgcccgcctcttcttcctcccccttccactcgcctcgccattcgccattattaagagctccccggaggcaaaattttgccccccaaaatcctcgcgtattcgtcccacccttgttcgcccccacctcagttagttctccgcctatcgcgcgcccgcgcaaagcatcaactctgctccacccaccctctgtgcagacttaatcttgaggttcccgattgtccttcggctccttgccatttgcgacgagatttagcggcaaggatgcgtctgcatgctgaggtgcgggatgagatggaagagagcgaggagggggctgtgatgtcttcggcggcgttgtcgccaatcatcggcgcggcggcgccggctccccggctagtggtgggctacgccctcacgaagaagaaggtcaagagcttcctccagcccaagctgctcctgctggcgaggaagaatggaatcagttttgtctcgattgatgagtctcttcccctctcagaacaaggcccttttgatgttattttacacaagattactaggaaggagtggcagcaggttctggaggactatcatgaagaacatccagaagttactgtccttgacccaccaaatgctatcaagcatctgaacaatcgacaatcaatgcttgaagaagtagctgatttgaacctgtcaaatttctatggagaagtttgtaccccacgacaactggtcattacggaagatccatcctctataccaactgctgtagctatggctggactaactttgcccttggttgccaagccattggttgttgatggaacatctaaaggtcacgaactataccttgcatatgatgaggcatccttgtcaatgcttgatccgcctctggttctacaggaattcataaaccatggcgggatcctctttaaggtgtatatcattggcgaaacaatacaggttgtccgcaggttctctcttcctgatgttaacacatatgacttactaaacaatgttggcgtctatcgattgccaagagtttcatgtgctgcagctagtgcggaggatgcagatcttgaccctcttattgcagagcttcctccaaggccacttctagagaaactgggcagggagcttcgtggccggctgggtttgagattgttcaatatagatatgattagagaacttggaaccaaagatcggtactacataattgatatcaactacttcccaggctacggtaaaatgccaggatatgagcgcatgttcacagacttcttactaagtcttgcacaaagcaagtacaaaaggtacttaagcgggacctgaggtgcaaggaagtttgcgaagactgtattactgacaaaatggcatataacggtggcagccatgcttccctagtccccaccaatgtacatttgctggagacataagcatagcataagccggaggcttgaggaagtcggcaagtcgcagtgtatgtgttcaaaagtggtggcacatgctggactggagtaggaaataaccaaggaaatgcttggatgccctgtgcgcatgttgtaaaatgtttaactgaatgaatgacttcttcgtgatggactccttccatcataattcgtcaaccgttttcttgagccagagaaataattctgcagcttggtggccattggggggttttgttgggttagtttggcagagtttgaggtctatggaagtcaggagaccaccaaatagctgttggtgattggatcattctcaagtgacactgccatcggagctgcagctctgtaaattgaaaaatggcagtcttcggctacgtctggttgctactttccactgccagtgcgtggccacgacccacgaatggcgcctacggggaccatgttctgttgcactaatt

SEQ ID NO: 1355 - DNA, 1710 bp, Sorghum bicolor
cttccactcgcctcgccattcgccattattaagagctccccggaggcaaaattttgccccccaaaatcctcgcgtattcgtcccacccttgttcgcccccacctcagttagttctccgcctatcgcgcgcccgcgcaaagcatcaactctgctccacccaccctctgtgcagacttaatcttgaggttcccgattgtccttcggctccttgccatttgcgacgagatttagcggcaaggatgcgtctgcatgctgaggtgcgggatgagatggaagagagcgaggagggggctgtgatgtcttcggcggcgttgtcgccaatcatcggcgcggcggcgccggctccccggctagtggtgggctacgccctcacgaagaagaaggtcaagagcttcctccagcccaagctgctcctgctggcgaggaagaatggaatcagttttgtctcgattgatgagtctcttcccctctcagaacaaggcccttttgatgttattttacacaagattactaggaaggagtggcagcaggttctggaggactatcatgaagaacatccagaagttactgtccttgacccaccaaatgctatcaagcatctgaacaatcgacaatcaatgcttgaagaagtagctgatttgaacctgtcaaatttctatggagaagtttgtaccccacgacaactggtcattacggaagatccatcctctataccaactgctgtagctatggctggactaactttgcccttggttgccaagccattggttgttgatggaacatctaaaggtcacgaactataccttgcatatgatgaggcatccttgtcaatgcttgatccgcctctggttctacaggaattcataaaccatggcgggatcctctttaaggtgtatatcattggcgaaacaatacaggttgtccgcaggttctctcttcctgatgttaacacatatgacttactaaacaatgttggcgtctatcgattgccaagagtttcatgtgctgcagctagtgcggaggatgcagatcttgaccctcttattgcagagcttcctccaaggccacttctagagaaactgggcagggagcttcgtggccggctgggtttgagattgttcaatatagatatgattagagaacttggaaccaaagatcggtactacataattgatatcaactacttcccaggctacggtaaaatgccaggatatgagcgcatgttcacagacttcttactaagtcttgcacaaagcaagtacaaaaggtacttaagcgggacctgaggtgcaaggaagtttgcgaagactgtattactgacaaaatggcatataacggtggcagccatgcttccctagtccccaccaatgtacatttgctggagacataagcatagcataagccggaggcttgaggaagtcggcaagtcgcagtgtatgtgttcaaaagtggtggcacatgctggactggagtaggaaataaccaaggaaatgcttggatgccctgtgcgcatgttgtaaaatgtttaactgaatgaatgacttcttcgtgatggactccttccatcataattcgtcaaccgttttcttgagccagagaaataattctgcagcttggtggccattggggggttttgttgggttagtttggcagagtttgaggtctatggaagtcaggagaccaccaaatagctgttggtgattggatcat

SEQ ID NO: 1356 - DNA, 1659 bp, Zea mays
ctcttccgctcgtcccgccaatcgccattattaacagctccgcggtccctccctccctcggtcggtcggcgtcggtccctccctccccacccagttagtcctcagcctatcccgtgcccgcgcagagcaccgcctctgctcgacccaccaccctctgtgcagagttaattaaccttgaggtttccgattgcccttcccttccgctcctctcgcccattcgcggcgagattcagcggcaaggatgcgcctgcacgcggaggtgcgggatgagatggaggaggggagcgaggagggggctgtgacggcttcggcggggctgtcgccaccgccactcatcggtgcggcggcgccggttccccggctagtggtggggttcgccctcacgaagaagaaggtgaagagcttcctgcagcccaagctgctcctgctggccaggaagaatggaatcagttttgtatctattgatgagtctcttcccctctcagaacaaggcccttttgatgttattttacacaagattactaggaaggagtggcagaaggttctggaggactatcacgaagaacatccagaagttactgtccttgacccaccaaatgctatcgagcatctgaacaatcgacaatcaatgcttgaagaagtagctgatttgaacctgtcaaatttctatggagaagtttgtatcccacgccagctggtcattacgaaagatccatcctctataccaacttctgtagctatggctggactaactttgcccttggttgccaagccattggttgttgatgggacgtctaaaggtcatgaactatatcttgcatatgacgaggcatccttgtcaatgcttgatccgcctctggttctacaggaattcataaaccatggcgggatcctctttaaggtgtatatcattggtgaaacaatacaggttgtccgcaggttctctcttcctgatgttaacacatatgacttactaaacaacgttggcatctatcgattgccaagagtttcatgtgctgcagctagtgcggatgatgcagatcttgaccctcttattgcagagcttcctccaaggccacttctagagaaactgggcagggagcttcgtggccggcttggtttgagattgttcaatatagatatgattagagaacttggaaccaaagatcggtactacataattgatatcaactacttcccaggttacggcaaaatgccaggatatgagcgcatgttcacagacttcttactaagtctcgcacaaagcaagtacaaaaggtatgcttccccaccgcgccaatgtacatttgctggagacataagcataagcgggaggcttgaggaagttggcaagtctcagtgtgtgtgttcaaaatcggtggcacatgctggactggagtaggaaataaccaaggaaacgcttggatgcgctgtactcatgttgtaaaatgtttaactgaatgaacaccttcctcgtgatggctccctccatcgtaatttggcaaccatgagaattaattctgcagcttggtagtgaacggtgttttgttgtgtgtatttggtaggtttgaggtctacgcaagtcaggagaccaccaaatagctgttgatgatcggatcatattaatctacatacaatctttctagcagtcatactaat

SEQ ID NO: 1357 - DNA, 1736 bp, Setaria italica
atgacctttttttgtttgaaaggatggggcagagctccgcgaaggccaaaatttcgcccaccgaatcctcgctgccagtgccgctcccctcgccttgcttgccaccccgcttcagttacctctcccgcgcgaagtaccaccccagctggaccccacccccacgccgcaggcttaaccgtgacgcttccgattatctttccgctccttgtccatttgcgacgagatttagctttaagacccgcggggatgcgcctgcacgcggatgtactggatcagatggaaggggagggagaggagggagctgcgatggcctcgtcggtgctgtcgccgccgctcatgggcgcggcggcggcggcggccacggcgcccaggctagtggtgggctacgccctcacgaagaagaaggtgaagagcttcctccagcccaagctgctccagctggcgaggaagaatggaatcacttttgtatccattgatgagtctcttcccctctcagaacaaggcccttttgatgttattttgcacaagattactagcaaggagtggcagcaggttctggaggactatcacgaagaacatccagaagttactgttcttgacccacctaatgctattgagcatctgaacaatcgacaatcaatgctcgaggaagtggctgatctgaacctgtcaaatctctatggagaagtttgtaccccacgccaactggtgatcacaaaggatccatcctccataccaacagctgtatccatggctggactaacctggcccttggttgccaagccattggttgttgatgggacatctaaaggccatgagctctatcttgcatatgatgaggcatccttgtcaatgcttcatccaccgctggttctacaggaattcataaaccatggcgggatcctctttaaggtgtatatcattggtgaaacggtaaaggttgtccgcagattctctctaccagatgttaacgcatatgacttactaaacaatgtgggcgtctatcggttgccaagagtttcatgtgctgcagcaagtgcggatgatgcagaacttgaccctcttattgcagagcttcctccaaggccacttctagagaaactagggagggagcttcgtagccggctgggcttgagattgttcaacgtagatatgattagagaacttggaaccaaagatcggtactacataattgacatcaactacttcccaggttttgggaaaatgccgggatatgagatcatgttcaccgacttcttacttagtcttgcccaaagcaagtacaaaaagtacttaagcgggacctgaagtgcaaggaagtttgcgaaagagtggagactgacaaaatggcatataatggtggcagctgtgcttccccaccaatgtacatattctggagacataagcataagccggaggctccaggaagtcgcagtgtgtgttccttcaaaagtggtggtacatgctgggtccggagtaggaaataaacaaggaaatgcttggatgccctgtgcccatgttgtaagatgttgcttaccgaatgaataccttcgtcgtgatggcctcctttaatcgtaataagttggtgaccggtttcttgggccaagcttcacccaattgcttgctgttgcgcttcccgttatttctgaacactgcagcatggtggtgactggggttttatttggtttgttcagcagggggttggaggtctatggaataatggaagtcaggattga

SEQ ID NO: 1358 - DNA, 1333 bp, Panicum virgatum
ccgagatggaggggcaggaggaggagggagctgcgatggcctcgacggttctgtcgccgccgctcgtcggcgcggcggtggcggctgccacggcgcccaggctagtggtgggctacgccctcacgaagaagaaggtgaagagcttcctccagcccaagctgctcatgctggcgaggaggaacggaatcagttttgtttctattgatgagtctcttcccctctcagaacaaggaccttttgatgttattttgcacaagattactagcaaggaatggcagcaggttctggaggactaccttgaagaacatccagaagttactgtcctcgaccctccaaatgctatcgagcatctgaacaatcgacaatcaatgcttgaggaagtagctgatttgaacctatcgaatttctatggagaagtttgtaccccacgccaactggtcattacgaaagatccatcctctataccaacagctgtagcaatggctggactaacttttcccttggttgccaagccattggttgttgatggaacatcaaaaggtcacgaactatatcttgcatatgatgaggcctccttgtcaatgcttcatccacctctggttctacaggaattcataaaccatggcggtatcctctttaaggtctatatcattggtgaaacagtacaagttgtccgcaggttctcccttcctgatgtcaacacatatgacttgctaaacaacgttggcatctatcgattgccaagagtttcatgtgccgcagctagtgcggatgatgcagaccttgaccctcttattgcagagcttcctccaaggccacttctggagaaactggggagggagcttcgcagccggctggggttgagattgttcaatgttgatatgattagagaacttggaaacaaagatcggtactacataattgacatcaactacttcccaggttttgggaaaatgccaggatatgagcacatgttcaccgacttcttactgagtcttgcgcaaagcaagtacaaaaggtacttaagcgggacctgaagcgcaaggaagcttgcgagcgaagaggcgtcactgacaaaatggcatataacggtggcagctgtgctcccccaccgatgtacatattccggagacaagcataagccggaggctcgaggaagtcgcagtttgtttcttcaaaagtggtggcacatggtggattctgagtaggaaatgaccaaggaaatgtttggatggcctgcgcccatgtggtaaaatgttgtttactgaatgcgtgcctttcttcgtggtggcctcctttcaccataatttggcgaccggtttttttgggccaa

SEQ ID NO: 1359 - DNA, 2085 bp, Oryza sativa
caaggacaaggtaagaaaagtttaatcaatctagctcgttgaatggaacaaacaaacaacccacattccattaagcccccacacgaaacaaaagcttggtacacgtagaacaaaataaaagttggagcctccaaagaaacgagaccttcactagctccccacataccaagaacagtgtcactctagcttcttcctctttctctctataaatcttttcccgagccaagaaaaccaccattaaacccaccaccaccgccacctcctccacctccatggcgatggcgatgcaccggttcagcctctgctgcgtcgtcctcctcgtgctcgcgccgctcgccgccgtcgcgtggcggccgtggccgccacggaatgggagcggcgaggttgaggggatcggggcgtccaagaagttcgaggggtcgtcggatttcgtcaagctgcagtaccacatgggccccgtcctcgccgccgacatcacggtccacccgatctggtacggccggtggcccgccgagcagaagcgcaccatccgcgcgttcctccggtcgctctcgccgccgggctcgggctccggcgatggcggcatcccgtcgccgtccgtggcggcgtggtggcgcaccgtgcggctgtacaccgaccagacctcggcgaacgtgtccggggtggtgaggctcgggcgggagaagtgcgacgcgcgcgcgtcgcggggcgggcggctgacgcggctcgacatccagtccgtggtgcgggacgccgtgacggcgcggacgcggccgctccccgtggactcgagcggcgtgtacctggtgctgacctcgccggaggtggtggtggagaacttctgcgggcaggtgtgcggcttccactacttcacgttcccgtcggtggtcgggtacacgctgccgtacgcgtgggtggggaactcggcggcgcggtgcccggaggtgtgcgcgtacccgttcgccatcccgtcgtacgtgggcggggggcggagggcggaggcgccgccgaacggcgacgtgggcgtggacgggatggtgagcgtcatcgcgcacgagctggccgagctggcgtcgaacccgctcgccaacgcgtggtacgccggcgaggacccgtcgttcccgacggagatcgccgacctgtgcgaggggatctacggcaccggcggcggcggcgcgtacaccggccagctgctcaccgacggccgctccggcgcgtcgtacaacgtcaacggcgtcggcggccgcaagttcttggtgcagtgggtgtggaaccccatcctcagctactgctccggccccaacgcgctcgaccagtagccgccgccgccgccacgcacgaacgcagtgttcgtccgcccatggattcggattccttttcttgggaatccatggtagctttaaattcttgtatagatcgagccggtgaagtgaacaagggtggcgatgtttggggttttgggtgactttgggtgaatggatggtatgtttgggggagactgtttggaactttgagattattttgcttaccaccatggctcaaatgctcaattcgtttgtttgagttcgttcttcttgaactaagtttgaattcgactcagcaatttggcattgcaacaggtaaaatttcatgagaattttggaagctagacatgggcatggccgcattggcaaaacagtcacagttcaaacgatgttgagatggtcgttgattgacaggcggccattaatcacgggattaattgatgccggggattgaaaacaagatgagattgatgatgcccgtgagtgtgagttgtggcaatgattcatgggcaattgcggtttttgttgtgtagcgcaggcacaagcacaacactaggcagtagtgtgtgtaggcattcagctgaacacagctggttctgtttctgtttctctcttctcttctaactactgcactaacactgcttcgtgtagtagtgtactaggtctgtgtttacatccaaacaaacttcagtccttttccattacatcaatatgtcatacacacacaacttttcagtcacatcatctctaattttaaccaaaattcaaactttgtgttgaa

SEQ ID NO: 1360 - DNA, 1341 bp, Oryza sativa
ttcttcctctttctctctataaatcttttcccgagccaagaaaaccaccattaaacccaccaccaccgccacctcctccacctccatggcgatggcgatgcaccggttcagcctctgctgcgtcgtcctcctcgtgctcgcgccgctcgccgccgtcgcgtggcggccgtggccgccacggaatgggagcggcgaggttgaggggatcggggcgtccaagaagttcgaggggtcgtcggatttcgtcaagctgcagtaccacatgggccccgtcctcgccgccgacatcacggtccacccgatctggtacggccggtggcccgccgagcagaagcgcaccatccgcgcgttcctccggtcgctctcgccgccgggctcgggctccggcgatggcggcatcccgtcgccgtccgtggcggcgtggtggcgcaccgtgcggctgtacaccgaccagacctcggcgaacgtgtccggggtggtgaggctcgggcgggagaagtgcgacgcgcgcgcgtcgcggggcgggcggctgacgcggctcgacatccagtccgtggtgcgggacgccgtgacggcgcggacgcggccgctccccgtggactcgagcggcgtgtacctggtgctgacctcgccggaggtggtggtggagaacttctgcgggcaggtgtgcggcttccactacttcacgttcccgtcggtggtcgggtacacgctgccgtacgcgtgggtggggaactcggcggcgcggtgcccggaggtgtgcgcgtacccgttcgccatcccgtcgtacgtgggcggggggcggagggcggaggcgccgccgaacggcgacgtgggcgtggacgggatggtgagcgtcatcgcgcacgagctggccgagctggcgtcgaacccgctcgccaacgcgtggtacgccggcgaggacccgtcgttcccgacggagatcgccgacctgtgcgaggggatctacggcaccggcggcggcggcgcgtacaccggccagctgctcaccgacggccgctccggcgcgtcgtacaacgtcaacggcgtcggcggccgcaagttcttggtgcagtgggtgtggaaccccatcctcagctactgctccggccccaacgcgctcgaccagtagccgccgccgccgccacgcacgaacgcagtgttcgtccgcccatggattcggattccttttcttgggaatccatggtagctttaaattcttgtatagatcgagccggtgaagtgaacaagggtggcgatgtttggggttttgggtgactttgggtgaatggatggtatgtttgggggagactgtttggaactttgagattattttgctta

SEQ ID NO: 1361 - DNA, 1410 bp, Triticum aestivum
cgttccccaccctctataaagcatccccggccaagaacctccggtaaagtaaaccaggcgacattcccctcgaagccagccgagatgccgcaccgcggcgccgtcctcgtgttcgtcctcgccctcgcggcggcgccgctcgccgtggcgtggcgcccgtggccgccgcgcgacgccagcggcgccctggccggcctcggcgcgtccaagaagttcgaggggtcgtccgacttcgtcaagctcgagtaccacatgggccccgtcctcgccgccgacatcaccgtccacccgatctggtacggcgcctggcccgccgagcagaagcgcaccatccgcgccttcctgcgctccctctcgccgcaggcctccggggagaaggagggcgccgtcccgtcgccgtcggtggcggactggtggcgcaccgtccggctctacacggaccagaccacggcgaacgtgtcggccgtggtggcgctcggccaggagaagtgcgacgcgcggatgtcgcggggggcctcgctgtcccggatggacatccagaccgttgtcaaggacgcggtgaccgcgcgcaccaggccgctgcccgtggacgccgggggggtgtacctggtgctgacgtcgccggaggtgcgcgtggagaacttctgcgggcaggtgtgcggcttccactacttcaccttcccgtcggtggtcgggtacacgctcccctacgcgtgggtgggcaactcggcggggcggtgcccggaggtgtgcgcctacccgttcgccatcccggcctacgtgccggggcggcggcccgaggcgccgcccaacggcgacccgggggtggacggcatggtgagcgtcatcgcgcacgagctggcggagatggcgtccaacccgctggccaacgcgtggtacgccggcggggacccctccttccccaccgagatcgccgacctctgcgagggcatctacggcaccggcggcggcggcgcgtacaccggccagctgctcaccgacgggcggtccggcgcgtcctacaacctcaacggcgtcggcgggcgcaggttcctggtgcagtgggtctgggacccctaccgcagctactgctccggccccaacgcgctcgaccagcactagcactagcgtctctttcgtctcaccgccgccgcaccctcgccgcatctagcgtagcgctagcggtagtagtgttcctccttcctccggcattggattccttcctcgggacatccatggccggccatgggagcgtttcctctctcttgtatagagtcagtgagccgaagaagcatggtggtccgatccggtgagcccagtggctggctcatggttggtatgcctgcgtgcggacaatgttttggatgttcaaatttgatgacattttgtccaaaaaaaaaaaaaaaacga

SEQ ID NO: 1362 - DNA, 2019 bp, Sorghum bicolor
aacaagtccaaaggagacgccccggccaagaacaaacagtgctctccctctccctggccctgctgcctgcttcctctccactccacagtctcgcactctgtcgctcagctccgttcccctccatttcccttcttctccctataaagctccgtccccagccaagaaggcagccttaaacctccactacccccatccccaagcgcctcgccgcaatgcagcatctgggcgtgctcctcgtcttggctgcactcaccgcgtcgccgctcgctgcggcgtggcgcccgtggccgccgcgcgccaacgggacgacggcggggctgggcgcttcaaagaagttcgagggctcgtcggagttcgtgaagctagagtaccacatgggtcccgtcctggcgtccgccatcacggtgcacccgatctggtatggcgcctggcccgccgcgcagaagcgcacgatccgcgcgttcctccgctccctcgcgccaccgcccgactcgtcggcccgcatccctcctccgtcggtctccgcctggtggcgcacggtgcggctctacacggaccagacctccgccaacgtgtcggcggccgtgaccctgggcgcggagaagtgcgacgcgcgcatgtcccgcggcgcgcgtctctcccggatggacatccagtccgtggtccgcgacgcggtcacggcgcgcacccgcccgctccccgtcgactccagcggcggcgtgtacctggtgctcacctccccggacgtctccgtggaggacttctgcgggcaggtgtgcggcttccactacttcacgtttccgtcggtggtcggctacacgctgccctacgcgtgggtcgggaactcggcgcggcggtgccccgaggtgtgcgcgtacccgttcgcgatcccgtcgtatgtccccgggcggaaggcggaggcgccgccgaacggggacgtcggcgtggacgggatggtcagcgtcatcgcgcacgagctggccgagctcgcgtccaacccgctcgccaacgcgtggtacgctgggagtgacccctcgttcccgaccgagatcgctgacctctgcgaggggatctacggcaccggcggcggtggcgcgtacaccgggcagctcctcacggatgcgcgctccggcgcggcgtataacgttaatggcgtcggtggccggaggttcctcgtgcagtgggtttggaaccccgtgctcagctactgctccggccccaacgcgctcgaccagtagcagattcgactagctgttcttgctgctgttccggtttcatttcatctgcttgaaatgaaatggaattttgccatccgttgtcattgtgcaaaggatgatgattctgctctgcctctagtgcattggatttccttgctctggaaatccatgggatgtttctgtatagagttgttattattaatggcacgtttgatggggggagaaagaaggtggtggtgatgactgatgagcaggaggaggatggcaatggcatgtcttatgaggtgaattttggaactttttattattaatagtaagatttacctgtttaccatctgaccgtggttcgtttgaatttgaaattgagattttttctgtagcctgtaggacgggggtaaaactgtcagggttacttggctttaaggggagaaggctattgtagctactgccttggcttttactagtgcagtacagtcgcagcatgatggcttttgtacagagtggttggctttgctgtttgctccatgctctctcaaatgatggtactaacaacagcattgcaggacggtgcaagcaatgctccacagtacacactcactctaccgcacagcaaaaaagacaaggctgtgctgtgagcctgtgactgtgagctactaccccttgtactaatctctgacacgtagtggtaggctgatagccgctaatcacggaatcagtttacttgtgcagtgcgatgcaatgccatgcaatgcaacagcagtagagtataggggttactgatgattcagggatcggagggcag

SEQ ID NO: 1363 - DNA, 1616 bp, Sorghum bicolor
cacagtctcgcactctgtcgctcagctccgttcccctccatttcccttcttctccctataaagctccgtccccagccaagaaggcagccttaaacctccactacccccatccccaagcgcctcgccgcaatgcagcatctgggcgtgctcctcgtcttggctgcactcaccgcgtcgccgctcgctgcggcgtggcgcccgtggccgccgcgcgccaacgggacgacggcggggctgggcgcttcaaagaagttcgagggctcgtcggagttcgtgaagctagagtaccacatgggtcccgtcctggcgtccgccatcacggtgcacccgatctggtatggcgcctggcccgccgcgcagaagcgcacgatccgcgcgttcctccgctccctcgcgccaccgcccgactcgtcggcccgcatccctcctccgtcggtctccgcctggtggcgcacggtgcggctctacacggaccagacctccgccaacgtgtcggcggccgtgaccctgggcgcggagaagtgcgacgcgcgcatgtcccgcggcgcgcgtctctcccggatggacatccagtccgtggtccgcgacgcggtcacggcgcgcacccgcccgctccccgtcgactccagcggcggcgtgtacctggtgctcacctccccggacgtctccgtggaggacttctgcgggcaggtgtgcggcttccactacttcacgtttccgtcggtggtcggctacacgctgccctacgcgtgggtcgggaactcggcgcggcggtgccccgaggtgtgcgcgtacccgttcgcgatcccgtcgtatgtccccgggcggaaggcggaggcgccgccgaacggggacgtcggcgtggacgggatggtcagcgtcatcgcgcacgagctggccgagctcgcgtccaacccgctcgccaacgcgtggtacgctgggagtgacccctcgttcccgaccgagatcgctgacctctgcgaggggatctacggcaccggcggcggtggcgcgtacaccgggcagctcctcacggatgcgcgctccggcgcggcgtataacgttaatggcgtcggtggccggaggttcctcgtgcagtgggtttggaaccccgtgctcagctactgctccggccccaacgcgctcgaccagtagcagattcgactagctgttcttgctgctgttccggtttcatttcatctgcttgaaatgaaatggaattttgccatccgttgtcattgtgcaaaggatgatgattctgctctgcctctagtgcattggatttccttgctctggaaatccatgggatgtttctgtatagagttgttattattaatggcacgtttgatggggggagaaagaaggtggtggtgatgactgatgagcaggaggaggatggcaatggcatgtcttatgaggtgaattttggaactttttattattaatagtaagatttacctgtttaccatctgaccgtggttcgtttgaatttgaaattgagattttttctgtagcctgtaggacgggggtaaaactgtcagggttacttggctttaaggggagaaggctattgtagctactgccttggcttttactagtgcagtacagtcgcagca

SEQ ID NO: 1364 - DNA, 1401 bp, Triticum aestivum
tcgccctcgcggcggcgccgctcgccgtggcgtggcgcccgtggccgccgcgcgacgccagcggcgccctggccggcctcggcgcgtccaagaagttcgaggggtcgtccgacttcgtcaagctcgagtaccacatgggccccgtcctcgccgccgacatcaccgtccacccgatctggtacggcgcctggcccgccgagcagaagcgcaccatccgcgccttcctgcgctccctctcgccgcaggcctccggggagaaggagggcgccgtcccgtcgccgtcggtggcggactggtggcgcaccgtccggctctacacggaccagaccacggcgaacgtgtcggccgtggtggcgctcggccaggagaagtgcgacgcgcggatgtcgcggggggcctcgctgtcccggatggacatccagaccgttgtcaaggacgcggtgaccgcgcgcaccaggccgctgcccgtggacgccgggggggtgtacctggtgctgacgtcgccggaggtccgcgtggagaacttctgcgggcaggtgtgcggcttccactacttcaccttcccgtccgtggtcgggtacacgctcccctacgcgtgggtgggcaactcggcggggcggtgcccggaggtgtgcgcctacccgttcgccatcccggcctacgtgccggggcggcggcccgaggcgccgcccaacggcgacgcgggggtggacggcatggtgagcgtcatcgcgcacgagctggcggagatggcgtccaacccgctggccaacgcgtggtacgccggcggggacccctccttccccaccgagatcgccgacctctgcgagggcatctacggcaccggcggcggcggcgcgtacaccggccagctgctcaccgacgggcggtccggcgcgtcctacaacctcaacggcgtcggcgggcgcaggttcctggtgcagtgggtctgggacccctaccgcagctactgctccggccccaacgcgctcgaccagcactagcactagcgtctctttcgtctcaccgccgccgcaccctcgccgcatctagcgtagcgctagcggtagtagtgttcctccttcctccggcattggattccttcctcgggacatccatggccggccatgggagcgtttcctctctcttgtatagagtcagtgagccgaagaagcatggtggtccgatccggtgagcccagtggctggctcatggttggtatgcctgcgtgcggacaatgttttggatgttcaaatttgatgtcattttgtccatttccccgctcggtttcgttcaaatttgattagcattactacgtagcatgtttgaaacatgtagaacattgggagtacaattattgcagacgaggccgcttcgatctgcatgaaaatctggttgaac

SEQ ID NO: 1365 - DNA, 1615 bp, Setaria italica
gaacaaacagtgcctctgcctcctgtccacccactctcactccacagtctcactcactccctctgtcactcactcacagctccgtttccccgtttcttcctataaagcttccccccggtccggtcccaggccaagaaccccgccataaaccaccaccaccaccccgcgctcgccgcaatgcagatgcggcacctcggcctcctcctcctcgtcgcggccctcctcgccgcgccgcccgccgtgtcggcgtggcgtccgtggcctccgcggaacgagacgggcggcggcgcggcgtcgggtctcggcgcgtcgaagaagttcgaggggtcgtcggagttcgtgaagctgcagtaccacatgggcccggtccttgcgacggccatcaccgtgcacccgatctggtacgggccctggccggtggagcagaagcggaccatccgcgcgttcctccgctccctcgcgccgccgccggaggaggaggcccggatcccgcggccctccgtggccgcgtggtggcgcacggtccggctgtacacggaccagaccgacgccaacgtgtcggcggcggtgtcgctgggtgcggagaagtcggacgcgcgcatgtcccgcggtgcgcggctgtcgaggatggacatccaggcggtggtccgcgacgcggtgggcgcgcgcacccggcccctccccgtggactccggcggtgtgtacctcgtcctcacctcgccggaggtggtggtggaggacttctgcgggcaggtctgcggcttccactacttcaccttcccgtccgtggtgggttacacgctcccctacgcgtgggtcgggaactcggcgcggcggtgcccggaggtgtgcgcgtacccgttcgccatcccggcgtacgtccacggccggaggcccgagtcgccgcccaacgccgacgtcggcgtcgacgggatggtcagcgtcatcgcgcacgagctggcggagctggcgtccaacccgctggccaacgcgtggtacgccgggacggacccgtcgttcccgacggagatcgcggacctctgcgaggggatctacgggaccggcggcggcggcgcgtacacggggcagctgctgacggacgcgcggtcgggggcagcgtacaacgtgaacggcgccggcgggcgcaggttcctcgtgcagtgggtgtggaaccccgtgctcagctactgctccggacccaacgcgctcgaccagtagcgagcggtggccagctcgcgtcttcgtcgtccgaggacgcgccgccgatggatggatggaagatggatccatcatccatcatctatagtacgtagtgttgggcctccatggatttggtttcctcgctcgggaaatgaaatccgtggaatgtttttgtatagttttctattggagtgaagtgaggtggggagcacggggtgggcaatggcatgtcaagtttgaggagacttttggaatttgaagatttatttaaattttgagcatttgtttcggcctcggttcgtttgaatttggttcatctcatcatttgggttgattttcttgggagagccggggcaaaactgtcagcgagtaacagttgtgtacttgaagatcatcatcactatcactttactag

SEQ ID NO: 1366 - DNA, 1520 bp, Panicum virgatum
ctgcctcctctcctctccactcactctcgctcactctgtcactcacaactccatgcctccatttccccctttcttcctataaagcgtctcggtcccgggccgagaaacccgccataaaccgccgccgccgccgcctcctcgccgcaatgcagatgcggcgcctcgccgcgctcctcgtcgcggccctcctcgccgcgccgcccgccgtcgcggcgtggcgcccgtggcctccgccgcgcaacggcacggcggtggaggggctcggcgcgtccaagaagttcgaggggtcgtccgagttcgtgaagctgcagtaccacatgggccccgtcctggcggcgtccatcacggtgcacccgatctggtacggcccctggccggcgccgcagaagcgcaccatccgcgccttcctccgctccctcgcgccgccgccggcggaggaggcccggatcccgcgcccctccgtggcggcgtggtggcgcaccgtgcggctgtacacggaccagaccggcgccaacgtgtcggcggcggtgtccctgggcgccgagaagtcggacgcgcgcatgtcccgcggcgcgcgcctgtcgcggatggacatccaggccgtggtccgcgacgccgtggccgcgcgcactcgcccgctccccgtcgacgccggcggcgtctacctcgtgctcacctcgccggaggtgctggtggaggacttctgcgggcaggtctgcggcttccactacttcaccttcccgtccgtggtgggctacacgctcccgtacgcgtgggtggggaactcggcgcggcggtgcccggaggtgtgcgcgtacccgttcgccatcccggcgtacgtgccggggcggaggcccgagtcgccgcccaacgccgacgtcggcgtcgacgggatggtgagcgtcatcgcgcacgagctggcggagctggcgtccaacccgctggccaacgcgtggtacgcggggacggacccgtcgttcccgacggagatcgccgacctctgcgagggcatctacggcaccggcggcggcggcgcgtacacggggcagctgctgacggacgcgcgctccggcgccgcgtacaacgtcaacggcgccggcgggcgccggttcctcgtgcagtgggtgtggaaccccgtgctcagctactgctccggccccaatgcgctcgaccaggactagctagctgctggagttgcatcggattgatggtctgcttgctgatgcatcatccatcgccgtctaggccgtgtttggtttaggctaaaaaaattcgcaatttttttacttttgactactaatttacagtattaaataaagtctaattacaaaatcacttgccgtacttctgataaattcgagagaccaatctaatgatgtttttgaccgcacgattagaagatgattactgtagcatactgtagttaaatatggattaattaccgttattagattcgtctcgaaaagttatatccatccgtgaaaaaattttgtaaataaactttgtttagtattccatgt

SEQ ID NO: 1367 - DNA, 1440 bp, Saccharum officinarum
cgctctcgctcagctccgttcccctccatttctcttcttcctataaagctccgtcaccagccaagaagccagccttaaacctccactacccccagcaggccagccccaccaagcctcgccgcaatgcagcagcacctctgcgtgctcctcgtcctggcggcactcactgcgtcgccgctcgctgcggcgtggcgcccgtggccgccgcgcgacaacgcgacgacggcggcgggcctgggcgcgtcgaagaagttcgagggctcgtcggagttcgtgaagctggagtaccacatgggtcccgtcctggcgtccgccatcacggtgcacccgatctggtacggcgcctggcccgccgcgcagaagcgcacgatccgcgcgttcctccgctccctggcgccaccgcccgactcggaggcccgcatccctcctccctcggtctccgcctggtggcgcacggtgcggctgtacaccgaccagaccttggcgaacgtgtcggcggccgtgtcgctgggcgcggagaagtgcgacgcgcgcatgtcccgcggcgcgcggctgtcccggatggacatccaggcggtggtccgcgacgcggtgacggcgcgcacccggccgctccccgtcgactccagcggcggcgtgtacctggtgctcacctccccggaggtgtccgtggaggacttctgcgggcaggtgtgcggcttccactacttcacgttcccgtcggtggtggggtacacgctgccctacgcgtgggtggggaactcggcgcggcggtgccccgaggtgtgcgcgtacccgttcgcgatcccggcgtacgtccccgggcggaagcccgaggccccgcccaacggcgacgtcggcgtggacgggatggtcagcgtcatcgcgcacgagctcgcggagctggcgtcgaacccgctcgccaacgcctggtacgccgggagtgacccctcgttcccgaccgagatcgctgacctctgcgaggggatctacggcaccggcggcggcggggcgtataccgggcagctcctcacggacgcccgctccggcgcggcgtataacgtcaatggcgccggtgggcggaggttcctcgtgcagtgggtttggaaccccgtgctcagctactggtccggccccaacgcgctcgaccagtaggggatcgggattaccatccagcaaacagggtgctagtggtgtctgtttgcctgtttcatttcatctgatgaaatgaaattaccatccattgtctttgtgcaaggatgggtgatctgttctgcatctggtgcattggatttcccgaaatccatgggatgcttctgtatagagttattattaatgccacgtttggtgaaggaaggtggtgatggtgagcagggggatggcaatggcatgtctgataaaatgaattttggaattggaacttaaggtggtgtttaaatc

SEQ ID NO: 1368 - DNA, 1609 bp, Brachypodium distachyon
caccagcatcgaaaaggttgggaactccaaaagcgcccaagccaagagcagcagcgtctcactctccactctcacactcacactcctccatggccacctccattcccatcttcctataaaacttcccctgccgccgcacaacccagccgcccacaatgccttcccctccggctccgcccgcaatgcgctgcctcttcttcttcctcctcgcggcgccgctcgcaagcgcgtggcgtccatggccgccgcgcaacggcagcagcaacgccgcgtccggcatcggcgtgtcgaagaagttcgagggctcgtcagacttcgtgaagctggagtaccacatgggcccggtgctggcggccgacatcaccgtccacccgatctggtacggcgcctggccggcaacccagaagcgcaccatccgggccttcctccgctccctctcgccggaggcccagagcgccgccgccatcccttccccctccgtcgccgcctggtggcgcaccgtccgcctctacgccgaccaaaccgacgccaacgtgtccgccgtcgtcaacctcggccaggaaaaatcggacacccggatgtcccggggagcgtccttaacccggctcgacatccagcgggtgatccacgacgcggtcaccgcgcgcacgaagccgctgcccgtcgactcctccggcggactctacctggtgctaacctccccggaagtccacgtggagaccttctgcgggcaagtctgcggtttccactacttcaccttcccttccatcgtcggctacacgctcccctacgcctgggtcggcaactccgccgcccgctgcccggagatctgcgcctacccgttcgccatcccgagttacgtagcgaacggccggaagccggagatggcgccgaacggggacgtgggcgtggacgggatggtgagcgtgatcgcgcacgagctggcggaggcggcgtcgaacccgctggccaacgcgtggtacgccggcggcgacccctcgttcccgaccgagatcgcggatttgtgcgaggggatttatgggacgggcggtgggggagcgtatactgggcagctgcttactgatgggaggtctggagctgcgtataatgttaatggcgttaggggcaggaggttcttggttcagtgggtctgggatccttaccggagctactgctccggccccaacgcgctcgatcaccagtagacttggcgccgtgtgtagcgcgtcgagtagtagtagtaaggagtagtgttgtttccgccatggatggaatggaggggttccttcctcgggacatctatctccattcatggccatgggagcgttttcttgtatagagtcagtgagctgaactgaagcagagatggcgagtcgggctggtctttttgggggggacggacggatggtggtaatgtcagctgagactgttttggatctttggaatttgatgatggtcttttgtctatcagcgtgttcttatcgctcgaaattgtttgttgcgagcaatagttgaggacagagattttgcaggtaggagttcaccagtctccatggaaatcctggaaattagacaatcaattgcacaaatgcagtacagagctgcatgt

SEQ ID NO: 1369 - DNA, 1494 bp, Hordeum vulgare
gaaaccccagaagcgccaaggcaagagcactgtcccgtgtcttcctctccactccactccacactcccactccacacccccactctccctccatggattttacagtctcaccaccaccgtcccccaccttctataaagcatccggggccaagaacctccggtaaaccgcgcgtcattcccctccagccagccgagatgccgcagcgcggcggcgcccccctcctcctcctcctcgccctcgccgcggcgccgctcgccatggcgtggcgcccgtggccgccgcgcgacgccgtggccgccctcggcgcgtccaagaagttcgaggggtcgtccgacctcgtcaagctcgagtaccacatgggccccgtcctcgccgccgacatcaccgtccacccgatctggtacggcgcctggccggccgaccagaagcgcaccatccgcgccttcctccgctccctctcgccgcagtcccccgtcccgtccccgtccgtcgcggactggtggcgcaccgtccggctctacacggaccagaccacggccaacgtgtcggccgtggtggcgctcgggcaggagaagtgcgacgtgcggatgtcgcggggcgcgtcgctgtcgaggatggacatccagtccgtggtgaaggacgcggtgaccgcgcgcaccaggccgctcccggtggacgccggcggggtgtacctggtgctgacgtccccggaggtgcgcgtggagagcttctgcgggcaggtgtgcgggttccactacttcaccttcccgtcggtggtcgggtacacgctgccgtacgcgtgggtgggcaactcggcggggcggtgcccggaggtgtgcgcgtacccgttcgccatcccggcgtacgtgccggggcggcggcccgaggcgccgcccaacggcgacccaggcgtggacggcatggtgagcgtcatcgcgcacgagctggccgagatggcgtccaacccgctggccaacgcgtggtacgccggcggggacccgtcgttcccgacggagatcgccgacctctgcgagggcatctacggcaccggcggcggcggcgcgtacacggggcagctgctcaccgacggccggtccggcgcgtcctacaacctgaacggcgtcggcgggcgccggttcctggtgcagtgggtctgggacccctaccgcagctactgctccggccccaacgcgctcgaccaccactagcttttcgtttctctttcaccatcgtcgccgcatctagcgctagcggtcgtcgtagtattcctccaactccagcatagcattggattccttcctcgggacatccatggccggtcctcctgtatagagttccgaagcatggtggtccggtcgccggtcagtgagctcatgatttgcggacgatgttttgggctttcattcaaattcgatgtcattttgtgcatctggataacatttgaagcatcgggagtaccaattattgggaatctggatgaacaaccattgcca

SEQ ID NO: 1370 - DNA, 1462 bp, Brachypodium distachyon
cgcccacaatgccttcccctccggctccgcccgcaatgcgctgcctcttcttcttcctcctcgcggcgccgctcgcaagcgcgtggcgtccatggccgccgcgcaacggcagcagcaacgccgcgtccggcatcggcgtgtcgaagaagttcgagggctcgtcagacttcgtgaagctggagtaccacatgggcccggtgctggcggccgacatcaccgtccacccgatctggtacggcgcctggccggcaacccagaagcgcaccatccgggccttcctccgctccctctcgccggaggcccagagcgccgccgccatcccttccccctccgtcgccgcctggtggcgcaccgtccgcctctacgccgaccaaaccgacgccaacgtgtccgccgtcgtcaacctcggccaggaaaaatcggacacccggatgtcccggggagcgtccttaacccggctcgacatccagcgggtgatccacgacgcggtcaccgcgcgcacgaagccgctgcccgtcgactcctccggcggactctacctggtgctaacctccccggaagtccacgtggagaccttctgcgggcaagtctgcggtttccactacttcaccttcccttccatcgtcggctacacgctcccctacgcctgggtcggcaactccgccgcccgctgcccggagatctgcgcctacccgttcgccatcccgagttacgtagcgaacggccggaagccggagatggcgccgaacggggacgtgggcgtggacgggatggtgagcgtgatcgcgcacgagctggcggaggcggcgtcgaacccgctggccaacgcgtggtacgccggcggcgacccctcgttcccgaccgagatcgcggatttgtgcgaggggatttatgggacgggcggtgggggagcgtatactgggcagctgcttactgatgggaggtctggagctgcgtataatgttaatggcgttaggggcaggaggttcttggttcagtgggtctgggatccttaccggagctactgctccggccccaacgcgctcgatcaccagtagacttggcgccgtgtgtagcgcgtcgagtagtagtagtaaggagtagtgttgtttccgccatggatggaatggaggggttccttcctcgggacatctatctccattcatggccatgggagcgttttcttgtatagagtcagtgagctgaactgaagcagagatggcgagtcgggctggtctttttgggggggacggacggatggtggtaatgtcagctgagactgttttggatctttggaatttgatgatggtcttttgtctatcagcgtgttcttatcgctcgaaattgtttgttgcgagcaatagttgaggacagagattttgcaggtaggagttcaccagtctccatggaaatcctggaaattagacaatcaattgcacaaatgcagtacagagctgcatgt

SEQ ID NO: 1371 - DNA, 1399 bp, Triticum aestivum
aagctaagcaatcaccagaactcacgcacgcacacgaagaacacagaaaccagaggagcataaacaagatttcgaagatgcaagcattcctcgcctattcgatccttacgaatccatgctcgagatccttcttcccgcgtccagcaacgcgaccgcagttcctcctgtcctcggttccggcagcgaggactagtgctgctgccaccgcaagaagatgcggtgggccgggccggagcgtggtgaccgcggcgtcatcgtccccggcagtggtcaccgcggcgacggacgttccggggacgatgaaggcttgggcgtacgaagagtacggggacgccagcgtgctcaagctcgacgaggccgtgtcggtgccggcggtgggcgaggaccaggtgctggtccgggtggctgccgcggcgctcaaccccgtcgattccaagcggcgtatgggcaagttcaaggccaccgactccccactcccgactgtgccagggtacgacatggccggagtggtcgtcaaggtcggcagccaggtgaagaacctcaaggaaggcgacgaggtgtacggccacatcagcgagaaggtcctcgagggacccaagcagttcggctcgctggcagagtacaccgccgtggaggagaagctggtggcgctcaagcccaagagcatcgacttcgcgcaggccgccggtctgccgctcgccatcgagaccgcccatgagggcctcgagagagcaggcttctccgccggcaagtccatccttgtcctcggcggcgccggcggagtcgggacccttgtcatccagctggcaaagcaagtttacggcgcatcgaaagtggcggccacagccagcaccccaaagctggagctcctgaaaagcctgggagccgacgtcgccattgattacaccaaggagaacttcgaggacatgccggagaagtacgacgtcgtgttcgacgcagtcggccagggcgagaaggcggtcaaggtggtgaaggaaggcggcagcgtggtggtcctcacaggcgcggtcgcgcctccggggttccggttcgtggtcacctccgacgggtccgtcctggcgaagctcaacccttacctcgagtccgggaaggtgaagccggtggtcgaccccaaggggcccttccccttctcccaggtcgtggaggcgttttcttaccttgagaccgggcgagccaccggcaaagtagtcatttcgcctgttccatgagacactgctgtaaatagctagcacaggtgatgtatttttgtcacggattactgagcaaatatttgttggatcgtgagtataaacagaaaaggatgtgatgttatcagagatggtggtaggttcctggagtattactacaatgaacagaaatctgtagtatttgttcaatc

SEQ ID NO: 1372 - DNA, 1611 bp, Triticum aestivum
acaaccagctgaactttctccttccttcgatcacaaacgcaaatctcaaccagatcctcccgcagccggtcccggccttttatccccagccattccccgccactcccagctgccacagcggataactgaagctaagcaatcaccagaactcacgcacgcacacgaagaacacagaaaccagaggagcataaaaaagatttcgaagatgcaagcattcctcgcctactcgatccttacgaatccatgctcgagatccttcttcccgcgtccagcaacgcgacctcagttcctcctgtcctcggttccggcagcgaggacgggtgctgctgccaccgcaagaagatgcggtgggccgggccggagcgtggtgaccgcggcgtcatcgtccccggcggtggccgccgtggcgacggacgttcccgggacgatgaaggcctgggcgtacgaagagtatggggacgccagcgtgctcaagctcgacgaggccgtgtcggtgccggcggtgggcgaggaccaggtgctggtccgggtggcagccgcggcgctcaaccccgtcgattccaagcggcgtatgggcaagttcaaggccaccgactccccactcccgactgtgccagggtacgacatggccggagtggtcgtcaaggtcggcagccaggtgaaaaacctcaaggaaggcgacgaggtgtacggccacatcagcgagaaggtcctcgagggacccaagcagttcggctcgctggcagagtacaccgccgtggaggagaagctggtggcgctcaagcccaagagcatcgacttcgcgcaggccgccggtctgccgctcgccatcgagaccgcccatgagggcctcgagagggcgggcttctccgccggcaagtccatccttgtcctcggcggcgccggcggagtcgggacccttgtcatccagctggcgaagcaagtttacggcgcgtcgaaggtggcggccacggccagcaccccgaagctggagctcctgaaaagcctgggagccgacgtggccatcgactacaccaaggagaacttcgaggacatgccggagaagtacgacgtcgtgttcgacgcagtcggccagggcgagaaggcggtcaaggtggtgaaggaaggcggcagcgtggtggtgctcaccggcgcggtcgcgcccccggggttccggttcgtggtcacctccgacgggtccgtcctggcgaagctcaacccttacctcgagtccgggaaggtgaagccggtggtcgaccccaaggggcccttccccttctcccaggtcgtggaggcgttttcctacctcgagaccgggcgagccaccggcaaagtagtcatttcacctgttccatgagacactgctgtaaatagctagcacaagtgatgtgtttttgtcacagattactgagcaaatatttgttggatcgtgcgtataaacagaaaaagatgtgatgttatcagagatggcggtaggttcatggtgtatttactacaatgaacataaatctgtagtatttgttcaatctgtacctgacattttaccattcagttatgtttctgatagttcaaaaggctacagagggttgtactgctttcctgaatttccaa

SEQ ID NO: 1373 - DNA, 1407 bp, Zea mays
gcacgcttggttaaactccgggcgatggccgagcaaggacgcacccgggattggacctatcgacggtggcagcccgcagcccatcggtttcgccgaccggcgcctcgttcgcatcgactccacctcctcctcctcgcacgctataaactagactagagcaatacccgtggtggatgttccaccgcctgctccgccgcgcgatgccgctcccgccgccgcagtccccgcttcctgctccccggatgccgggggtcaccggcgggcgcctcttcgcttcgctgccgtcgccgccgcccctccagtctcgaagagaggtgcatgtgtggtatcttttgcctgatgagttgaaggatgcctcccaactcaagatgtacacggagctcctttccccttctgaaaggaagactgctttgtctatgaacggggaaaagttgcagaaaggtgccgtgctgtcccgtgcactgctgcgcaccaccctctcgagatatacagattgcaaagttgatccaagatcatttgagtttaagaaaaacaagtttggcaaacctgaggtactgtggcgatctgatgacagcaggatggaatggcctttacatttcaatatttcacacacatcatctttgattgtctgtggcataaccatggatactcctattggcattgacgttgaagagaagacacgaaagacagccaagaatattttatctcttgctcgccgttatttcaccccatctgaaattgattatctagctaaaattccagatcctgatgctcagcaaaaggagttcgtaaaactatggactcttaaagaagcatatgtaaaagctcttggaagggggttttcaggcgcccctttcaacaaattctcgattatattggcagcaaatggcagaatccaaatttctgtggcaccaaaagtatcgaacggttctgactctatccatgactgtctgtccgagaattggcagtttgcacttgctgaactaaacagttctcattacatggcaatctgtatagaggatgactcaacaagttcagattctggaaacggtagactgccactaggattgaaagtatggaagaccactccgttcgtggaagatatacttgtttctggaacggaagctgtaaaacttgtcagttaagtatgtgagaggatatctgccattggtcaagtgatttcgccagatgacaatgtgatgcaacgaatgtatttggacgaagtatgcgctgtgcagggaggctgaacggttttcttcgagcatactgcatgcattgatgaactgaccactgacactgtgtgctttagttaagatttggaaatgcaatgacatacactttggagtcctgatattcatattagcatatcacgacactgtttcgaaaggaataaacatttatctctct

SEQ ID NO: 1374 - DNA, 1230 bp, Saccharum officinarum
ccgtcgccgacgacggggcaacactgctggagatcaagaaatccctcgccgtcatccccgtctcctgctccccggacgccgggggttgccggcggacgcctcttcgcttcgctcccgccgccgccgccgccccggtctcggagagaggtgcatgtttggtatcttttgcctgatgagttgaatgatgcctcccaactgaagatgtacacggagctcctttccccttctgagaggaagactgctttatctatgaatggggaaaagttgcagaaaggtgctgtgctgtcccgtgcactggtgcgcaccaccctctcgagatatacagattgcaaagttgatccaagatcatttgagtttaagaaaaacaagtttggcaaacctgagatactgtggcgatctgatgacagcaggatggaacggcctttgcatttcaatatttcacacacatcttctttgattgcctgtggcataaccatgggtactcctattggcattgacattgaagacaagaaacgaaagacagccaagaatattttatctcttgctcgccgttatttcaccccatctgaaattgattatttagctaaaattccagatcctgatggtcagcaaaaggagttcataaaactatggactcttaaagaagcatatgtaaaagctcttggaagggggttttcaggcgctcctttcaacaaattctcgatcatattggcagcaaataacagaatcaaaatttctgtggcaccaaaagtatccaacgattctgattctaagtgtgactgtctgtccgagaattggcaatttgcagttgctgaactaaatagttctcattacatggcaatctgtatagaggatgactcgataagtcagattctgggaacggtagactgccactaggattgaaagtatggaagaccattccattcgttgaagatatacttgtttcgggaacagaagttgtaaaacttgtcagttgagtatgtgagtatgcagggagactgaacactcttcgagcattgatcaactgaccactgacattatgctgtacttaagatttagggaaatgcgcaacgacatatacacttcggagctctgatattattcatgtaaacttatcacgacactgtttcgatgtgtgtgtgtgtgtgtgtgtgtgtggcaattttagacgtattttctactttctactgattgctccgtgatgtcggcgtcatctgacggatcattgga

SEQ ID NO: 1375 - DNA, 1369 bp, Setaria italica
cccatcgtcgatgcgccacctcctgctccgccgccgcgcgatgccgctcccgccgccggcttcaccgcctccgccccggatgccgggggtcgccggcgcgcgcctcttctcctcgcttccgccgccgctgcccctccagtcgcgaagagaggtgcatgtttggtaccttctgcctgatgagctgaatgatgcctcccaactgaagatgtacatggacctcctttcgccttctgaaaggaaggctgctttggctatgaatggagaaaagtttcagaaaggtgcagtgctgtcccgtgcactggtgcgcaccacactctcgagatatacagattgcaaagttgatccaagatcatttgagtttaagaaaaacaaatttggcaaacctgagatactgtggcaacctgatgacaacaggatgggatggcctttgcatttcaatatttcacacacatcttctttaattgcctgtggcgtaaccatggatactcctattggcattgacattgaagagaagaaacggaagacaaaaaagaactttttatctcttgctcgccgttatttcaccccatctgaagttgattatctagataaaattccggatcctgatgctcagcaaaaggagttcataaaactatggactcttaaagaggcatatgttaaagctcttggaagggggttttcaggcgctcctttcaataagttctcaattgtattggcagcaaaaaatggaatccaaatttctgtggcaccaaaagtattcaatgattctgactcttgtgactgtttgtccgagaattggcaatttgcacttgcagagctaaataattctcattacatggcagtttgtgtagaagatgactcaagaagttcagattctgggaatggtcgtcggctacctctagcattgaaaatatggaagactgttccattcctagaggatacacttgtttctggaacagaagctgtaacacttatcagttagtatgtgagagtctgctattgccttatgatttcaccagattacaatgtgatgcaacgaattcatattttggagaagtatgcagggaaactctgaacattcttctagcattgattaacttattgctgacattgtgccttagtagggacttgggaaatgcaacagcatatatttcagagtccaggtattcatattaagactgtttattagctgtagcctatcacgacaaactattttggaaggaataaactgtataaaccatttgttaccgttgcaggcttatgtttattttcaactggttactcaaagaagtcaaaatattctgtctgatgtatcattggaaatgatacttgcatgtacatacttctataagtaacatttgaattagct

SEQ ID NO: 1376 - DNA, 1357 bp, Panicum virgatum
agcccgttggccgctcggtccgcgtgctataaaccaagcgccaagcgaagctcgctgccgatgcgccgccgcctgctccgccgcgcgatgccgctaccgccgcctacgcctcctgcgccccggacaccggggatcgccggcggacgcctcttctcctcactccggccgccgccgccgccgctccagtcccaaagagaggttcatgtttggtatcttttgcctgatgagttgaatgatgcctcccaactgaagatatacatggatctcctttcaccttctgaaaggaagaatgctttatctatgaatacggagaagttgcagaaaggtgctgtgctgtcccgtgcattagtgcgcaccacactctccagatatacagattgcaaagttgatccaggatcatttgagtttaagaaaaacaaatttggcaaacctgagatactgtggcaatctgatgacaacaagatagaatggcctttgcatttcaatatttcacacacatcttctttgattgcatgtggcataaccatggataatcctattggcattgacattgaagagaagaaacgaaagacagccaagaatattttatctcttgctcgacgttatttcaccccatctgaagttgattatctagctcagattccggatcccgatgctcagcaaaaggaattcataaaactgtggactcttaaactcttggaatgggattttcaggtgctcctttcaataagttctcaatcgaaatggaagcaaagaacggaatccgaatttctgtggcaccaaaagtattcaaggattctgactctacttgtgactgtttgtccgagaattggcaatttgcacttgcggagctaaatagttctcattacatggcagtttgtgtaggggatgactcaagaagttcagaatctgggaatggtcggctacctctaggattgaaagtatggaagactgttcccttcctagaagatacacttgtttctggaacagaagctttgactcgtatcgtttgagtatgtgagagtctggtattggccttatgatttcaccagatgacaatgcgatacacaatgaattcatattttgaagaagtatgcagggcaactctcaacattcttcaagcattgattagctgattgcagacatcatgcattagcggggacttgggaaatacaattttcatagtccatattcagattatgactgttattagctgtagcctaccacgacaaactgtttcggaaggaataaactgtttgtactgttgcagaattatgtatcatttgaaaagatactagtaacatgtataggcttctataagtaacattggaaatagatcttgtagtatttcattgca

SEQ ID NO: 1377 - DNA, 1711 bp, Setaria italica
cacgcggctgccctcatccactaggccggcgatccagcaaccgcccccagctccagcctggcggcgcgccgaccggcctgagcgtgcgccctgctccgccgttgacgacgagcatctacgagcagaggaggggagccggcatcgacgaagcggggagacgtcgggtcaccgggttgacccgcgggccgtcgggccagttttttcagcccgatgcgccagtgcctgctccgccgcgcgatgccgctgccgccaccgcctcctccccggacgccgggggtcaccggcgggcgtctcctttcctcgctctcgcccccgccgcggctccagtcccgaagagaggtgcacatttggtatctttcccctgatgagttgaatgacgcctcccaattgaagatgtacatggagctcctttccccttctgaaaggaagaatgctttgtccatgaatggggaaaatttgcagaaagttgctgtgctgtcccgtgcactggtgcgcaccaccctctcgagatatacagattgtaaaatcgatccaagattgtttgagtttaagaagaacaaatttggcaaacctgagatactgtggcgggctgatgatgataggatagagtggcctttgcatttcaatatttcgcacacatcgtctttgattgcctgtggagttactatggatgctcctattgggattgacattgaggagaagaaacgaaacacagccaagaatgttttatctcttgctgaccgttatttcaccccttctgaattcgatcatctagtcaaccttcctgatcctgatgctcagcaaaaggaattcatcaaactatggactcttaaagaagcatacgtaaaagctcttggaagagggttttcaggtgctcctttcaataaattctcaatcatattggcagctaataatggaattcaaatttctgtggaaccaaaagcactcaacgattccaactctagttgtgactgtctgtccgagaattggaaattcgcacttgctgagctatatggttcttattacatggcagcttgtatggaagatgactcgagaagttcaggttctgaagatgatcgatcaccactaggcttgaaagtatggaaaaccattccgttcttagaagacatacttgtttctggaacagaagctgtaaaatttatcagttgactgtgctagagtatatggcattgtgatatggatttgagccatttatggggagaagctctgatcatttttctggtattgaggggaaactgaccactgacgtcgcgctatagttggggctatggaaattcggcagcatatactctcaataaagacttcgttattagctgcaaggctaccacaacaacctgcttttgaagggacaaaccattcttttattgttactgtagcaggcttgcattcgactgattagtcaaggatgtcagcagttgctatctgacgtatttttggagttgcatctatatgtatggctagacttccacctttgaaaagttcggtgcagcatatcttgattcgaatgctgtacgaatcattgtggttctagaatgcatctttatgattggaatgtaacacgtaggctttcgatgctgtaatagaatgatgtcttgctgctgaggaatcagttaggattcctacgccgattgcagttgatgtagtacgttaacatttttcaatgaccaaattgcctctctcctgtgagccc

SEQ ID NO: 1378 - DNA, 2324 bp, Zea mays
gatcccatacattgccacttgtcggggaggagagtccggagctgagacggcgagctgcctagctccgttcctgctctatatctcagctcctccgttctgtcctgtggccccgagctgagctgccaaggatacgtacgtcttgagggaggctgccggtcgccctcttctctcgtcgacctcgtcggggttatgcggaggagcaggtcgtgcttgtcctgcgtgcccatggggacggcggcgctgcccattgagaaccacttcgtcgctccggctgcgctaccgtcggtgcccgcctcagattcagaggacggaggatttggcaagggcagcatagaccttggaggcctagaggtgcgccaggtcaccacgtttgccaaggtctggtccaccacacagggcggccaagacggcctcggcgccaccttcttcaagccctcgccggtgcccgccggcttctccgtgctcggccactacgcgcagcccaacaaccggcctctcttcggccacgtcctcgtcggccgggacacgtctggcgccggcggtgcgctcctcgccgcgccagtggactacgccctcgtctggtccagcccggacggcgccggccacttctggctccccacggctcccgagggctacaaggccgtcggcgtggtggtcacggccgcggcggacaagccttcacccgacgaggtccggtgcgtccgcgccgacttcaccgacgcgtgcgaggccgaggactcggtgtggagcagcgacaaggacggcttcagcgcgtccaccctgaggccggcggtccgcggcatcgaagcccgcggcgtgcacgctggcacgttcctcgcccagagcagcgcgacgccggcggcggcggcgggcgtgtcaacgacgctggcgtgtctgaagaacaacagcgcgagctacacgtcctccatgcccgacctggcccagctgaactccctcctggcggcctacgcgccgcacgtgtacctgcacccgaacgagccctacttcccgtcgtcggtggcgtggttcttcgagaacggcgcgctgatgtaccagaagggcagcagccagaccccgacgccggtggccgccgacgggtcgaacctcccgcagggcggcggcaacgacggcgggtactggctcgacctgccggcggacgggaaccagcgggagaaggccaagaggggagacctcgccggcgcgaaggtgtacgtgcaggcgaagccgatgctcggcgggacggtggccgacctcgcggtgtggatcttctacccgttcaacgggccggcgcgcgccaaggtcggcctcatcccgtcgatcccgctcggcgagatcggcgagcacgtcggcgactgggagcacgtgacgctgcgcgtcagcaacttctccggcgagctcctccggatgtacttctcgcagcacagcgcgggcacctgggtggacgcgtcgcggctggagtacctcgacggcggggacggcggcgggagcaggccggtggcatacgcgtcgctgcacgggcacgcgttctacccgaacgcggggacggtgctgcaggggaactcgggcctgggcatcgggatccggaacgactgcgccagagggagcaggctggacaccggcgcggggcggtgcgaggtggtgtcggcggagtacctcggcgtcaaggagccggcgtggctcgggttcgagcgcgagtggggcccgcgggatgagtacgacatcgggcgcgagatcaaccgcgccgctaggctcttgccacgttcggtgagggagcggctagccaagctggtggagaaggtgctcgtcggggagggcccgacggggcccaagatgcatggtaactggagaaacgacgagagggaagcctgattaaggcttcgtatccttaactgtacgattcgtgaggtatatacggatcagacggtttgcgattgaaaggatagcgtgctcattagaggagctaaaaggattggttgtgtcattgtgtgtgtgcgtgcctgcgtggcagtgtatttccatctcagctgtatgtaggcaacgactgctatgcaagcagtccttctgtgcaagcgtgcaagcaaatcatctcatccattagatcatgatccaaccgtaggtcatatttaacacttaaaccctttcaccaccagctcaataatctttataaaaaaaatcctaacaaaccatggttgtatctatggttggatcgtaatctaattgataaaatggtttgtttgcacgcttgcacagaaggactatttgcataacagtcgttgccgctgtatgtattcgataatgtgtagcattgtttggtttgctgttta

SEQ ID NO: 1379 - DNA, 1728 bp, Setaria italica
ccatcggcgagctgcctgctgcttgccttcttctcagtcggaccttttgccggagctatgcaaaggagcaagtcgtgcttgccttgcgtgcccatggggacggcggcgctgcccattgagaagcacttcgttcctccggttgcgctaccatcttggccagcctcagtttcagatggaggatttgcgaagggcagcatagaccttggaggcctagaagtgcgccaaatcaccacgttcgctaaggtctggtccaccacgcaaggtggagaggacggcgtcggcgccaccttcttcaagccctcgccggtccctgccggcttctccgtgctcggccactacgcgcagcccaacagccggcctctcttcggtcacgtgctcgtcgctcgggacacgtccggcaccggagcactccttgccgcgcccgtggactacaacctcgtctggtccagcccggacggcgccggccatttctggctccccacggctcctgatggttacaaggcggtcggcgcggtggtcacggccacgtctgacaagccttcgcccgacgaggtccggtgcgtccgcgccgacttcaccgacgcgtgcgagaccgagaagccggaactgagcaacagcgacaaggacggcttcagcgcggccactctgaggccggcggtccgtggcatcgacgcccgaggagtgcacgccggcacgttcctagctcagagcagcgtgacaccggcgaacgcctcgtcgctggcatgcctgaagaacaacagcgcgagttacacgtccgccatgcctgacctggctcaggtgaactccctcctcgcggcctacgcgccgcacgtgtacctgcacccgaacgaatcctacttcccttcgtcggcgacatggttcttcgagaacggcgcgctgctgtaccagaagggaagccagatcccgacgccggtggccgccgacgggtcgaacctcccgcaaggcggcggcaacgacggcgggtactggctcgacctgccggcggacaacaagcagagggagaaggtcaagaagagcgacctcgccagcgcgaaggtgtacgtgcaggcgaagccgatgctgggggggacggtgaccgacctcgccgtgtggatcttctacccgttcaacgggccggcgcgcgccaaggtcggcttcctcacgatcccgctgggcgagatcggcgagcacgtcggcgactgggagcacgtgacgctacgcgtgagcaacttctccggcgagctccgccggatgtacttctcgcagcacagcgcggggacgtgggtggaggcgtcgcagctggagtacctcgacgcgggagacggcgggaacaggccggtggcgtacgcgtcgcggcacgggcacgcgttgtacccgaaggcggggctggtgctgcagggcgactcgaggctgggcgtcgggatccggaacgacacctccagggggagcaggctggacaccggcggcgccgggcggtgcgaggtggtgtcggcggagtacctcggcgtcgcggagccggcgtggctcgggttcgagcgcgggtggggtccgaaggaggagtacgtcatcgggcgtgtgatcaaccgcgtggcgtggatcctgccgcgctcggtgagggagcggctggccaagctggtggagaaggtgttcgtcggcgatgggccgacggggcccaagatgcatggcaactggaggaacgacgagagggaggcccggtgaggcgcacat

SEQ ID NO: 1380 - DNA, 804 bp, Zea mays
atccaatcaaatcgagtggcgcacatattcgcaaccaccgcgcgcagcctccacctccatttctactctgcttcgtcgtcccaacaacccagccgtcatcagggcctctcttcccctcctctgcctcgaccgcccatagcctgctgcctggtagccatggaccgatccaagtcgtacgcgggcgggcgcatgcagatcgagccgtactacgacggaggcggcgcgcggccggacttccggtcctactcctacagcgccggcggcagcgggatggggacgtcgtcctacgcgtaccagtacgagtacggcggggcgggggcgggggcgggggaagagatgaagcggagcaagtcgaagcggcggtggctggcgctggcggacccggacatggagcgcaagcgccgggtggcggcgtacaaggcgtacggcgtggagggcaagatgaagggctccttccgcaagagcttcaagtggatcaaggaccgctacctaaacctcgtctacgggtggtcctgatcctcaaagtatatatactccatggttttggctctgcatgtttgcttgatatatcatatcatcatcctggattcatggtgagtacatgcatacagtatatatatcagagagagtgtgtgtgtttccatttttcttcttggttggctttgctagatgttgttgttggtgatctgatagtaccaatcagtcaagtgtattgatgagatgtaacccaaggggctgtttcagaccaaatcggtaaagacaaatccatcgttcaagtgataaacggcagggcgtgcgtggttg

SEQ ID NO: 1381 - DNA, 804 bp, Setaria italica
caccaaaaagcctccgcctccctccgtttcttctctgcttcgtcccaaccgtcgctgacctccctactaatcttcgcgctcgtctccctcccctccctcctccgctctcagtagcttgctcgtcgccaagaagagccaccagctggctgccatggaccggtccaagtcgtacgcgggcgggcgcatgcagatcgagccctactacggcggaggcgcgcggccggacttccggtcctactcgtacagcgccggcgggggcggcggtatggggatgtcgtcgtactcgtaccagtacgagtacggcggcggcgcggcaggggcggcggcggacggggacctgaagcggagcaagtcgtcgaagcggcggtggctggcgctaggggacccggacatggagcgcaagcggcgggtggcggcgtacaaggcctacgccgtggagggcaaggtgaagggctccttccgcaagagcttcaagtggatcaaggaccgctacctccacctcgtctacggatggtcctgatcgaaacaactcgcttcgatcgcgcatgtctctagttttggctgccttcttcgattctccctctctctgttcatgctttgcttcgatcatggtgagtacgagtgcatatcaacaaacggtataaacctttttcttttcttttgggagctttattggtagatgttgttcttgatgatgccaatgaaccagtcaagtgtctgatgatgatgatgatgatgtaaccaaatgaatgggtttgttgtttcgaattgttcttggatgaatcgatccatcgggtgatcaat

SEQ ID NO: 1382 - DNA, 913 bp, Panicum virgatum
ctccctccatttcttctctgcttcgtcctcccaacccgtcgctcagcacccgctacgaatcgcccagaaaagctctcctcctccgcctcgcccgccaagaatttgtggtatctgccatggaccggtccaagtcgtacgccggcgggcgcatgcagatcgagccgtactacggcagcggcggcggcgcgcggccggacttccggtcctactcgtacagcgccggcggcggcgtcggaggcgggatggggatgtcgtcgtactcgtaccagtacgagtacgggtacggcggcggcgcggcgggggcgggggcggcggcggacggggacctgaagcggagcaagtcgtcgaagcggcggtggctggcgctgggggacccggacttggatcgcaagcggcgggtggtggcgtacaaggcctacgccgtggagggcaaggtgaagggctccttccgcaagagcttcaagtggatcaaggaccgctacctccacctcgtctacggatggtcctgactcctgactcctgaagcaaatcagcagcagcaacctctagttttggctgcctcttcttcgattctctctccgttcaagtgttcatgcttgtttgcttgcttgcttcgatcatggtgagtacgacacgatcgagtaaatattagtaagaaacagtatacatacacattacacgctgcttcgattttccttctcctttttcgggggctttggtagtagatggtgtttgttcttgatcgatgatgatacttcaaacagtcgagtgttatatcccaaagaaaaaaaacaggtcaagttgtgtttgatggatgatgtaacctaatgaaggggatgttgttcgaaattgttcttggatgagtccatcgatcgtttgatcttctcagctcttctagatgggctgtgttcag

SEQ ID NO: 1383 - DNA, 1151 bp, Saccharum officinarum
atttcttttcccctttcctcccggcgctgctctctcctccgacatccgcggcagcgaagactaggccaacaaaatcacggtagcggaagcagcagacgggaggggaagatgtcgtcgctgcggaatgcgatcccgcggcgcgctcacaaggagcgctcccagccggaggcgaggaagaagtttgggcttttggagaaacacaaggactatgtcgtccgggcgcgagcttaccacatcaaggaggcaaccatcgcgaaactgaaggagaaggcagcatttaggaacccggatgaattctactttaaaatgatcaacagtaggactgttggtggaattcatagacctaagcctgaagataataagtatacagaagaggaacttcttctgttaaaaaataaagatatgggatatatccttcagagcgttcaaagtgaaaaaaagaaaattgaaaagttaaggtcaacacttcatgaactggataacaagcctcaaaacaagcatgtttattttgctgaagacagagaagaagcgaaagaaatacaatcaaggataggacaaagcagcaacatgcctggttttgacaacatcccttctcgtataaagaaaaaaactgcctcttcgtacagggagttagaagagaggaagcagcggcttcaaaagcttgagaaattgtatgcagacatggccttgcaaaaagaattgaagaaacctggacgcaagaggaaactgaaactcaatgaagatgaggagacggataatcaaacatcacagcctgtttataaatggcgagcacagaggaagcgatgatatgaatgcgtgacagagggaggaaaaggcaaggcattagtagtggaagtatggtcatagtggcgtacagaagctggtgattgaacagctccttttggatcctaaaatatttccctgtgaaagtagccctccgcaagaactactatgtctgtcaaactgttgggcaaaaagaattaggataagatgtaagagtaactttaatttatccaagattggattctgtatgatccaatcctatgcatcatatctcaattcattgttctctattctgttgaattcccctagtgatgggctattttgtgatccattttgaggtcagcaagtaatgccagatacaagaggat

SEQ ID NO: 1384 - DNA, 1690 bp, Zea mays
gaaacctagtgtctattttacatttaaccacttccatataaaaccgttggatctagactggatgctctggatagtttgattgcacgcttgcaccaaaatgagtgattgcacaggatatgtcctcaagattaaccactgggtccggcctctcctgaaaccgtcactgttcgaaaaactctaccaccacttctcatctaataggtctgaatctaatgccatgccattataatttctttggaactacttggtacacctatgacctatcggtttcattgttggcaacagaaaattcgaattcgaaataaaaaaaacaatgttgacctgggctaggagcccacaggccacgctcgaaacagattcagcccagcaaccgccaaaaattgggcccgcaaggtggtcggactttcggagttcggctgggctccgaccagttggacatccccggaccctgaaccctagcggctgatttattttctcctttcctcccggcggccggcgctgctctctccttcgacatccgcggcagcgaagactaggccacaaaatcgcggtagcaagcagcagacaggtggggaagatgtcgtcgctgcggaatgcgatcccgcggcgcgctcacaaggagcgcgcccagccggaggcgaggaagaagtttgggcttttggagaaacacaaggactatgtcgtcagggcgcgagcttaccacatcaaggaggcaaccatcgctaaactgaaggaaaaggcggcattcaggaatccggatgagttctattttaaaatgatcaacagtaggactgttggtggaattcatagacctaagcctgaagataataagtatactgaagaggaacttcttctgttgaaaaataaagatatgggatatatccttcagagcgttcaaagtgaaaaaaagaaaatcgaaaagctaagctcaacactccatgaacttgataacaagcctcaaaacaagcatgtttattttgctgaagacagagaagaagcaaaagaaatacaatcaaggataggacaaagcagcaacatgcctgatcttgacaacatcccttctcgtataaagaagaaaatagcctcttcgtacagggagttagaagagaggaagcagcggcttcaaaagcttgagaaattgtatgcagacatggccttgcaaaaagaattgaagaaacctggacgcaagaggaaactgaaactccatgaagatgaagagacggacaatcaaacatcacggcctgtttataagtggcgagcacagaggaaacgatgagatgatatgaatgggctatggagggagtaaaaggcaacatgttagtagtggaagtactggtcagtggaaccgctccttcggaccttaaaatacttccctgtagaagtagccctccacaagaactgtgtctttgtcaaactattgggcttaaagaattaggataagatgtaagagtaacttatacaagatcagattctgtatgattcaatcatgtgcatcatatatcaattcattgttctgtattatgttgaattcgcctagggatgggctatttttgtgatccattttgagatcagcaagtaatgccagatacaataggatagatccaacacaatgtatccctatacaatgtatccctatacaataggatagatcagcaagtaatgcctagcgttgggcttgaccacaattttt

SEQ ID NO: 1385 - DNA, 1182 bp, Setaria italica
ctagctcggctgcggctgattcctccccggcagctcttctcccaaatcctctcctccgccgatccctcgtgctccatcggaagcaacaggagagagaggaagatgtcgtcgctgcggaacgcgattccgcggcgggctcacaaggagcgtgcacagccggaggcgaggaagaagtttgggattcttgagaagcacaaggactatgtcgtccgggcgacagcttaccaccgcaaggagaaaattatcgcgaaactgagggagaaggcagcattcaggaatccagatgagttctactttaagatgatcaacaataggactgttggtggagttcataggccaaagcctgaagataataagtataccgaagaggaacttctattgttgaaaaataaagatatgggatatatctttcagagtattcaaagtgaaaaaaagaaaatcgagaagttaagctcaacacttcatgaattggataccaagcgtccaaacaagcatgtttattttgctgaagacagagaagaagccaaagaaatacgatccaggataggagaaagcagcaacatgcctagttttgacaacatcccttctcgtataaagaagaaaacagcttcttcatacagggagttagatgagaggaagcagaggcttcaaaagcttgagaaattgtatggagacatggccttgcaaaaagaattgaagaaacctggacacaagaggaaactccgtgaagatgagacagtgaatccaacatcacagcctgtttataagtggcgagcacaaaggaagcggtgagatgatatgaatgattgacaaagggagaaaaagtgaagtactgcaactggcggtaaaatggaaactaaaacacttggaaactggcggttggacagctcttcttgaatcctaaaatacttgcctgtattcttagccctctgcaagagctactagatctctttgttaaattgtcgggcaaacagaagtaggatatgctgtaagagtaactttgatatatatgaggaattggattctgtatggttcaattcaatgggccatgtcttcattcattgttctttattctgcggtgctgccaaatttgcacgtttgaactgtagtttcttgacctgtatttggagatcagcaagcaacgcagaggcaatactacctaattgttggcttgatcgcatt

SEQ ID NO: 1386 - DNA, 1139 bp, Pennisetum glaucum
cagagtacgcgggggaaccctgcctgaaccctagcctcgctcggctgcggctgattcctacttctcgtcccttcctcccccggtctccgtgcagctctcctccgccgatccctcgtgctccatcggaatcagcacgacgaagatgtcgtcgttgcggaacgccattccgcggcgggctcacaaggagcgtgcacagccagaggcgaggaagaagtttgggattcttgagaagaaaaaggattatgtcgtccgcgcgaaagcttaccaccgcaaggaggaaattatcgcgaaactgaaggagaaggcagcattcaggaatccagatgagttctacttcaagatgatcaacagtaggactgttggtggagttcataggccaaagcctgaagataataagtatacagaagaggaacttctgttgttgaaaaataaagatatggggtatatccttcagagtattcaaagtgaaaaaaagaaaattgagaaattaagctcaacacttcatgagctggatgccaagcgtccaaacaagcatgtttattttgctgaagacagagaagaagccaaagaaatacgatccaggataggagaaagcagcaacaagcctagttttgacaacatcccttctcgtataaagaagaaaacagcttcttcataccgggagttagatgagaggaggcagaggcttcaaaagcttgagagattgtatggagacatggccttgcaaaaagaattgaagaaacctggacgcaagaggaaactccgtgaagatgagatggtgaatccaacatcacagcctgtttataagtggcgagcacaaaggaagcgatgatatgatacggatgattgacaaagggaagaaaaagtgaagtactgcaagaggtagtactggtcgtaacgggagaaatggaaactggcggttggacagatcttcttgggccctaagagctactagatctctttgttaaattgttgggcaaaccgaagtaagatatgctgtaagagcaactttgatatatgttaggatttggattctgtatggttcaattcaatgggtctgcagtgctctgccaaattcacacatttgaactgtagtttcttgacatgtatttggagatcagcaagcaaccccaagatgc

SEQ ID NO: 1387 - DNA, 1011 bp, Panicum virgatum
  misc_feature (17)..(17): n is a, c, g, or t
  misc_feature (21)..(21): n is a, c, g, or t
  misc_feature (753)..(754): n is a, c, g, or t
  misc_feature (784)..(784): n is a, c, g, or t
ccgctcctccgccgatncctngtgctccgtcggaagcaaacaggagggggaggaagatgtcgtcgctgcggaactcaattccgcggcgagctcataaggagcgtgcgcagccggaggcgaggaaaaagtttgggcttcttgagaagcacaaggactatgtcgtccgggcgaaagcttaccaccgcaaggaggaaattatcgggaaactgaaggagaaggcagcattcaagaacccggatgagttctactttaagatgatcaacagtaggactgttggtggagttcataggccaaagcctgaagcaaataagtataccgaagaggaacttctactgttgaaaaataaagatatgggatatattcttcagagtattcaaagtgagaaaaagaaaatcgaaaagttaagctcaacacttcatgaacttgataccaagcgtccgaacaagcatgtttattttgctgaagacagagaagaagccaaagaaatacaatcgaggataggagaatgcagcaacacgcctggctttgacaacatcccttctcgtataaagaagaaaacagcttcttcatacagggagctagaagagagaaagcagaggcttcaaaagcttgagaagttgtatggagaaatggccttgcaaaaagaattgaagaaacctggacgcaagaggaaactccgggaagatgagatggtaagtccaacatcacagcctgtctataagtggcgagcacagaggaagcggtgagatgatnngaacgattaacaaagggaagaaaaaaagcnaagtattgcaaggggaagtgctggtcgtaacagcaaatggaaactagcgcttgaacagctctcctttgaaccctgaaatattcagtaaatgttgccctccacaagagctactatatctctgtcaaattgttgggcagacagaattaggagacgttgtaaactaagatatatatgggaaatcagattctatatgaaattcaatgacaatgtactcattcatttttctc

SEQ ID NO: 1388 - DNA, 1577 bp, Oryza sativa
aaaccctgaaccctagctttctcctcctccttccccttcccccttcctcttctccggattccctctcctccccacggcgtcgctactcccaaatccgcgaaaaatcgacagagaccagccgcccaatctgcctgatccatcggaggaggacgacgaggaggaggtttgcgaggcagcggcagggagaggaagatgtcttcgctgcggaacgcgatccagcggcgcgctcacaaggagcgcgcccagccggagtcgaggaagaagttcgggcttctggagaagcacaaggactacatcgttcgggcgaaggctttccaccagaaggaggaaaccatcaggaaattgaaggagaaggcatcatttagaaaccctgatgagttctattttaagatgatcaacagcaagactgttgatggaattcataggcctaagcctgaagcaaacaagtatactgaagatgaactcatgctgctaaaaactaaagatatgggatacatccttcagggtattcagagtgaaaagaagaaaattgaaaaattaagctccatgcttcatgaactagacaacaagcgaccaaacaagcatgtttactttgctgaagacagagaagaggtcaaagaaatacaatctagaatagaacaaaagagcagttcacttggtttggacaacatcccttcccgtataaagaggaaaactgcttcgtcctatagggagttagaggagaggaaacagagggttcaaaagcttgagaaactgtatgcagacatggccttgcagaaagagttgaagaaacctggacggaaaagaaaactccgtgaggatgagattgagaatcaaacatcccggcctgtttataagtggcgagcacaacggaagcgatgatgtgaatggcttacaatggaatcattgagaatatatggagtaaccagtagatcctaaagcaaacggagactattgtttattttcttgaattctaatgcatttacatgtagcagtgcccctccacaaccgtctctcttcatagccttcacttgattgtatttgtggatccatgttggataccactttctgctacctgctactgatgtgatgtacctctgctttttacaaaatgttgggtaactacatcaacaattgagaacctaaacggtccgaatcttcacgcatcgtccgtaatcaacattccaaggttagcaagcacagtgccaccagaattagggcgtgttcactttgccggaaaaaaaacataccatttgatggtagagccaaatattagtaatgccattctttggtaaagtcaaaatatcaatgtgtcattggctttgataccttactaaattttggtgtaatttttgtgagtggaaggttccggaattaccaaattaccttactaaattttggtgtaatttttgtgagtgcaatcctatttgtttgttaccctaccaacaaaaatttgacaataccaaaatttagtaaggtttattctggtagtggagtgaacaagccactctttagtgtatgaagtatttgatatattctccagaaaaaaaggggtaggaaaagaaaaaagaaaaaag

SEQ ID NO: 1389 - DNA, 1542 bp, Oryza sativa
ctcctccttccccttcccccttcctcttctccggattccctctcctccccacggcgtcgctactcccaaatccgcgaaaaatcgacagagaccagccgcccaatctgcctgatccatcggaggaggacgacgaggaggaggtttgcgaggcagcggcagggagaggaagatgtcttcgctgcggaacgcgatccagcggcgcgctcacaaggagcgcgcccagccggagtcgaggaagaagttcgggcttctggagaagcacaaggactacatcgttcgggcgaaggctttccaccagaaggaggaaaccatcaggaaattgaaggagaaggcatcatttagaaaccctgatgagttctattttaagatgatcaacagcaagactgttgatggaattcataggcctaagcctgaagcaaacaagtatactgaagatgaactcatgctgctaaaaactaaagatatgggatacatccttcagggtattcagagtgaaaagaagaaaattgaaaaattaagctccatgcttcatgaactagacaacaagcgaccaaacaagcatgtttactttgctgaagacagagaagaggtcaaagaaatacaatctagaatagaacaaaagagcagttcacttggtttggacaacatcccttcccgtataaagaggaaaactgcttcgtcctatagggagttagaggagaggaaacagagggttcaaaagcttgagaaactgtatgcagacatggccttgcagaaagagttgaagaaacctggacggaaaagaaaactccgtgaggatgagattgagaatcaaacatcccggcctgtttataagtggcgagcacaacggaagcgatgatgtgaatggcttacaatggaatcattgagaatatatggagtaaccagtagatcctaaagcaaacggagactattgtttattttcttgaattctaatgcatttacatgtagcagtgcccctccacaaccgtctctcttcatagccttcacttgattgtatttgtggatccatgttggataccactttctgctacctgctactgatgtgatgtacctctgctttttacaaaatgttgggtaactacatcaacaattgagaacctaaacggtccgaatcttcacgcatcgtccgtaatcaacattccaaggttagcaagcacagtgccaccagaattagggcgtgttcactttgccggaaaaaaaacataccatttgatggtagagccaaatattagtaatgccattctttggtaaagtcaaaatatcaatgtgtcattggctttgataccttactaaattttggtgtaatttttgtgagtggaaggttccggaattaccaaattaccttactaaattttggtgtaatttttgtgagtgcaatcctatttgtttgttaccctaccaacaaaaatttgacaataccaaaatttagtaaggtttattctggtagtggagtgaacaagccactctttagtgtatgaagtatttgatatattctccagaaaaaaaggggttatgcacagc

SEQ ID NO: 1390 - DNA, 1641 bp, Brachypodium distachyon
ttcaaaaacagtagagaaaatacattcgggatacacggtgtgactctatccggtgaagaaaatctgccccgtgcggccgtgccacacccacacagagctccccagcgagccctctacagctcaacacgaacgggccggacccaggcctaccgcgtcgggcccgtatacctgacaccccaaaccctgaaccctagcttagcttcgactcttccctctccgtccccggccaatctcccctccttcctcctgctcacctcccaaatcggccaaacgcgaagagcgaactcagcgacccacccgttcgttctcctcccgttcccgggtgaggcggggtaaagatgtcgtctctgcggaacgcaatctcgaggcgggctcacaaggagcgcgcccagccggaggcgaggaagaagttcgggcttctcgagaagcacaaggactatgtcgtccgcgccaaggccttccaccgcaaggaggatttcatcaggaaactgaaggagaaggcatcattcaaaaacccagatgagttctatttcaagatgatcaacagtagaaccgtggatggagtgcataaggccaagcctgaaaatgagtacactgaagaggaacttctgctgttgaagaataaagacatgggatacatccttcagggcattcaaagcgaaaagaagaaaattgaacgattaagctcaacgcttcatcaactagataacaaacgttcgaacaagcatgtttactttgctgaggacagggaagaagccaaagaaatacaatctaggatagaacaaagcagcaatgcaactcattttggcaacatcccttcccgtataaggaggaaaacagcttcctcctacaaggagttagaaggcaggaaactcagagttcaaaagcttgagaaactgtacgcagacatggccttgcaaaaagagttgaagaaacccggacgcaaaaggaaactccgcgaagaagagatggaaaatccaacatcacagcctgtttacaagtggcgtgcgcaacggaagcggtgagacagcaattttgccgctgcaccttagaacttcagataaaaattgcaggaagtattgctgactgatcctaaagtagaactggggcttttgaagagtttctcctgaattctgaagcacatctctgtaattttgcccttccacaacaccaccagttctttcccttatagcctttgatgaatatttgtggttcctatgttggagaccacgtactgctattactgtatgttattttctcaaaatgttgggctatcagaatcaacatgtaagaaaaaaaaatgatggatatggtttgaattatgtctctgttgtatggctaggattagcagttgcgttgtatgtctaaaaaaacatgtaagacagcaatgtttgtgcttaaccctctgaacctaaatcctgtcaataacttacattccatgattagcagcaaaaagagcactactgcagtaactacatttgatgattaccagcaaacagagcattattgcagtgctttgcactcaatcctagccatacaattattgatcaacggcccaaagagttctggcacagagtacttttgctctctgagatgggagtttatgtgagtgagcccgggctaaggttttggttgcccgta

SEQ ID NO: 1391 - DNA, 2753 bp, Brachypodium distachyon
tggccaccaccatggcgccacccgccatggcgtgccaagctctcacctacgcgcccctccccctccacctaccaaccgcgcggcgccgtgtccgggtccgcgttctcgccgtagccgccgaccagactcctgccccacaggcctccccatcttccgagccggcgaacagcccgagccggctcctccgggagctcgcggaacgaaagaaggctgtatccccgaaaaagaagcacccgccgcgccgcttcatcctgaagccgccgctcgacgacgagcgcctcacccagcggttcctcagcagcccgcagctgtcgctcaagtcgctcccgctcctctcctcctgcctcccctcctcgccgctctccgccgccgaccggacctggatggacgagtacctcctcgaggccaagcaggcgctcggctacccgctggctccctcggagacgctcggcgacggcgacgactgccccgcgcggcacttcgacgtcctgctctacctcgccttccagcacctggacccctcctgcgagcgcacgcggacgcgccacgtgcggaatggccactctaggctgtggttcctgggccagttcgtcttggagcttgcgttctccgagttcttcctgcagagataccccagggaatcccctggaccgatgcgagagagggtgttcgcattgattgggaagaggatgctaccaagatggctcaaagcggcaagcctgcataatttggtgtttccgtatgacaatttggatcggatgatacggaaagaccgggaaccaccgaccaaggctgtattctgggcactgtttggagctatatatttgtgctttggaatgcctgaagtctatcgtgttctttttgaggcgtttgggatggaccctgaagaagagagctgtcagccaaaactgcggcgccaactagaagatgttgattacgtttctgtggaatttgaaaagagacaactcacgtggcaagatgttgctgcctacaggccaccagcggatgctctttttgctcatcccaggcttttccgagcatgcgtgccaccaggaatgcatcgtttcagaggaaatatttgggactttgacaatagacccaaagtcatgaacatcctaggatatcccttgcctatgaatgatagaattccggaaatcacggaagcgaggaatatagaacttggacttggtcttcagttgtgcttcctgcatccctcaaagcataagtttgagcatccaagattttgtttcgagcgtcttgaatacgttggacagaagattcaggatcttgtattggcagagaggttgctcatgaagcaccttgacgcacccggcaggtggttgggggagaaacataggaggatgttgatgaacaagtattgcggacggtacctgcgggataagcaccttcaccactacattatttacggggagtctgtacaagacagattcgaacacaaccgccggctaagaaatccttccacgactgctgtccagcaagcgatacatggccttgcgtactgtgtctatggcaaacctgatgtgcgacgcttgatgtttgaggtgtttgactttgaacaagcctaccgcgtcgggcccgtatacctgacaccccaaaccctgaaccctagcttagcttcgactcttccctctccgtccccggccaatctcccctccttcctcctgctcacctcccaaatcggccaaacgcgaagagcgaactcagcgacccacccgttcgttctcctcccgttcccgggtgaggcggggtaaagatgtcgtctctgcggaacgcaatctcgaggcgggctcacaaggagcgcgcccagccggaggcgaggaagaagttcgggcttctcgagaagcacaaggactatgtcgtccgcgccaaggccttccaccgcaaggaggatttcatcaggaaactgaaggagaaggcatcattcaaaaacccagatgagttctatttcaagatgatcaacagtagaaccgtggatggagtgcataaggccaagcctgaaaatgagtacactgaagaggaacttctgctgttgaagaataaagacatgggatacatccttcagggcattcaaagcgaaaagaagaaaattgaacgattaagctcaacgcttcatcaactagataacaaacgttcgaacaagcatgtttactttgctgaggacagggaagaagccaaagaaatacaatctaggatagaacaaagcagcaatgcaactcattttggcaacatcccttcccgtataaggaggaaaacagcttcctcctacaaggagttagaaggcaggaaactcagagttcaaaagcttgagaaactgtacgcagacatggccttgcaaaaagagttgaagaaacccggacgcaaaaggaaactccgcgaagaagagatggaaaatccaacatcacagcctgtttacaagtggcgtgcgcaacggaagcggtgagacagcaattttgccgctgcaccttagaacttcagataaaaattgcaggaagtattgctgactgatcctaaagtagaactggggcttttgaagagtttctcctgaattctgaagcacatctctgtaattttgcccttccacaacaccaccagttctttcccttatagcctttgatgaatatttgtggttcctatgttggagaccacgtactgctattactgtatgttattttctcaaaatgttgggctatcagaatcaacatgtaagaaaaaaaaatgatggatatggtttg

SEQ ID NO: 1392 - DNA, 1090 bp, Cynodon dactylon
ggcgcggctgctccctcgttccctgttccgcagtcctccctcccatcccaaatccgcaagggcgaagaggagaatccacccactccttcgctgatccgcgtgctccgtcggaggaattatcgaaagcagcagtggtagatgtcgtcgctgcggaacgccatcccgcggcgcgctcacaaggagcgtgcccagccgggggcgaggaagaagtttgggcttctggagaagcacaaggactatgtcgtcagggcgagagcttaccaccgcaaggaagaaaccatcaggaaattgaaggagaaggcagcgttcaagaaccctgatgagttctactttaaaatgatcaatactaagactgttgatggaattcacaagcctaagcctgaagcaaataagtatactgaggaggaacttatgctgataaaaaataaggatatgggatatatccttcagtgtattcaaagtgaaaaaaagaaagttgaaaaattaaattcagtgcttcatgagctggatagcaagcgtccaaacaagcatatttactttgctgaagatagagaagaagccaaagcaatacaatccaggatagaagaaagcagcaatgtgcctgttttaagcaatatcccttcccgtataaagaagaagacagcttcttcatatcgggagttagaggagaggaaacagagacttcaaaagcttgagagactctatgcagacatggcattgaaaaaggaattgcagaaacctggacacaagaggaaactccgtgaagacgagatagaaaatccaacatcacagcctgtttataagtggcgagcacaaaggaagcagtatgatgatttgaatggctggaaaatgaaggaaaaatggtattaacagtagaagtttggccgtaccagcaaatatatattggcacttgaagagttctctctgaatcctaaagcagtctccagtaacagtgtcccttgcaagtattgcaactactgtattcatttgcctaattttgggtgaccagaattagataagctgtaagagctactttgatgtatattgacaaattggaacctacctggtttaatcaatggtcatgtttaca

SEQ ID NO: 1393 - DNA, 1080 bp, Avena sativa
atccccgtcctcctcaccgcgtcgctcccaaatccgcgaacatcgaagagcgaattcaggcgagagggcagccggaggaagatgtcgtcgctgcggaacgcgatctcgaggcgggctcacaaggagcgctcccagccggaggcgaggaagaagtatgggcttctggagaagcgcaaggactatatcatccgcgccaaggccttccaccgcaaggaggatctcatcaggaatctcaaagagaaggcatcattcaggaacccagatgagttctatttcaagatgatcaacagtaaaaccgtggatggaatccataggcccaagcctgaaacaaacaagtacactgaagaggaacttatgctgttgaaacataaagacatgggatacatccttcaggccatccaaagtgaaaagaagaaaattgaacgattaagctcaacgcttcacgaactggataacaagccgtcaaacaagcatgtgtactttgcagaggacagagaagaagccaaagaaatacattctaggatagaagaaagcagcagcacacctgattttggcaacatccctgctcggataaagaagaaaacagcttcctcctacaaggagttggaagccaggaaactcagggttcaaaagcttgagaaattgtacgccgacatggccttgcaaaaagaactgaagaaacctggacgcaagaggaaactccgtgaagaggagattgaaaatccaacatcacagcctgtttataagtggcatgcacaaaggaagcggtgatatggacgaaagttggattattgggaatagatgaagtgttgcagaatgaccccaaagcagaagctgtgcctggagagtttctcttgagtgcagaagcacatctcttcaacttgcccccttccaccatccatgccgattatttctgatacctttataacctttactcggtgatatttgtggatcctttattggagaccacatactactattagtctattaatgtatgttcatttcttgaaatgttgggcaagccagaatcaacatgtaagaacaatttgatggatatagttcaaatcaccatattcgggc

SEQ ID NO: 1394 - DNA, 1988 bp, Setaria italica
aaagaaagatactactggtctactgccatcatggggccgggaggcgtggcgcggctggcctgcgtgctcctcctcgccgccgccgccgcggggcacgccggcgtgcagccgctgtcgcgcatcgccatccaccgcgcgcgcgtcgcgctcgacgcgtccgccgcggtgcgggcctcgccggcgctgctcggcacgcagggtgaagatacagcttgggtaactgtagattttgttgctccccatcccagcggtgatgattggatcggcatattctctccgtcaaacttcaacgcatccacatgccctggatctcatggatcaggcccaggtcctgtcatatgctcagcaccgataaagtatcagtttgcaaattactcatcagattatggcacgtctgggaaaggaaccctgaagtttcagctgataaaccagcggcaagacttttcatttgcattgttcactggtggactctcaaatccaaaactgatcgccgtatcaaatgcgatcgcttttgcaaacccaaaagctccggtttatccacgcctagcacaggggaaatcctggaatgagatgactgtcacatggacaagtggctatgacataagtgaggcgtatccctttgttgagtggggcatgaaagggagacctgctgtacgcacagcagctggcacaatcacttttgatcgtgaaagcatatgcggagaacctgctcgttctgttggttggagagatcctggtttcatacacacagctttcctgacagacttatggccaaataaagagtactactgcaaaattgggcatatgctgcctgatggaaatgtcacatggggcaagttttcttccttcagagcacctccttatcctggtcagaagtcactgcagcgagttgtcatttttggagatatgggaaaggctgagagggatggtagcaatgagtacagcaactaccagcctggatcacttaacactaccgatacactgatcaaggacctcgacaacatagacataatgtttcacattggtgatattagctacgccaatggatacatttcacaatgggatcagttcacacaacaagtcgaggcgattacttcacgggttccatacatgattgcaagtggaaatcatgaacgagattggcccaacagtgggtcattcttcaatggaacagactctggaggggagtgtggtgtgttagctgagaccatgtactacaccccaacagaaaacagagcaaactactggtattcgacagattatggaatgttccggttctgcatcgcggacagcgagcacgactggcgggaaggcacggagcagtacaagttcatcgagaactgcttcgccacagtcgacaggaagaaccagccgtggctgatattcatcgctcatcgcgttcttggttactcttccggttacttctacggcattgacggggctttcgctgagccaacatcccggcaaagcctccagaagctctggcagaagtacagggtggacatggcgttctacggccatgtccacaactacgagagaacatgcccagtctatgaggaacaatgcatgagctcggagaagtcgcactactcgggcaccatgaacggcaccatacacgttgttgtcggaggcggcggtagccacctgagcaacttcaccaccgaggtcccggcttggagcatttacagggagatggactacggcttcgtcaagctcacggcgttcaactacacgtcccttctctacgagtacaagcggtccagtgacggcaaggtgtacgatagcttcactgtgcacagggagtacaaggacgtgctggcgtgcgtcaaggacagctgccctccgacgataccagcgacatgatattgatttgcagagggtcgcttgtgaggtgatgggttctgcgtgtaactgtgactgactattatctggaaaactgcaggagaaaggattgcacaacatttgttcgttgacagaccaccattaac

SEQ ID NO: 1395 - DNA, 2390 bp, Zea mays
gttcggtgtgaacgtccaggagaagtcgaccgtcgtatcgtacaaacaattagtattataagctaaacaaacggcgcggccgtacgcggaatttctggccatatccgaagcatataacttccttatctttatagatcctgtacgcggccagcggcggaaatctctccgagagccctcgcgaattgaagctgctgggcacggctatctagctgtatcgctcgtcgagtcaactccccgcgcgcgtcgtctcgttcgagttctctcgcatctcgatcgggtgcgctacacgtagacgtagcgtccgctgatacataaaccgcacggcggaagctgctcggtgctctccctactagttccaaaaggaagcaaggaagatagcatcatcgatcgtgtcatgagaccggcggaaggcgcggcgcggttggtttgcctgctcctgctcgccgccgtggccgcggggcacgccggcgtgcagccgctggcgcgcatcgccatccaccgcgcccgcttcgcgctcgacgcgtccgccgccgtgcgggcctcgccggagctgctgggaaccaagggcgaagatactgcctgggtgaaggtagaccttgttactccccatccaagtgccgatgattgggtcggcgtgttttctccttcgaagttcaacgcgtccacatgccttggttctcacggatctggcccaggccctgtgatatgctcggctccaataaagtatcagttcgccaactattcgtcgggctacggggagtccgggaaaggcgcgctgcagtttcagctgatcaaccagcggcaggacttctcgttcgcgctgttcactggcggactctcgaatcctaagcttatcgcagtatcgaacgccattgctttcgcgaacccaaaggctccagtctacccacgcctggcgcaagggaaatcctggaacgagatgactgtgacgtggacaagtggctacgagagcgacgaggcgtacccgtttgtggagtggggaatgaaatggagccccccggtgcgcagcgcagctggcaccgtcacttttgaccgtgaaagcgtctgtggagagcctgcccggtctgtcggctggagagatcctgggttcatacacacagccttcctcacagacttgtggccgaacaaagagtactactacaagatcggccatatgctgccagatgggagcgttgtttggggcaagctatcttccttcaaagcgcctccgtttcctggccagaagtcactgcagcgcgtcgtcatcttcggagatatggggaaggccgagagggacgggagcaacgagtacagcaactaccagcccggatcactcaacaccaccgacacccttgtcaaggacctggacaacattgacatggtgttccacatcggtgacatcacctacgccaacgggtacatctcgcagtgggatcagttcacgcagcaagtggaggagatcacctcgcgggtcccttacatggttgccagcgggaaccatgagcgggactggcccaacagcgggtccttcttcaacggcaccgactctggaggggagtgtggcgtggtcgctgagaccatgtactacacacccacagagaaccgagcaaactactggtactcggcagactacggcatgttccggttctgcgtggcggacagcgagcacgactggcgggaaggcacggagcagtacgagttcatcgagagctgcctcgccacggtcgaccggaagaagcagccgtggctggtgttcatcgcgcaccgcgtcctcggctactcctccggcttcttctacggcgtcgacggctcgttcgcggagcccatgtcccggcagagcctccagaagctctggcagaagtaccgggtggacctggcgttctacggccatgtccacaactacgagaggacatgcccggtctacgaggaacaatgcatgagctcggagaaatcccactactcgggcaccatgaacggcaccatccacgtcgtggtcgggggcggcggcagccacctcagcaacttcaccgcccaggtcccgccgtggagcgtgtacagggagatggactacggcttcgtcaagctcacggcgttcaactactcgtccctcctctacgagtacaagcgctccagcgacggccaggtgtacgacagcttcacgatgcacagggagtacagggacttgctggcgtgcgtcaaggacagctgccctccgacttcgccagcgacgtgacatgcattgcagccgcgcgtgaggagcagaggggggacaggggtcgcttctgtgacagtgggttaggttccacttcggcgtgtaactgtaactgtttaattaggtggtcgagcgagacccacattataaatcctacactcaataaagagcatgttgaccc

SEQ ID NO: 1396 - DNA, 2516 bp, Oryza sativa
gagcgatttacttcaaattttagaggatcagatccgacgaaattcaaactaatcaaatgaaagtgtaaaaatccttcatcacaagtaatgcgaataaaaatagtgaccggtcaaacaataccgcgcgtcgagtcaactcccggccccaaaacttatcaatctgtccccgcgcatgtgaactcaaacccatccgatcggttgactcgcaactgatcatgcgtagtaccccccgaatattcggacgagatgatcacatcatcacgcgtcccctagaaaaacccactccgccgccgccgtcgtcgcgtcgcacgcggcgccctaaaacagcagccgccgcgccggccgctcgccacattcacacgagcggggccggcctctctcacgagagcaaaccaacaaactagttcggcgagcgagctcggtcaatcgggataccgccaaagagtgcgtgcgagtggcaatggcgatgccgctgggtgggattctcctcctcttcctcgtgctcctcgccgccgccgcggcgggcggcggcggcggcgtgtgggcgttctcctcgtcgtcgtcgtcgtcgtcgtattccaggatcggcgagcagccgctgtcgctgatcggcatccaccgcgcgacggtcggcatcgacgccgcggcttccgtgcaagcgtcgcctcggcttctcggtgtcaagggggaagatactgcctgggtaactgttgatttcgcagctccgcatgcgagtgacggcgattggatcggagtattctctccttcaaatttcaacgcgtccacatgccccggtccttctggatcagactcaggacctgttatatgctctgcaccaataaagtatcagcttgcaaattattcttcagattatggcaagacaggaaaaggcactctcaagtttcagttgatcaatcagaggcaggacttctcctttgcactgttcactggtggtctctcaaatccaaagcttatcgcagtatcaaataagatcgccttcgcaaacccgaaagctccggtttaccctcgtctagctcaaggcaaatcctggaatgagatgactgtcacatggactagtggttatgacatcaaagaggcatatccctttgttgaatggggcatgaaatggagccctcctacgcgcacagcagctggcaccgtcacttttgatcgcgaaagcttatgcggagaacctgcccgtactgttggttggagagatccaggtttcatacacacagcattcctgactgatttatggccaaataaagaatactattacaagattggacatatgctacctgatggaaaaattgtatggggcaaattttactccttcaaagcacctccttttcctgggcaaaagtcactgcagagggttgtcatttttggtgatatgggaaaggccgagagggatggaagcaacgagtacagcaactaccagcctggatcactgaacacaactgacacactgatcaaggaccttgacaacatcgacattgtatttcacatcggtgacattacctatgccaacgggtacatttcccagtgggatcagttcactcagcaagtcgagccgatcactgctcgagtcccctacatgattgcaagtggaaaccatgaacgggattggccaaacagtggatctttcttcaatgggacagattctggaggggagtgtggggtgcttgctgagaccatgtactacacacccacagagaacagggcaaactactggtacaagacggactacgggatgttcagattctgcgtggcggacagcgagcacgactggcgggaaggcacggagcagtacgcgttcatcgagagctgcctcgccacggtggaccggaagaagcagccatggctggtgttcatcgcgcaccgcgtcctcggctactcctcgggcttcttctacggcgccggcggcgccttcgcggagccgacggcaaggcagagcctccagaggctatggcagcggcaccgcgtcgacctcgccttctacggccacgtccacaactacgagcggacgtgcccggtctacgacgggcggtgcgcgtcgccggagaggtcgcgctactccggcgcggtgggcggcaccatccacgcggtggtcggcggcggcggcagccacctgagcaacttcaccgccgaggcgccgccgtggagcgtgtacagggagatggactacggcttcgtcaagctcacggcgttcaactacacgtcgctgctctacgagtacaggcggtccagcgacggcgaggtgcacgacagcttcaccgtccaccgggagtaccgcgacgtgctcgcctgcgtcgccgacagctgcccgccgaccatcccgccggcgacgtgatccagctccggtgattccgccggcgagtctgccggcgacgtgtgcactattgctgcttggtggtgcttgcgggcctcgtctgtaatcttgacttgtcaatcgtgtgtaaattgaattgcgaaatatttcgaaattaagtcaaataaagaaatgttacaaaaat

SEQ ID NO: 1397 - DNA, 2330 bp, Oryza sativa
atccgatcggttgactcgcaactgatcatgcgtagtaccccccgaatattcggacgagatgatcacatcatcacgcgtcccctagaaaaacccactccgccgccgccgtcgtcgcgtcgcacgcggcgccctaaaacagcagccgccgcgccggccgctcgccacattcacacgagcggggccggcctctctcacgagagcaaaccaacaaactagttcggcgagcgagctcggtcaatcgggataccgccaaagagtgcgtgcgagtggcaatggcgatgccgctgggtgggattctcctcctcttcctcgtgctcctcgccgccgccgcggcgggcggcggcggcggcgtgtgggcgttctcctcgtcgtcgtcgtcgtcgtcgtattccaggatcggcgagcagccgctgtcgctgatcggcatccaccgcgcgacggtcggcatcgacgccgcggcttccgtgcaagcgtcgcctcggcttctcggtgtcaagggggaagatactgcctgggtaactgttgatttcgcagctccgcatgcgagtgacggcgattggatcggagtattctctccttcaaatttcaacgcgtccacatgccccggtccttctggatcagactcaggacctgttatatgctctgcaccaataaagtatcagcttgcaaattattcttcagattatggcaagacaggaaaaggcactctcaagtttcagttgatcaatcagaggcaggacttctcctttgcactgttcactggtggtctctcaaatccaaagcttatcgcagtatcaaataagatcgccttcgcaaacccgaaagctccggtttaccctcgtctagctcaaggcaaatcctggaatgagatgactgtcacatggactagtggttatgacatcaaagaggcatatccctttgttgaatggggcatgaaatggagccctcctacgcgcacagcagctggcaccgtcacttttgatcgcgaaagcttatgcggagaacctgcccgtactgttggttggagagatccaggtttcatacacacagcattcctgactgatttatggccaaataaagaatactattacaagattggacatatgctacctgatggaaaaattgtatggggcaaattttactccttcaaagcacctccttttcctgggcaaaagtcactgcagagggttgtcatttttggtgatatgggaaaggccgagagggatggaagcaacgagtacagcaactaccagcctggatcactgaacacaactgacacactgatcaaggaccttgacaacatcgacattgtatttcacatcggtgacattacctatgccaacgggtacatttcccagtgggatcagttcactcagcaagtcgagccgatcactgctcgagtcccctacatgattgcaagtggaaaccatgaacgggattggccaaacagtggatctttcttcaatgggacagattctggaggggagtgtggggtgcttgctgagaccatgtactacacacccacagagaacagggcaaactactggtacaagacggactacgggatgttcagattctgcgtggcggacagcgagcacgactggcgggaaggcacggagcagtacgcgttcatcgagagctgcctcgccacggtggaccggaagaagcagccatggctggtgttcatcgcgcaccgcgtcctcggctactcctcgggcttcttctacggcgccggcggcgccttcgcggagccgacggcaaggcagagcctccagaggctatggcagcggcaccgcgtcgacctcgccttctacggccacgtccacaactacgagcggacgtgcccggtctacgacgggcggtgcgcgtcgccggagaggtcgcgctactccggcgcggtgggcggcaccatccacgcggtggtcggcggcggcggcagccacctgagcaacttcaccgccgaggcgccgccgtggagcgtgtacagggagatggactacggcttcgtcaagctcacggcgttcaactacacgtcgctgctctacgagtacaggcggtccagcgacggcgaggtgcacgacagcttcaccgtccaccgggagtaccgcgacgtgctcgcctgcgtcgccgacagctgcccgccgaccatcccgccggcgacgtgatccagctccggtgattccgccggcgagtctgccggcgacgtgtgcactattgctgcttggtggtgcttgcgggcctcgtctgtaatcttgacttgtcaatcgtgtgtaaattgaattgcgaaatatttcgaaattaagtcaaataaagaaatgttacaaaattat

SEQ ID NO: 1398 - DNA, 1696 bp, Pennisetum glaucum
tgggtaactttagattttgttgctccccatccaagtggggatgattggattggcgtattctctccttcaaacttcaatgcatcgacatgccctggatctcatgtatcagacccaggtcctgtcatatgctcggcaccaataaagtatcagtttgcaaattactcatcagattatggcatttctgggaaaggaaccctgaagtttcagctgataaaccagcggcaagacttttcatttgcactgttcactggtggaccctcaaattcaaaacttattgccatatcaaatgcaattgcttttgcgaacccaaaagctccagtttatccacgcctagcacaggggaaatcctggaatgagatgactgttacatggacaagtggctatggcatcagtgaggcatatcccattgttgagtgggccatgaaagggagaccctctgtacgcactgcagctggcaccgtcacttttgatcgtgaaagcatatgtggggaacctgctcgttctgttggttggagagatcctggtttcatacacacagctttcctgacagacttgtggccaaataaagagtactactacaaaattggacatatgctgcctgatggaaatgtcacatggggcaagttttcttcgttccgtgcacctccttctcctggtcagaagtcactgcagcgagttgtcatttttggagatatgggaaaggctgagagggatggtagcaatgagtacagcaactaccagcctggatcacttaacactaccgatacactaatcaaggacctcaataacatagacataatgtttcacattggtgatattagctacgccaatggatacatttcacaatgggatcagttcacacaacaagttgaggcgattacttcacgggttccttacatgattgcaagtgggaatcatgaacgagattggcccaacagtgggtctttcttcaatggaacagactctggaggggagtgtggtgtgttagctgagaccatgtactataccccaacagaaaacagagcaaattactggtacttgacagattatggcatgttccggttctgcatcgcggacagcgagcacgactggcgggaaggcacagagcagtacaagttcatcgagaactgcttcgccacggtcgataggaagaagcagccatggctgatattcatggctcatcgagttcttggttactcttccggttacttctacggcattgatgggacgttcgctgagccatcgtcccggcaaagtctccagaagctctggcagaagtacagggtggacattgcgttctacggtcatgtccacaactacgagaggacatgcccaatctatgatgaaaaatgcatgagctcggataagtctcactactctggcaccatgaacggcaccatccacgtcgtcgtcggaggcggcggcagccacctgagcaacttcaccatcgaggtcccggcttggagtatctacagggagatggattacggcttcgtcaagctcacggcgttcaactacacgtcccttctctacgagtacaagcggtccagcgacggcaaggtgtacgatagcttcactgtgcatagggagtacaaggacgtgctggcgtgcgtgaaggatagctgccctccgacgataccggcgagatgatattgatatgcagacggtcgcttgcttgtgaggtgatgggttaatt

SEQ ID NO: 1399 - DNA, 2628 bp, Zea mays
tattacagatctatcggcaaagctcctgcagcaccgacccattctccgcccatttctcaattgatccgtaaaatgcatgtggaatttgtgcatccaaactaaactaggaaacagggctacaaatctgtgaatttccacaaaacacgagtttctgagagcgcgggcaaaaccagaaagtgcagtattcaaactgaatacactttattttattttttcagacaccaagtttctcgggtcgtcattttattttgtttttcaccgcactgtgccgcggcacatgcgcgggccgagccagtgatgacgagcccgattcactcgtgagttacagcgaggggtatatgcggaagctgaaaaaattcggggtgcgcccgtgcatcccagcaccggaagctggatccgcccctgcggtggcagcatgagcggcggggcgtcgctggggctcaggtcgtcggggagctacggatcgctgccgcagcagcagttaggcggctgccagtcgtcgtccccaccgctggccgcgcggaagcccgcgaagatgtccctcggcgggaccagcggcccgcgcgtctgcgcccggatctgcaagctcgccggacgccgccagcggatgctcctcctcctcctcgtctccgtcgccgtggcattctgcttcctcttctcatcacttgtcagtaaagacgaagatgcatcacctggtgttgagaccatgcttgtgttttctgatcatgtccggagctttgtgaaccctgtttggacatcgtcaggcagaccagtagctcagagaggttcgctgactgtgaatggtttgaatacaccatcgcagatggaaaaacaatctgatagtaaacaagttcaggaactcatgcagagttttccaccggctattgttgtggatcaccatccttgtgaaaacttttcattgtctcctccaccagttgatagaaaacgcactggaccacgaccttgtccagtttgttatttgccagttgagcaagcactggcactgagaccagctaaaccatcattgtcaccagtccttcaaagcttaaattatgttcttgaagagattttgattcccaaagagtccaagagcggttctttgtttggaggttttccatccctggaggaacgagataagtcttatgacataaaagactcgatgactgtacattgtggatttgtaagagggaaggtacctggtcttaatactgggtttgacatagatgaagctgatcattctgagatgcagctgtgccagagtacagttgttgcctctgctatttttggtaattatgacgtaatgcaacaaccagaaaatatcagcaaattttcaaaagatacagtttgcttctttatgtttctggatgaagaaacagaagctgcaataaagaacactactattggtcatactaaaaagattgggctgtggcgggtagttgttgtccgcaacctaccatttacagatgctagacgcaatggaaaggttccaaagctattacttcatcggctttttcccaatgcgcgatattcaatttggattgatgggaaacttaagctagtgagggatccttatcaggtattagaaaggttcttgtggaggaagaatgttagctttgcaatttccaggcattacagacgcttcgatgttttcgaggaagctgaggccaacaaggctggtggaaaatatgataacacatcaattgactaccagatagagttctacaaaagagagggtctaacccattattcatcagccaaacttcctataacgagtgacgtcccggagggctgtgtgataattagggaacatatccccataacaaacttgtttacatgcctttggttcaatgaagttgaccgcttcacgtccagagatcagctaagcttcagcacagttagggataaaataaggtggcgagttaattggactgcagacatgttcctggattgtgaaaggcgtgattttgttgttcagtcgtaccaccgagaactgttggaacagaggcagtctgccttacgaagatggcctccccagcggtctcccgtcgcgcgcttccaacctagaaagatgcttccagacaatgcagcaagggaaccatggaaggcttctgcaaccaagaagttatcacggaagcgagcacgggataagaaatcaagctcgagacgaactcattgaactagtgggaaggaagcaattcaactgtaaatgctggcgattttgctcctacacaactgcatatctaacggacagcattccaacattgttttactacttttaacttcctttcatgctcctagctcccctccccaagggcgccaaaattttgtcagggattgttgatagagagctgaaattctttgttgtaaataaacatttttagatcagagatgtattcaactagcagctgattcaattcaatccattttggaggtagtctttggcagggtttcaaatacagtcaatcttgtcaaacaatgccatcgatgcctgccagaggccatggtggacttgtgagtagccggaggtaggagaagacatggtgggtcccagctgcaagtgagagagtgaaggaagcccgggcgtgcgggcagaggagatgagtcattgcagtttctgataaaaaaaaa

SEQ ID NO: 1400 - DNA, 2373 bp, Setaria italica
tatttgcccagaaaccaaatttgtcggaccaccattttgacctcactgcccaagcgccccagcccggcccgatgatcacgactcacagccggattcagtcatgatgagttgcgacgaggggtatatgtggaagttgaaaaaattcggggtgcgcccgtgcatcccagcaccgtcagctggatccgccccttctgctgcggtggcggcatgagcggcggggcgtcgctggggctcaggtcgtcggggagctatggatcgctgctgcagcagcagctaggcggctgccattcctcgccctcgcccgcgccgtcggcatccccgccgctcgccgcgcggaagcccgccaagatgtcgctcggcggggccggcggcggcgggggcccgcgcgtgttcgcacggatctgcaagctcgccggccgccgccagcggatgctcctcctccttctcgtcgccgtcgcggtggccttctgcttcctcttctcatcacttgtcagtaaagatgaagatgcatcacctggtgttgagaccatgcttgtattttctgatcatgtccggagctttgtgaaccctgtttggacatcatcaggcagaccagtagcccaaagagattcactgactgtgaacggtttgaatacagcatcacagatggaaaaacaatctgatagcagtcgtaaacaagttcagagtcccatgcggaggtttccaccagctgttgttctgaatcaccatccttgtgaaaatttctcattgtctcctccacctattgatagaaaacgcactggaccacggccctgtccagtttgttatttgcctgttgagcaagcgctggcactgagacctgctcagctatcagcatcacctgtccttcaaagcttaaattatatatctgaagcgaatttggtttccgaagagtcaaatggtggttctttgtttggaggttatccatccctggaggaacgagataaatcttacgacataaaagatttgacgacagtgcattgtggatttgtaagagggaagatacctggtcttaatactgggttcgacatagatgaagctgatcgttctgagatgcagcagtgcgagaggactgttgttgcctctgctatttttggaaactatgatatactgcaacaaccagaaaacatcagtgatttttcaaaggatactgtttgcttctttatgtttctggatgaagaaacagaagctgcactaaagaactccactaccattgatcatactaaaagaatcgggctgtggcgtgtagttgttgttcgcaacctaccatattcagatgcaaggcgcaatggaaaggttccaaaattactacttcatcggctttttcctaatgtgcgatattcaatttggattgatgggaaacttaagctagtgagggatccttatcaggtattagaaagattcttgtggaggaagaatgttagctttgctgtttccaggcattacagacgctttgatgtctttgaggaagctgaggccaacaaggctggtggaaaatatgataatgcttcaattgattaccagatagagttctataaaagtgagggtttaactcattattcatcagctaagcttcctataacaagtgacgtccctgagggctgtgtgataattagggaacacatccccataacaaacctgtttacatgcctttggttcaatgaagttgaccgcttcacctccagagatcagctaagcttcagcacagttagggataaaataaggtcgcgagttaattggactgcagacatgttcctggactgtgaaaggcgtgattttgttgttcagtcataccaccgagaactgttggaacagaggcaggctaccttaagaagtcggcctcccctgcggcctcccatggtgcagatacaaccgagaaagatgcttccagacaatgcagcaaaggaacccgggaaggcttcatcagccaagaagttaccagggaagcgaacacgtgataagaaatcaagctcaaaacgagctcatcaaactaaagtaattggtgggaaggaggcaattcaactgtaaatctcctggcagttttgctcctatacaattgcagatctaacgaacattattccgacatggttttactatttaacttgtattcatgctgccttaccaacggctcaaaaattttgtcaggaagtgttaatagagggctaaatttttttattgtaaataaacatttctttttatattagatatggattcaactagcagctgatccaattcaattcaattcattgtagagttagtatttggtatggtttcaaatacagtcaattttgtcataatcattggtgtgaactatcaaagatgaagttgaattaaaaaatcgtaggtaattaggtg

SEQ ID NO: 1401 - DNA, 1981 bp, Zea mays
aaatatgataacacatcaattgccagtcgtcgtccccaccgctggccgcgcggaagcccgcgaagatgtccctcggcgggaccagcggcccgcgcgtctgcgcccggatctgcaagcttgccggacgccgccagcggatgctcctccgcctcctcgtctccgtcgccgtggcattctgcttcctcttctcatcacttgtcagtaaagacgaagatgcatcacctggtgttgagaccatgcttgtgttttctgatcatgtccggagctttgtgaaccctgtttggacatcgtcaggcagaccagtagctcagagaggttcgctgactgtgaatggtttgaatacaccatcgcagatggaaaaacaatctgatagtaaacaagttcaggaactcatgcagagttttccaccggctattgttgtggatcaccatccttgtgaaaacttttcattgtctcctccaccagttgatagaaaacgcactggaccacgaccttgtccagtttgttatttgccagttgagcaagcactggcactgagaccagctaaaccatcattgtcaccagtccttcaaagcttaaattatgttcttgaagagattttgattcccaaagagtccaagagcggttctttgtttggaggttttccatccctggaggaacgagataagtcttatgacataaaagactcgatgactgtacattgtggatttgtaagagggaaggtacctggtcttaatactgggtttgacatagatgaagctgatcattctgagatgcagctgtgccagagtacagttgttgcctctgctatttttggtaattatgacgtaatgcaacaaccagaaaatatcagcaaattttcaaaagatacagtttgcttctttatgtttctggatgaagaaacagaagctgcaataaagaacactactattggtcatactaaaaagattgggctgtggcgggtagttgttgtccgcaacctaccatttacagatgctagacgcaatggaaaggttccaaagctattacttcatcggctttttcctaatgcgcgatattcaatttggattgatgggaaacttaagctggtgagggatccttatcaggtattagaaaggttcttgtggaggaagaatgttagctttgcaatttccaggcattacagacgcttcgatgttttcgaggaagctgaggccaacaaggctggtggaaaatatgataacacatcaattgactaccagatagagttctacaaaagagagggtctaacccattattcatcagccaaacttcctataacgagtgacgtcccggagggctgtgtgataattagggaacatatccccataacaaacttgtttacatgcctttggttcaatgaagttgaccgcttcacgtccagagatcagctaagcttcagcacagttagggataaaataaggtggcgagttaattggactgcagacatgttcctggattgtgaaaggcgtgattttgttgttcagtcgtaccaccgagaactgttggaacagaggcagtctgccttacgaagatggcctccccagcggtctcccatcgcgcgcttccaacctagaaagatgcttccagacaatgcagcaagggaaccatggaaggcttctgcaaccaagaagttatcacggaagcgagcacgggataagaaatcaagctcgagacgaactcattgaactagtgggaaggaagcaattcaactgtaaatgctggcgattttgctcctacacaactgcatatctaacggacagcattccaacattgttttactacttttaacttcctttcatgctcctagctcccctccccaagggcgccaaaattttgtcagggattgttgatagagagctgaaattctttgttgtaaataaacatttttagatcagagatgtattcaactagcagctgattcaattcaatccattttggaggtagtctttggcagggtttc

SEQ ID NO: 1402 - DNA, 3368 bp, Zea mays
aatccggagtcttctccctcccctaacgcccctcctctccttccccacctgcgtgctgccgctgctgacaccttctcctccccacaaatctcgcctctgccgccgactctggctgcgaatccaccgcagatcggcgcgggggctccgcttgatgcccgatctgtgagagcggctcgccaccatgagggccgtgctgctgctggcgctgctcctgtctgcttgcgccgcggcggcggcgcaaggggccaactccacggcgttcgtgccgcgggacgacatccgcctggactgcggcgccaaggggcagggtaacgacactgacggccgggtgtggaccggggacgcgggctccaagtacgccccgccggacaacctcgcctcggtggcctccgcctccggccaggatccctcggtcccgcaggtgccgtacctcaccgcgcgggtctcggcctcgcctttcacctactccttcccgcttggcccgggccgcaagttcctcaggctccacttctacccggccaactacaccgaccgcgacgccgccgacggcctcttctccgtctccgtcgccgccccggggggcaacctcacgctcctctccaacttcagcgcctaccagacggctgccgcgatcacctactcgtacctcattcgggagttctccgtcaacgtctcgtccccgacgctcgacctcaccttcaccccggagaaggcccaccccaacgcctacgcgttcgtcaacggcatcgaggtcgtgtcctcccccgacctcttcgacatctccactcccaacatgcttgccggcgacggcaacctccagccgttcccgatcgatgctggcactgcgatgcagaccatgtaccggctcaacgtcggaggccaggcgatttcgccctccaaggacacgggcggttaccggtcctgggacgacgactcatcgtacatctttggtgctagcttcggggtcagctacccgaaggatagcaaggtcaccatcacatatccaagcaatgtgccggagtatgtggcgccagaggatgtctacggcacggcgcgatccatggggccagataagaatgtgaacatgaactacaatctcacatggatgttggaggtggatgctggattcatgtaccttatcaggatgcatttctgtgagatccagtaccccatcacaaagatcaatcagcgggtcttcaatatttacattaacaaccagactgcagtcaagggtgctgatgtgaatgcctgggcggccgtaagtggtgctaccacccttattggcactccggtgtatcaggactatgtagtgagcacaacgggtttaggggccatggatttatgggtagctctccatcccaatcccgactcgaagccacaaatatatgatgctatcctcaatgggatggaggtgttcaagctacagcttaccaatggcagccttgcagggctgaatcctgtgccaagtgttgccccggtgcctgatgggacaactaagaagaagtcaagtgttgggcctattgtcggtggagtggttggaggtttggtggttcttgcacttggctattgctgctttgtgatctgcaagcgcaggaggaatgccgggaaggatgcaggcatgagtgatgggcattctggttggctgcccctgtctctttatggcaattcacacacttccagttcggccaagtcacacactactggtagctatgcttcatctttgccatccaacctgtgccgccatttctcttttgctgagatcaaggccgcaacgaacaactttgatgagtcccttattcttggtgtgggtggatttggtaaagtttatcgtggtgaggttgatgggggaacaactaaggtggctatcaagcgtggcaaccccttgtctgagcagggtgtgcatgagttccagactgagattgaaatgctgtccaagctccgccaccgccatctggtgtcactgattgggtactgcgaggagaagaatgaaatgatcctggtctacgattacatggcccatggtactctccgtgagcacctgtacaagacccagaagccacctcttacctggaggcagcgtttggatatctgtattggtgcagctcgtgggcttcactaccttcacactggtgcaaagcacaccatcatccaccgtgatgtgaagacaacaaacatcctgctggatgagaaatgggttgccaaggtttcagattttggtctgtccaagactggcccatctatggaccatactcatgtgagcacagttgtcaaaggcagttttggttaccttgatcccgaatacttccgcaggcagcagctcacagagaaatccgatgtctactcatttggtgttgtgctgtttgaggtcctctgcgcacggcctgccttgaaccctactcttccaaaagaagaagtcagcttggcggagtgggcgttgcactgccagaagaagggcatccttgaccagattgtcgacccctacctgaagggaaagatagccccacagtgcttcaagaagttcgccgagacagccgagaagtgtgtttctgatcagggaatcgaccgcccttcgatgggtgatgtgctctggaacctggagttcgcccttcagatgcaggaaggcgcagaagagagcggaagccttggctgcgggatgtcagacgagggcgccccattgatggtcgggaagaaggacccgaacgacccatcgatcgagtcaagcaccaccaccacaaccaccacttctataagcatgggcgaccaaagcgtcgcgagtatagactcggatgggctgacgcctagcgccgtcttctcgcagatcatgaaccccaaggggcggtgaggtaaagctggccccattcgttaccttgcaggcgtaatttattcattcagaataaatttttttcttcaatgttctctcaagttaaggcttaagaaccagaagtgtgaggattgtttcgtactagatattctgccttgccttgtactacttccttctccgagtattgtaatgactatacaatctgttggcttgtattgtaccgctgctattgacccagccagtattttactgcacgagaaagtggtgtgcacgaactattcttatggggtggttgtgtgacgtgttcttttaggaaggagtctcacctctgaatccgacatctacacttgacaatcagttttcagtctgaatggatacaagaactggtagaccgtcgtctggttattagcagaactgagattgtgtcggttttgtcccttcagacaaattccaattgccaaacaatccatttcacattggattgtaggcgcagggcggctcacgagagctcttgaggtgttattacagaataattgtttgggtgtgt

SEQ ID NO: 1403 - DNA, 3172 bp, Zea mays
gcaccgcccgtaatccggaggcttccccctcccccttccttcccccacccgcgggctgctgctgccaccttctcctccccacaaggctcacctccgccgccaaccccggccgcgaatccaccgcagatcggcctcggcgcgccgcttgatgcccgatctgtaagaggggcttgccaccatgagggccttgctgctgctggcgcttctcctggccacttgcgccgcggcggcggcgcaagcggccaactctacggcgttcgtgccgcgggatgacatcctgctggactgcggcgcgaaggggcagggcaacgacacggacggccgggtctggaccggggacgcgggctccaagttcgccccgcccgacaacctcgcctccgtggcctccgcctctggccaggatccctcggtcccgcaggtgccgtacctcaccgcgcgggtctcggcctcgcccttcacctactccttcccgcttggcccgggccgcaagttcctcaggcttcacttctacccggccaactacagcaaccacgacgccgccgacggcctcttctccgtctccgtcgccgtcccggggggcaagctcacccttctctccaacttcagcgcctaccagacggctgccgcgatcacctactcgtacctcatccgggagttctccgtcaacgtctcatccgcgacgctcgacctcaccttcaccccggagaaaggccacccgaacgcctacgcgttcgtcaacggcatcgaggtcgtgtcgtccccagacctcttcgacatctccactcccaacatggtcaccggcgatggcaacctccagccgttcccaatcgatgctggcactgcggtgcagactatgtaccggctcaacgtgggaggccaggcgatttcgccctccaaggacacgggtgggtaccggtcctgggacgacgacacagcatacatctttggcgctggcttcggggtcagctacccgaaggataacaatgtcaccatcacatatccaagcaatgtgccggagtatgtggcgccagaggatgtctacggcacagcgcgctccatggggccagataagaatgtgaacatgaactacaatctcacatggatgttgcaggttgatgctggattcatgtaccttatcaggctgcatttctgtgagatccagtacccgatcacaaagatcaatcagcgggtcttcagtatttacattaacaaccagactgcagtcaaggatgctgatgtgaacgcgtgggcgaccatgagtggtgctaccacccttattggcactccagtgtatcaggactatgtggtgaccacatcgggtttaggggccatggatttgtggatagctctccatccgaatcctgactcaaagccacaaatatatgatgctatcctcaatggaatggaggtgttcaagttaccgcttacaaatggtagccttgcagggctcaaccctatcccaagtgttgccccgatgactggtgggacagctaagaagaagtcaactgttgggcctatcgtcggtggagtgatcggaggtttggtggttcttgcacttgggtattgctgcttctttgtgatctgcaagcggaagaggagtgctgggaaggatgcaggcatgagtgatggacattctggttggctgcccctgtctctttatggcaattcacacacttccagttcggccaagtcacacactactggtagctatgcttcatctttgccatccaacctgtgccgccatttctcttttgctgagatcaaggctgcaacaaacaactttgatgagtccctcatcctcggtgtgggtggatttggcaaagtttaccgtggtgaggttgatgggggaacgactaaggtggctatcaagcgtggcaatcccttgtctgagcagggtgtgcatgagttccagactgagattgaaatgctgtccaagctccgccaccgtcatttggtgtcactgattgggtactgcgaggagaagaatgaaatgatcctggtctatgattacatggctcatggtactctccgcgagcacctgtacaagacccagaagccacctcttacctggaggcagcgtttggatatctgcattggtgcagctcgtgggcttcactaccttcacactggtgcaaagcacaccatcatccaccgggatgtgaagacaacaaacatccttctggatgagaaatgggttgccaaggtttcagattttggtctgtccaagactggcccatctatggaccatactcatgtgagcacagttgtcaaaggcagtttcggataccttgatcctgaatactttcgcaggcagcagctcacagagaagtctgatgtatactcttttggtgttgtgctgtttgaggtcctctgtgcacggcctgccttgaaccctactcttccaaaagaggaagttagcttggcggagtgggcgttgcactgccagaagaagggcgttcttgatcagattgttgacccctacctgaagggaaagatagctccacaatgcttcaagaagtttgctgagacagccgagaagtgtgtttctgatcagagtattgaccgcccttcgatgggcgatgtgctctggaacttggagtttgcccttcagatgcaggagagcgcggaagagagcggaagcctcggttgtgggatgtcggacgagggcactccccttgtgatggtcgggaagaaggatccaaatgacccgtcgatcgaatcgagcaccaccaccacaaccaccacttctttgagcatgggcgatcagagcgtcgcgagtatggactcggatgggctgacgcctagcgccgtcttctcacagatcatgaaccccaaggggcggtgaggtaaagctggtcccattcgttaccttgcattcattcagcatgtttttttcacgagttcgtgctgttacggttctctcgaattaagaaccagacgtccgagaattgtttcatactagatattctgccttgccctgtacttcttccccagtattgcaacgactgtacatctgttggcttgtattgtaccgctgctattgacccaactagtattttactttatgagaaagtgatgtgcacgaactattgttatgagtggtcgtgtgacgtgctgttaggaaggagtctcgactctgaattcgacatgcacacttgataatcagttttca

SEQ ID NO: 1404 - DNA, 3406 bp, Setaria italica
cctcccacttaatgccgcaccacccgtaatcccgaggcttcccccctcccttaacgcctccacccccctccatctcctcctcccttccccaccacctgcggctgccacctctctccttctgctagccctcaaatctcgcctccgccgccgactcctgccgcgaatccgcccccagatcggcgcgggcgcgccgcgttgatgtccgatctgtgaggagggacacgcccccccaccatgagggccttgctgctgctcgcgctgctcctggcggcttgcgccgcggcggcggcgcaggcggcgggagggcgcaactccacggcgttcgtgccgcgggacgacatcctgctggactgcggcgcgaaggggcagggcaacgacaccgacggccggatgtggggtggggacgaaggctcaaagtacgctccgccctccaacctcgccgccgcggcccccgcctccgggcaggacccctcggtcccgcaggtgccgtacctcaccgcgcgggtctcggcctcgcccttcacctactccttcccgctcggccccggccgcaagttcctcaggctgcacttctacccggccaactactccaaccgcgacgccgctgacggcgtcttctccgtctctgtcggcaagctcacgctcctctccaacttcagcgcctaccagaccgccgccgccatcaccttctcctacctcgtccgggagttctccgtcaacgtctcctcgacgctcgacctcaccttcaccccggagaagagccaccccaacgcctacgcgttcgtcaatggaatcgaggtcgtctcctcccccgacctcttcggcctcaccccgccgaatatggtcaccggggatggcaacaaccagccgttctcgatcgatgccagcgttgcgatgcagaccatgtatcggctcaacgttggaggccaggcgatctccccctccaaggacaccggcgggtaccggtcctgggatgacgactcgccctacatcttcggcgcctcgttcggggtgtcttacccgagtgatcccaatgtcaccatcacgtacccgagcaatgtgccggagtatgtggcaccgatggacgtctactccacggcacgctcgatgggcccggacaagaatgtgaacttgaactacaatctcacatggatgttgcaggtggatgctggcttcaattaccttgtcaggatgcatttctgtgagatccagtacccaattacaaagatcaatcagcgggtgttcgacatttacatcaacaaccagacggccatgaatggtgctgatgtgattgcgtgggcgtccgtgagtggtgctaccaccggtattggcactccggtgtatcaggactatgtggtgagcacatatggtttagggcctatggatttatgggttgctctccacccggatgttgactcgaagccagagagatatgatgctatcctcaatgggttggaggtgttcaagttacagcttagcaatggtagccttgcagggctcaaccctatcccaagtgttgagccaacggatgatggggagactaagaagaagtcagctgttgggcctattgttggtggtgtggttggaggtttggtgcttcttgcacttgggtactgcttatttgtgttctgcaggcgcaggagtgccgggaaggatgcaggcatgagcgacggccattctggctggctgcccttgtctctttatggcaattcacacacttccagttcggccaagtcgcacactactggtagctatgcttcatctttgccatccaacctgtgccgccatttctctttcgctgagatcaaggctgcaacaaacaacttcgatgagtcccttattcttggtgtgggtggatttggtaaagtttaccgtggcgaggttgatgggggaacaaccaaggtggctatcaagcgcggcaatccgttgtctgagcagggtattcatgagttccagactgagattgaaatgttgtccaagctccgccaccgtcatctggtgtcactgattggatattgtgaggagaagaatgagatgatccttgtctatgactacatggctcatggtactcttcgcgagcacttgtacaagacccagaagccaccgcttacctggaggcagcgcttggatatctgcattggtgcagctcgtggtcttcactaccttcacaccggtgcaaagcacaccatcatccaccgtgatgtgaagacaacaaacattctcctggatgagaaatgggttgccaaggtttcagattttggtctgtccaagactggcccatctatggaccacactcatgtgagcacagtggtaaagggcagttttggttaccttgatcctgaatacttccgcaggcagcagctcaccgagaaatctgatgtctactctttcggtgttgtgctgtttgaggtcctctgtgcacggcctgccttgaaccctactcttgcaaaggaagaagttagcttggcagagtgggcattgcactgtcagaagaagggcattctcgatcagattgttgatccctacctgaagggaaagattgctccgcagtgtttcaagaagttcgctgaaacagctgagaagtgtgtttctgatcagggcattgaccgtccttctatgggggatgtactctggaacttggagtttgcccttcaaatgcaggaaagcgcagaagagagtggaagccttggctgtgggatgtctgacgagggcactccccttgtgatggtgggaaagaaggatcccaatgacccgtccattgaatcgagcaccaccacaaccaccaccacttctatcagcatgggcgatcaaagtgtcgcgagtatggactcagacgggctgacgcctagcgccgtcttctcacagatcatgaaccccaaggggcggtgaggtaaaaactggttccattcgttccctcgcaggcataatttattcattcagcatatttttcatgagtttgtgctgtcaatgttctctcaagttatggaccggaagtcagagaattgtttcatactagatattctgccttgccttgtacctttcaccagtattgtaatgactacacctattggcttgtattgtactgctgctattgacccaactagtgttttactgcatgagaaagtgatgtgtgttttttctttctttcttttcttcggtgatgtgctgttaggataggacgtagtccgaaatctgaattcgacagctacacttgattgcagttttcaatcttggtggattgaaagaactgatatatcgttttgtggattagcattactgacagctggcgttggtctttgtcctcaagacaaatttcaatttttaaatctaagtgggtcaaacaatcgattgaccgtttcctacaattagcggagctgacagctgaggcactcttcctttagacaaa

SEQ ID NO: 1405 - DNA, 3004 bp, Pennisetum glaucum
cctcctcctccgttccccaccacctgcggctgccacctcccctcctcaaatctcgtctccgccgccgacccctgccgcgaatccgcccccagatcggcgcgggcgcgccgcgttgatgtccgatctgtgaggagggacacgctcccgaaccatgagggccttgctgctgctcgcgctgctcctggcggcgtgcgccgcggcggcggcgcaggcagcgggagggcgcaactccacggcgttcgtgccgcgggacgacatcctgctggactgcggcgcgaaggggcagggcaacgacaccgacggggggacgaaggctccaagtacgccccgccctccaacctcgccgccgcggcccccccgggcaggacccctcggtcccgcaggtgccgtacctcaccgcgcgggtctcggcctcgcccttcacctactccttcccgctcggccccggccgcaagttcctcaggctgcacttctacccggccaactactccaaccacgacgccgccgacggcctcttctccgtctccgtcggcaagctcacgctcctctccaacttcagcgcctaccagaccgccgccgccatcaccttctcctacctcgtacgggagttctccgtcaacgtctcctcctcgacgctcgacgtcaccttcaccccggagaagaaccaccccaacgcctacgcgttcgtcaatggaatcgaggtcgtctcctcccctgacctcttcgacctcacgccgccgaacagggtcaccggggatggcaacaaccagccgttcccgatcgatgccagcgttgccatgcagaccatgtatcggctcaacgtcggaggccaggcgatctccccctccaaggacaccggcgggtaccggtcctgggacgacgactcgccttacatcttcggcgcctcgttcggggtgtcttaccagagcgatcccaatgtcaccatcacgtacccaagcaatgtgccggagtatgtggcgccgatggacgtctactccacggcacgctcgatgggcccggacaagaatgtgaacgtgaactacaatctcacatggatgttgcaggttgatgccggcttcgattaccttgtcaggatgcatttctgtgagatccagtacccaatcacaaagcccaatcagcgggtgttcgacatttacatcaacaaccagacagccatgaatggtgctgatgtgattttgtgggcgtccctgagtggtgctaccacctacattggcactccggtgtatcaggactatctggtaagcacatatggtttagggcccatggacttatgggttgctctccatccggatgttgactcaaagccagaaagatatgatgctatcctcaatgggttggaggtgttcaagttacagcttagcaatgggagccttgcggggctcaaccctatcccaagtgttgagccaacagaagaaggggagaataagaagaagtcaactgttgggcctattgttggtggtgtggttggagctttggtgcttcttgcatttgggtattgcctcttggtgttctgcaggcgcaggaggagtgccgggaaggatgcgggcatgagcgacggccattctggctggctgcccctgtctctttatggcaattcacacacttccagttcggccaagtcacacactactggtagctatgcttcatctttgccatcaaacctgtgccgccatttctcttttgctgagatcaaggctgcaacaaacaactttgatgagtcccttattcttggtgtgggtggatttggtaaagtttaccgtggcgaggttgatgggggaacaaccaaggtggctatcaagcgcggcaatccattgtctgagcagggtattcacgagttccagactgagattgaaatgttgtcgaagctccgccaccgccatcttgtgtcactgattgggtattgtgaggagaagaatgagatgatccttgtctatgactacatggctcatggcactcttcgtgagcacttgtacaagacccaaaagccaccgcttacctggaggcagcgcctggatatctgcattggtgcagctcgtggccttcactaccttcacaccggtgcaaagcacaccatcatccaccgtgatgtgaagacgacaaacattctcctggatgagaaatgggttgctaaggtttctgattttggtctgtccaagactggcccgtctatggaccacactcatgtgagcacagtggtaaagggcagttttggttaccttgatcctgaatacttccgcaggcagcagctcactgagaaatctgatgtctactctttcggtgttgtgctgtttgaggtcctctgcgcacggcctgccttgaaccctactcttgcaaaggaagaagttagcttggcagagtgggcattgcactgtcagaagaagggcattctcgatcagattgttgatccctacctgaagggaaagattgctccgcagtgtttcaagaagttcgctgagacagctgagaagtgtgtttctgatcagggcatcgaccgtccttctatgggggatgtactctggaacttggagtttgcccttcaaatgcaggaaagcgcagaagagagtggaagccttggctgtgggatgtctgacgagggcactccccttgtgatggttgggaagaaggatcccaatgacccgtccattgaatcaagcaccaccacaaccaccaccacttcaatcagcatgggtgatcaaagtgtcgcgagtatggactcagacgggctgacgcctagcgccgtcttctcacagatcatgaaccccaaggggcggtgaggtaaaagctggttccactcgcaggcataatttattcattcagcatattttcatgagtttgtgctgtcgatgttatcttaagttatggaccggaagtcagagaattgtttcatactagatattctgccttgccttgtaccttctccagtattgtaatgactacacctattggcttgtaatgtactgctgctattgacccaactagctag

SEQ ID NO: 1406 - DNA, 2859 bp, Oryza sativa
gcgcggcggcgccggcgccggctgcgggggcggggccgttcgtgccgcgggacgacatcctgctcgactgcggcgcgacggggaaggggaacgacacggacgggcgggtgtggagcggggacgccgggtccaagtacgcgccggcgagcctcggctcggcgtccgccgcggggcaggacccctcggtgccgcaggtgccctacctcaccgcgagggtctccgcggcgcccttcacctactccttcccgctcggcgccggccgcaagttcctcaggctccacttctacccggccaactactccagccgcgacgccgccgacgcgcgcttctccgtctccgtccccgccgccaacgtcacgctcctctccaacttcagcgcctaccagaccgccaccgccctcaacttcgcctacatcgtccgcgagttctccgtcaacgtcacgaccccgacgatggagctcaccttcacgccggagaagggccaccccaacgcctacgcgttcgtcaacggcatcgaggttgtctcctcccccgatctcttcgacatctccaccccgaatctggtcaccggggatggcaacaatcagccattcccgatcgacgctggcactgctctgcagacaatgtaccgacttaatgtcggcggccaggcgatctccccctccaaggacacgggcggttaccgttcgtgggacgatgactcgccatacgtttttggtgcggcgttcggggtgtcctacccaaaagatgacaatgtcaccattgcctaccctagcaatgtgccggagtatgtggcgccggtggatgtctatgctacggcaaggtcgatggggccggacaagaacgtgaacttggcatacaacctcacttggataatgcaggtggatgctgggttcacataccttgtgaggcttcatttctgtgagatacaatatccaatcactatgatcaatcagcgggtgttcaacatttacatcaacaaccagactgcttttcagggcgccgatgtgattgcatggactaataacaatgggatcggcagtccagtgtatcaagactttgtagtgacaacagttggttcaggggctatggatttgtgggtagctctctatccagatgtccaggctaaaccacagtactatgatgctatcctcaatggactggaggtgttcaagttgccgcttagtaatgggagccttgctgggctcaaccctgttccaactgttgagccatcgttggatggtggagcagtgaagaagtcaagtgttgggcctattgttggtggagtgattggaggtctggtggttcttgcacttggatattgctgctttatgatctgcaagcgtcggagcagagtggggaaggacacaggcatgagtgatgggcattctggatggttgccactttcactctatggcaactcacactcatctggctcagccaaatcacatactactgggagctacgcttcatcgctgccatccaacctgtgccgccatttctcatttgcggagatcaaggctgcaacaaacaacttcgatgaatccctcctccttggtgtgggtggtttcggtaaagtgtatcgtggggagattgatggtggagtgaccaaggtggctatcaagcgtgggaatccactgtctgagcagggtgtgcatgagttccaaaccgagattgagatgctgtcgaagctccgccaccgtcatcttgtgtcactgattggttactgtgaggagaagaatgagatgatcctggtctatgactacatggctcatggaactcttcgtgagcacctgtacaagaccaagaatgcaccacttacatggaggcagcgcttggagatctgcattggtgctgcccgtgggcttcactaccttcacactggtgcgaagcacacaatcatccaccgtgatgtgaagacaacaaatatcctcctggatgagaagtgggtcgcgaaggtttcagattttggtctgtcaaagactgggccatcgatggatcacacacatgtgagcacagttgtcaagggaagttttggctaccttgaccctgaatacttccgcaggcagcagctcactgagaaatctgatgtctactcctttggtgttgtgctatttgaggtcctctgtgctcgccctgccttgaaccccactcttgctaaggaagaagttagcttggcagagtgggccctgcactgccagaagaagggtattcttgatcagattgttgatccccacctgaagggaaagatcgctccacagtgcttcaagaagtttgccgagactgctgagaaatgtgtttcagatgaaggcatcgatcgtccttcaatgggagatgtgctgtggaacttggaatttgcccttcaaatgcaggaaagtgcagaggatagtggaagcattggttgtgggatgtcagatgagggcactccccttgtgatgcctggaaagaaggatcccaatgatccatcgatcgagtcaagcaccactacaaccacaaccacgtccataagcatgggcgaccaaagtgttgctagcatagactccgacgggcttactcctagcgctgtcttctcacagatcatgaaccccaagggacggtgagctaacagtctttgcttgtcacctgcaggcattatttattctttaaacgtattctcatgagtttgtgatgttgattttctgtcaatttatggacctggaagtcagagagttgttccatattagatatttttgttttgtgctgtatattgtccatgctgtggtgacttggatacttattggctttgtattgtactctaccgctggtattaaccaccagttgatctctattactgtatacgaaagctatgcgcaagaccat

SEQ ID NO: 1407 - DNA, 3713 bp, Oryza sativa
aagcaacagaaaaatcccgcgcaacccgaccccgaacaggctgccacgacggtgcgagctgtcctccataactccagccatctccccgctgtgcgctcccgtcctcccgcccccgtccccacccgtcagccaaacccatcccaccacgaggagtgaaccaaaaacgcgagcaaccgagcagagcgaggagctcgcttgctttgccgttgccgacgtcgcccccaatctcccgcataacgccgcggccgtagtagtcccgaaacctccctcccccacattgcttgtctcctccaccttgaacccgagtttctcacccacatccaccagatctgcgaggaggtaggaaagctcgatgcccgatctgtgaagcggaagcagttagctagttgtagttgagagcgggggtggccacaatgggaagctccagattcgtgctcttgctcctcctcctcctcgccgtggcggcttgcgtcgcgcgggggcaaggcggcggaaactcgagcagcgcggcggcgccggcgccggctgcgggggcggggccgttcgtgccgcgggacgacatcctgctcgactgcggcgcgacggggaaggggaacgacacggacgggcgggtgtggagcggggacgccgggtccaagtacgcgccggcgagcctcggctcggcgtccgccgcggggcaggacccctcggtgccgcaggtgccctacctcaccgcgagggtctccgcggcgcccttcacctactccttcccgctcggcgccggccgcaagttcctcaggctccacttctacccggccaactactccagccgcgacgccgccgacgcgcgcttctccgtctccgtccccgccgccaacgtcacgctcctctccaacttcagcgcctaccagaccgccaccgccctcaacttcgcctacatcgtccgcgagttctccgtcaacgtcacgaccccgacgatggagctcaccttcacgccggagaagggccaccccaacgcctacgcgttcgtcaacggcatcgaggttgtctcctcccccgatctcttcgacatctccaccccgaatctggtcaccggggatggcaacaatcagccattcccgatcgacgctggcactgctctgcagacaatgtaccgacttaatgtcggcggccaggcgatctccccctccaaggacacgggcggttaccgttcgtgggacgatgactcgccatacgtttttggtgcggcgttcggggtgtcctacccaaaagatgacaatgtcaccattgcctaccctagcaatgtgccggagtatgtggcgccggtggatgtctatgctacggcaaggtcgatggggccggacaagaacgtgaacttggcatacaacctcacttggataatgcaggtggatgctgggttcacataccttgtgaggcttcatttctgtgagatacaatatccaatcactatgatcaatcagcgggtgttcaacatttacatcaacaaccagactgcttttcagggcgccgatgtgattgcatggactaataacaatgggatcggcagtccagtgtatcaagactttgtagtgacaacagttggttcaggggctatggatttgtgggtagctctctatccagatgtccaggctaaaccacagtactatgatgctatcctcaatggactggaggtgttcaagttgccgcttagtaatgggagccttgctgggctcaaccctgttccaactgttgagccatcgttggatggtggagcagtgaagaagtcaagtgttgggcctattgttggtggagtgattggaggtctggtggttcttgcacttggatattgctgctttatgatctgcaagcgtcggagcagagtggggaaggacacaggcatgagtgatgggcattctggatggttgccactttcactctatggcaactcacactcatctggctcagccaaatcacatactactgggagctacgcttcatcgctgccatccaacctgtgccgccatttctcatttgcggagatcaaggctgcaacaaacaacttcgatgaatccctcctccttggtgtgggtggtttcggtaaagtgtatcgtggggagattgatggtggagtgaccaaggtggctatcaagcgtgggaatccactgtctgagcagggtgtgcatgagttccaaaccgagattgagatgctgtcgaagctccgccaccgtcatcttgtgtcactgattggttactgtgaggagaagaatgagatgatcctggtctatgactacatggctcatggaactcttcgtgagcacctgtacaagaccaagaatgcaccacttacatggaggcagcgcttggagatctgcattggtgctgcccgtgggcttcactaccttcacactggtgcgaagcacacaatcatccaccgtgatgtgaagacaacaaatatcctcctggatgagaagtgggtcgcgaaggtttcagattttggtctgtcaaagactgggccatcgatggatcacacacatgtgagcacagttgtcaagggaagttttggctaccttgaccctgaatacttccgcaggcagcagctcactgagaaatctgatgtctactcctttggtgttgtgctatttgaggtcctctgtgctcgccctgccttgaaccccactcttgctaaggaagaagttagcttggcagagtgggccctgcactgccagaagaagggtattcttgatcagattgttgatccccacctgaagggaaagatcgctccacagtgcttcaagaagtttgccgagactgctgagaaatgtgtttcagatgaaggcatcgatcgtccttcaatgggagatgtgctgtggaacttggaatttgcccttcaaatgcaggaaagtgcagaggatagtggaagcattggttgtgggatgtcagatgagggcactccccttgtgatgcctggaaagaaggatcccaatgatccatcgatcgagtcaagcaccactacaaccacaaccacgtccataagcatgggcgaccaaagtgttgctagcatagactccgacgggcttactcctagcgctgtcttctcacagatcatgaaccccaagggacggtgagctaacagtctttgcttgtcacctgcaggcattatttattctttaaacgtattctcatgagtttgtgatgttgattttctgtcaatttatggacctggaagtcagagagttgttccatattagatatttttgttttgtgctgtatattgtccatgctgtggtgacttggatacttattggctttgtattgtactctaccgctggtattaaccaccagttgatctctattactgtatacgaaagctatgcgcaagaccatcttcattttcattgcctttctgatgtgtttggtcagagcccagcgttagttagcagagagcctggtagtatcacttttttccgaaaaaaattctcgtgtacaggtatcattgatttggtgtgctatgtagatggtgtttgttgcataagccattttcatgcatatactgaaatactggactatgatgtttttctgatgtcatgttgttttacaagtataaatctagtataacaccaatcttgaacttttattctatgtagtaccctttttttttatgctggtttacttcaagctgtatagacgttcagggttatggattgttgtccactccgtgttatcttgatctggcg

SEQ ID NO: 1408 - DNA, 3189 bp, Oryza sativa
aggagctcgcttgctttgccgttgccgacgtcgcccccaatctcccgcataacgccgcggccgtagtagtcccgaaacctccctcccccacattgcttgtctcctccaccttgaacccgagtttctcacccacatccaccagatctgcgaggaggtaggaaagctcgatgcccgatctgtgaagcggaagcagttagctagttgtagttgagagcgggggtggccacaatgggaagctccagattcgtgctcttgctcctcctcctcctcgccgtggcggcttgcgtcgcgcgggggcaaggcggcggaaactcgagcagcgcggcggcgccggcgccggctgcgggggcggggccgttcgtgccgcgggacgacatcctgctcgactgcggcgcgacggggaaggggaacgacacggacgggcgggtgtggagcggggacgccgggtccaagtacgcgccggcgagcctcggctcggcgtccgccgcggggcaggacccctcggtgccgcaggtgccctacctcaccgcgagggtctccgcggcgcccttcacctactccttcccgctcggcgccggccgcaagttcctcaggctccacttctacccggccaactactccagccgcgacgccgccgacgcgcgcttctccgtctccgtccccgccgccaacgtcacgctcctctccaacttcagcgcctaccagaccgccaccgccctcaacttcgcctacatcgtccgcgagttctccgtcaacgtcacgaccccgacgatggagctcaccttcacgccggagaagggccaccccaacgcctacgcgttcgtcaacggcatcgaggttgtctcctcccccgatctcttcgacatctccaccccgaatctggtcaccggggatggcaacaatcagccattcccgatcgacgctggcactgctctgcagacaatgtaccgacttaatgtcggcggccaggcgatctccccctccaaggacacgggcggttaccgttcgtgggacgatgactcgccatacgtttttggtgcggcgttcggggtgtcctacccaaaagatgacaatgtcaccattgcctaccctagcaatgtgccggagtatgtggcgccggtggatgtctatgctacggcaaggtcgatggggccggacaagaacgtgaacttggcatacaacctcacttggataatgcaggtggatgctgggttcacataccttgtgaggcttcatttctgtgagatacaatatccaatcactatgatcaatcagcgggtgttcaacatttacatcaacaaccagactgcttttcagggcgccgatgtgattgcatggactaataacaatgggatcggcagtccagtgtatcaagactttgtagtgacaacagttggttcaggggctatggatttgtgggtagctctctatccagatgtccaggctaaaccacagtactatgatgctatcctcaatggactggaggtgttcaagttgccgcttagtaatgggagccttgctgggctcaaccctgttccaactgttgagccatcgttggatggtggagcagtgaagaagtcaagtgttgggcctattgttggtggagtgattggaggtctggtggttcttgcacttggatattgctgctttatgatctgcaagcgtcggagcagagtggggaaggacacaggcatgagtgatgggcattctggatggttgccactttcactctatggcaactcacactcatctggctcagccaaatcacatactactgggagctacgcttcatcgctgccatccaacctgtgccgccatttctcatttgcggagatcaaggctgcaacaaacaacttcgatgaatccctcctccttggtgtgggtggtttcggtaaagtgtatcgtggggagattgatggtggagtgaccaaggtggctatcaagcgtgggaatccactgtctgagcagggtgtgcatgagttccaaaccgagattgagatgctgtcgaagctccgccaccgtcatcttgtgtcactgattggttactgtgaggagaagaatgagatgatcctggtctatgactacatggctcatggaactcttcgtgagcacctgtacaagaccaagaatgcaccacttacatggaggcagcgcttggagatctgcattggtgctgcccgtgggcttcactaccttcacactggtgcgaagcacacaatcatccaccgtgatgtgaagacaacaaatatcctcctggatgagaagtgggtcgcgaaggtttcagattttggtctgtcaaagactgggccatcgatggatcacacacatgtgagcacagttgtcaagggaagttttggctaccttgaccctgaatacttccgcaggcagcagctcactgagaaatctgatgtctactcctttggtgttgtgctatttgaggtcctctgtgctcgccctgccttgaaccccactcttgctaaggaagaagttagcttggcagagtgggccctgcactgccagaagaagggtattcttgatcagattgttgatccccacctgaagggaaagatcgctccacagtgcttcaagaagtttgccgagactgctgagaaatgtgtttcagatgaaggcatcgatcgtccttcaatgggagatgtgctgtggaacttggaatttgcccttcaaatgcaggaaagtgcagaggatagtggaagcattggttgtgggatgtcagatgagggcactccccttgtgatgcctggaaagaaggatcccaatgatccatcgatcgagtcaagcaccactacaaccacaaccacgtccataagcatgggcgaccaaagtgttgctagcatagactccgacgggcttactcctagcgctgtcttctcacagatcatgaaccccaagggacggtgagctaacagtctttgcttgtcacctgcaggcattatttattctttaaacgtattctcatgagtttgtgatgttgattttctgtcaatttatggacctggaagtcagagagttgttccatattagatatttttgttttgtgctgtatattgtccatgctgtggtgacttggatacttattggctttgtattgtactctaccgctggtattaaccaccagttgatctctattactgtatacgaaagctatgcgcaagaccatcttcattttca

SEQ ID NO: 1409 - DNA, 3800 bp, Brachypodium distachyon
gccgttgctggcctcgctccttaatgccgcaccagtaatcccgaaacatccctcccattccttaacgcctgccctcctctccaccgcggcgtcactttcccctttccttctctcctcaaatctcaccgctctgccgctacgctcctccgcgaatcagtcccccagatcggcgccgaggtggtcgccgtttcatgggcgatctgtgagccgctgcaacaaggagggaagtagctagctactacaactgacgccatggggagaagccccagatgtgtgctcctgctcctgctggccgcctgcgcggcggcgcttgtgcccgcggcgggggcgcagggagggggtaactcgaccgcgccggcgcccgctgcggcggggagcgcgcccttcgtgccgcgggacgacatcctgctcgactgcggcgccacggggaatgggaacgacacggacggccgggagtggggcggcgacgctgggtccaagtacgcaccggcgaacctcggctcggccatcgcgggggcgcaggacccctcggtgccgcaggtgccgtacctcaccgcgcgcgtgtcggcggcgcccttcacctactccttcccgctcggccccgggcgcaagttcctccggctgcacttctacccggccaactactccaaccgcaacgccgccgacgccttcttctccgtcaccgtcccggccgccaaggtcacgctcctctccaacttcagcgcctaccagaccagcacggcactcaacttcgcctacctcatacgggagttctccgtcaacgtcaccggccaaaccctcgacctcaccttcaccccggagaagggccaccccaacgcctacgccttcatcaatggcatcgaggttgtctcatcccctgatctcttcgacctctccactccagaattggtcatgggtgatggcaacaaccagccatacaccatggaagctggcactgctctgcagaccatgtatcggctcaatgtcggaggccaggcgatctccccctccaaggatacgggcgggtacaggtcgtgggacgacgacacgccttacatttggggtgctggtgcaggggtgtcgtaccagaacgatgccaatgtcacaatcacctacccggacaatgtgccgggttatgtcgcaccgacagatgtctatgccactgctcggtcaatggggccggacaaggacgtaaacttggcgtacaatctcacctggataatgcaggtggatgctggcttcttttaccttgtgaggctccatttctgtgagatacagtccccaattactaaacccaatcagcgggtgtttgacatttacatcaacaatcagactgccatggctggcgctgatgtgatcttatgggcgtctccaaatggtattggcagtccggtgtataaggactatgtggtgaacacaatgggttccgggactatggatttctgggtggctctccatcctgatgtaacgcagaagccgcagtactttgacgctattctcaatggaatggaggtgttcaagttgcaacagagtaatgggagtcttgtggggctcaaccctgtcccaagtgccgagccattggtggatggcggctcagggaagaagaaatcaacagttgggcctattgttggtggagtagttggaggtttggcagttcttgcacttggatactgcttcattgtcatatgcaagcgtcggaggagagcagggaaggatgctggcatgagtgatgggcactctggctggcttccgctgtcgctctatggcaattcacacacttcaggctcagccaagtcgcacaccacggggagctatgcttcatctttgccatccaacctgtgccgccatttctcttttgcagagatcaaggctgcaacaaagaactttgatgagtcactgattcttggtgtgggtggatttggtaaagtttaccgtggagaggttgatggaggcacaacaaaggtggctatcaagcggggtaatcctttgtctgagcagggtatacatgagttccagactgaaattgagatgttgtcgaagctccgccaccgtcatcttgtttcgctgattggttactgtgaggagaagaatgagatgatcctggtatatgactacatggctcatggaactctgcgcgagcacctgtacaagacccagaatgcaccacttagttggaggcagcgcttggagatctgcattggtgcagctcgtgggcttcactaccttcacacaggtgcaaagcataccatcatccaccgtgatgtgaagacgacaaacatcctcctagatgagaaatgggtcgccaaggtttcagatttcggtctgtccaagactgggccatcgatggatcacacacatgtgagcacagttgtcaagggcagttttggttacttagacccggaatacttccgcaggcagcagctcactgagaaatctgatgtctattcttttggtgttgtgttgtttgaggtcctttgtgctcggcctgccttgaaccccacacttgcaaaggaagaagtgagcttggcggagtgggcattgcactgccaaaagaagggcattctcgatcagattgtcgatccctacctaaaaggaaagatagttccacagtgctttaagaagtttgctgagacagctgagaagtgtgttgctgataatggcattgagcgcccttcgatgggagatgtgctttggaacttggagtttgccctacagatgcaggaaagcgcagaggagagcggaagcattggttgtgggatgtcagacgagggcactcccctcgtgatggttggaaagaaggatcccaatgacccgtcaattgattcaagcaccactacaaccacaactacttccataagcatgggcgaccaaagtgttgcgagcatcgactctgatgggctgacgcctagcgcggtcttctcgcagatcatgaaccccaaagggcggtgaggtaagaactggatatgtttgtcaccctccagacctaatttattcgttcatcgtatttttcctgagtttatgcccttgctgtatggattgggagtcagagaattgtttcatattagatattttgtcttgccttgtatttttctccagcactgtaatgactttatatgcttactggcttgtattgtaccaccgctgctacgtgctaggacccaacaaagtaataattatgagagagtgatgtgcacgaccttctcctttttagctgccttcatgtcatgtcaattttcaaatcgtggtgattgacactggatcgttctcctttatttccagagcaagatactctgcgttttgacaaaacccatttgtacaaaagctgtggacacttggcattgtagaggcgtgtcatggatatcattgaagaaagctgttttcgtattgtgttcaacatgctgtcttgatgttgattgttgcagcagttgtgctcatgcatatacccggggctaggctgtgttccatgtatttgttttaattgtaaactcaaaatagttgatgtggttgagctgtgcttccatcagttctatgtaatgccattatctggacaccagttgtcggtttacttacagttgtatagtgtatgcttgttaagtttctggatccagtgtgctggccacgttttcttctctgcaaaatatgtcaatcgatccagctgctcgtcttccctgtcgtcggttgattaatttgcttacagttgcgtacgtctaaagaaagagtggaatcaaataaatctaggcccagctgtgctgtcgagataatgaggactttaatatgattccagagtccagcgaagaaaa

SEQ ID NO: 1410 - DNA, 3294 bp, Brachypodium distachyon
accagtaatcccgaaacatccctcccattccttaacgcctgccctcctctccaccgcggcgtcactttcccctttccttctctcctcaaatctcaccgctctgccgctacgctcctccgcgaatcagtcccccagatcggcgccgaggtggtcgccgtttcatgggcgatctgtgagccgctgcaacaaggagggaagtagctagctactacaactgacgccatggggagaagccccagatgtgtgctcctgctcctgctggccgcctgcgcggcggcgcttgtgcccgcggcgggggcgcagggagggggtaactcgaccgcgccggcgcccgctgcggcggggagcgcgcccttcgtgccgcgggacgacatcctgctcgactgcggcgccacggggaatgggaacgacacggacggccgggagtggggcggcgacgctgggtccaagtacgcaccggcgaacctcggctcggccatcgcgggggcgcaggacccctcggtgccgcaggtgccgtacctcaccgcgcgcgtgtcggcggcgcccttcacctactccttcccgctcggccccgggcgcaagttcctccggctgcacttctacccggccaactactccaaccgcaacgccgccgacgccttcttctccgtcaccgtcccggccgccaaggtcacgctcctctccaacttcagcgcctaccagaccagcacggcactcaacttcgcctacctcatacgggagttctccgtcaacgtcaccggccaaaccctcgacctcaccttcaccccggagaagggccaccccaacgcctacgccttcatcaatggcatcgaggttgtctcatcccctgatctcttcgacctctccactccagaattggtcatgggtgatggcaacaaccagccatacaccatggaagctggcactgctctgcagaccatgtatcggctcaatgtcggaggccaggcgatctccccctccaaggatacgggcgggtacaggtcgtgggacgacgacacgccttacatttggggtgctggtgcaggggtgtcgtaccagaacgatgccaatgtcacaatcacctacccggacaatgtgccgggttatgtcgcaccgacagatgtctatgccactgctcggtcaatggggccggacaaggacgtaaacttggcgtacaatctcacctggataatgcaggtggatgctggcttcttttaccttgtgaggctccatttctgtgagatacagtccccaattactaaacccaatcagcgggtgtttgacatttacatcaacaatcagactgccatggctggcgctgatgtgatcttatgggcgtctccaaatggtattggcagtccggtgtataaggactatgtggtgaacacaatgggttccgggactatggatttctgggtggctctccatcctgatgtaacgcagaagccgcagtactttgacgctattctcaatggaatggaggtgttcaagttgcaacagagtaatgggagtcttgtggggctcaaccctgtcccaagtgccgagccattggtggatggcggctcagggaagaagaaatcaacagttgggcctattgttggtggagtagttggaggtttggcagttcttgcacttggatactgcttcattgtcatatgcaagcgtcggaggagagcagggaaggatgctggcatgagtgatgggcactctggctggcttccgctgtcgctctatggcaattcacacacttcaggctcagccaagtcgcacaccacggggagctatgcttcatctttgccatccaacctgtgccgccatttctcttttgcagagatcaaggctgcaacaaagaactttgatgagtcactgattcttggtgtgggtggatttggtaaagtttaccgtggagaggttgatggaggcacaacaaaggtggctatcaagcggggtaatcctttgtctgagcagggtatacatgagttccagactgaaattgagatgttgtcgaagctccgccaccgtcatcttgtttcgctgattggttactgtgaggagaagaatgagatgatcctggtatatgactacatggctcatggaactctgcgcgagcacctgtacaagacccagaatgcaccacttagttggaggcagcgcttggagatctgcattggtgcagctcgtgggcttcactaccttcacacaggtgcaaagcataccatcatccaccgtgatgtgaagacgacaaacatcctcctagatgagaaatgggtcgccaaggtttcagatttcggtctgtccaagactgggccatcgatggatcacacacatgtgagcacagttgtcaagggcagttttggttacttagacccggaatacttccgcaggcagcagctcactgagaaatctgatgtctattcttttggtgttgtgttgtttgaggtcctttgtgctcggcctgccttgaaccccacacttgcaaaggaagaagtgagcttggcggagtgggcattgcactgccaaaagaagggcattctcgatcagattgtcgatccctacctaaaaggaaagatagttccacagtgctttaagaagtttgctgagacagctgagaagtgtgttgctgataatggcattgagcgcccttcgatgggagatgtgctttggaacttggagtttgccctacagatgcaggaaagcgcagaggagagcggaagcattggttgtgggatgtcagacgagggcactcccctcgtgatggttggaaagaaggatcccaatgacccgtcaattgattcaagcaccactacaaccacaactacttccataagcatgggcgaccaaagtgttgcgagcatcgactctgatgggctgacgcctagcgcggtcttctcgcagatcatgaaccccaaagggcggtgagagcaagatactctgcgttttgacaaaacccatttgtacaaaagctgtggacacttggcattgtagaggcgtgtcatggatatcattgaagaaagctgttttcgtattgtgttcaacatgctgtcttgatgttgattgttgcagcagttgtgctcatgcatatacccggggctaggctgtgttccatgtatttgttttaattgtaaactcaaaatagttgatgtggttgagctgtgcttccatcagttctatgtaatgccattatctggacaccagttgtcggtttacttacagttgtatagtgtatgcttgttaagtttctggatccagtgtgctggccacgttttcttctctgcaaaatatgtcaatcgatcc

SEQ ID NO: 1411 - DNA, 3334 bp, Secale cereale
gactgagtaggtcggcgttgccgttgctggcagccccacttttaatgccgcggccgtagtcccgaaacctctctccccttcccttcttcctccctgacgccaccctcaccctgaccctccaccacctcggccgggccaccactttcccctcaaatctcacctcctccgccacgccagcacgcaaatcagcccccagatcggtgccgagagccgtttgatgggcgatctgtgagccgcgaggacacgcaagctcgcaccatgagaggaggcccgagatgcgcgctgctgctcctcctggccgccgccgcggcgtttgtccccgcggcgcgggcgcagggggcgaccgcgcccgcgccctcggcgggggccccgttcgtgccgcgggacgacatcctgctcgactgcggcgccacggggaaggggaacgacaccgacggccgccagtgggacggcgacgccggctccaagtacgcgccgcccaacctcgcctcggccagcgccggggcgcaggacccctcggtgccgcaggtgccctacctcaccgcgcgggtctcggcggcgcccttcacctactccttcccgctcggccccggccgcaagttcctcaggctgcacttctacccggccaactactccaaccgcgacgccgccgacgccttcttctccgtctccgtcccggccgccaaggtcacgctcctttccaacttcagcgcctaccagaccaccacggcgctcaacttcgcctacatcgtgcgcgagttctccgtcaacgtcaccggccagaacctcgacctcaccttcaccccggagaagggccaccccaacgcctacgccttcatcaacggcatcgaggtcgtctcctcccctgacctctttgacctcgccacgctgcaattcgtcaccggtgacggcaacagccagccatacgagatggatcctgctgctgctctgcagaccatgtatcggctcaacgtcggaggccaggccatctccccttccaaggactccggcggggctcggtcatgggacgacgacacgccttacatctatggtgcaggggctggggtatcgtaccagaacgatcccaatgtcacaatcacctaccctgacaatgtgccgggatatgtggcaccttcggatgtctatgccacggcgcggtcaatggggccagacaagggtgtaaacatggcctacaatctcacctggatattgcaggtggatgctgggtaccaataccttgtgaggctccatttctgtgagatacaatccccatttactaaacccaaccagcgggtgttcaacatctacctcaacaaccagactgccatgcaaggtgctgatgtgatccagtgggcggatcccaatggtattggtaccccagtgtacaaggactatgtggtgagtactgtgggttctgggattatggatttctgggtggctctacatccggatgcagagaccaagccgcagtactatgatgctattctcaatgggttggaggtgttcaagctgcaacttactaatgggagcctcgtggggctcaaccctgtcccaagtgctgatccaccggcgggtagcgggtcaggagacaagaaatcaattgtcgctcctattgttggtggagtaattggaggtttggcagtgcttgcgctcggatattgctgcttcatctgcaagcgccggaggaaagcggccaaggctagcggcatgagtgatggccattctggttggctgccgttgtcgctgtatggccattcacacacttcaagctcagccaagtcacatgctacagggagttatgcttcatctttgccgtccaacctgtgccgccatttctcctttgcagagatcaaggccgcaacaaaaaactttgatgagtcacggatccttggtgttggtgggttcggtaaagtctaccatggagagattgacgggggcacaactaaggtggctatcaagcgtggcaatcccttgtctgagcagggcatacatgagttccagactgaaattgaaatgttgtcaaagctcaggcaccgtcatcttgtgtcgctgattggttactgcgaagagaagaatgagatgatcctggtctatgactacatggctcatggaaccctgcgggagcacctatacaagacccagaatgcaccgcttagctggaggcagcgtttggagatctgcatcggtgcggctcgtgggcttcactacctccacaccggtgcaaagcacaccattatccaccgtgatgtgaagacgacaaacatactcctggatgagaaatgggttgccaaggtttcagattttggtctgtccaagactgggccatccatggatcacacacatgtgagcacagttgtcaagggcagttttggttacctagatcctgaatatttccgcaggcagcagctcactgagaaatctgatgtgtattcgtttggtgtggtgctgtttgaggtcctttgtgctcgacctgccttgaaccccactcttgcaaaggaagaagttagcttggcagagtgggcactgcactgccaaaagaagggaattctcgatcagattgttgatccctacctgaagggaaagattgttccgcagtgcttcaagaagtttgccgagacggctgagaagtgtgttgccgacaatggcatcgagcgaccttcgatgggagatgtgctttggaacctggagtttgctcttcagatgcaggaaagcgcggaggagagcggaagcattgggtgtgggatgtcagatgagggcactcccctcgtgatggctggaaagaaggatcccaatgacccatcaattgattccagcaccgctacaaccacaacaacttccctaagcatgggtgaccaaagtgtcgcgagcatcgactcagatgggctgacgccaagcgcggtgttctcacagatcatgaaccccaaggggcggtgaggtaaaaatctgggtctgcttttcagtcagtcacccttggggactgcctaatttattcattcagcatattttcatgagtttgtgctcttgctgtcttgcaagttatgcattagaagtcagagaattgttccatattagatatttctgtcttgccttgttttcttcttcttcttccttcttcttcttcagtgttgtaatgactctatgcttatttgcatgtgttattgtaccaccactgctatgcgtcattgacccaacatgtaataccgtatgagaaagggaaagtgatgtgcacgacctttgttaccccttttttaaaaaaaaaaaaaaaaagaaaaaaagaaaaaaagaaaaaaagaaaaagtaaggtaggagagacgacacgagaggagaggggggg

SEQ ID NO: 1412 - DNA, 3281 bp, Secale cereale
cccccttcttcctcgacgccaccctcccccttctcccctccccaccgccaccagtaccgccgcttccccctcaaatcccacctcagccgccgcgcgcagctcccacccgcgcgcaaatccgccccagatcggcgccgggcgagctgtttgatgggcgatctgtgagagccgcgagcaaacgccgagctacatacagctcgcggtcgcaccatgggaggaggccccagatgcgcgctcctgctgctcgccgcttgcgtggcgcttgtcccggcggcgtgggcgcagggctcgaccgcgcccgcgccctccggggcccccttcgtgccgcgggacgacatcctgcttgactgcggcgccacggggaagggcaacgacacggacggccgggagtggcgcggcgacgccggctccaagtacgcgccgccgaacctcgcctcggccgacgcgggggcgcaggacccctcggtgccgcaggtgccctacctcaccgcgcgggtctcggccgcggccttcacctactccttcccgctcggccccggccgcaagttcctccggctgcacttctacccggccaactactccaaccgcgacgccgccgacgccctcttctccgtctccgtcccggcggccaaggtcacgctcctctccaacttcagcgcctaccagaccaccacggcgctcaacttcgcctacatcgtgcgggagttctccgtcaacgtcaccggcccgaccctcgacctcaccttcaccccggagaagggccaccccaaggcctacgccttcatcaatggcatcgaggtcgtctcctccccagatctctttgacctcgccacaccgctcttcgtcaccggtgacggcaacaaccagccattcccgatggatcctggtgctgctctgcagaccatgtatcggctcaacgtcggaggccaggcgatctccccttccaaggactccggcggagcacggtcatgggacgacgacacgccttacatttatggtgcaggggctggggtaacctacccgaacgatcccaatgttacaatcacctaccctgacaatgtgccgggatatgtggcgccttcggatgtctatgccacggcgcgatcgatggggccagacaaggatgtgaacttggcctacaatctcacctggatagtgcaggtggatgctgggttcacataccttgtgaggctccatttctgtgagatacaatccccaattacgctgccgaatcagcgggtgttcaacatttacctcaacaaccagactgccgtggaaggtgctgatgtgatccagtgggtggatccgcttagtactggtaccccattgtataaggattatgtggtcagcactgtgggttcagggattatggatttctgggtggctctacatccgaatacagggagcaagccacagtactatgatgctattctcaatgggatggaggtgttcaagctgcaacttagtaatgggagcctcgcggggcccaaccctgtcccaagtgctgatccaccggcgcatacggggcaagggaagaagaattcactagtcgggcctattgctggtggagtaattggaggtttggcagtgcttgcacttggatattgctgcttcatttgcaagaggcggaggaaagcggcgaaggataccggcatgagtgatggccattctggttggctgccattgtcgctgtatggcaattcacacacttcaagctcagccaagtcgcatggtacagggagtattgcttcatctttgccgtcgaacctgtgtcgccatttctcctttgcagagatcaaggctgcaacgaaaaactttgacgagtcacggatccttggtgttggtgggttcggtaaagtttaccagggagagattgatgggggcacagttaaggtggctatcaagcgtggcaatcccttgtctgagcagggtatacatgagttccagactgaaattgaaatgctgtcaaagctccgccaccgtcatcttgtgtcgctgattggttactgcgaggacaagaatgagatgatcctggtctatgaccacatggctcatggaactctgcgtgagcacctatacaagacccagaatgcgccgcttagctggaggcagcgtttggagatctgcattggtgcagcccgtgggctgcactaccttcacaccggtgcaaagcacaccattatccaccgtgatgtgaagacgacaaacatcctcctggatgagaaatgggtcgccaaggtttcagattttggtctgtccaagactgggccatcgatggatcacacacatgtgagcacagttgtcaagggcagttttggttacctagatcctgaatacttccgtaggcagcagctcaccgagaaatctgatgtctattcatttggtgtggtgctgttcgaggtcctctgtgctcggcctgccttgaaccccactcttgcaaaggaagaagtcagcctggcagaatgggcattgcactgccagaagaagggaattctggatcagattgttgatccctacctaaagggaaagattgttccacagtgcttcaagaagtttgccgagacagctgaaaagtgcgttgccgacaatggcatcgagcgcccttcgatgggagatgtgctttggaacctggagtttgctcttcagatgcaggaaagcgcggaggagagcggaagcttcggctgtgggatgtcggatgagggcactccgctcgtgatggctggaaagaaggatcccaacgacccatcgatcgattcaagcaccaccacgaccacaacaacttccctaagcatgggcgaccaaagtgttgcgagcatcgactcggacgggctgacgccgagcgcggtcttctcacagatcatgaaccccaaggggcggtgaggtaaaattcggggcctgtttatcgcccttgaggcctaatttattcgttcagtgtattttcgtgagtttgtgctcttgctatcttgcaagatgcaagtcatgagtttgtattttcattcagtgtctagacatttctgccttgccttgttttcttcttcttcgtcagcgttgtgatgactctatgcttattagcatgtgtaattaccgcggctgctacgtgttattgacccaacaagtaaatactgtatgagaaagtgatgtgcacggccttttcctttttcttttgccttcatgtcatactcttttccgaatccaggtgattgacacccatgttgtgttgatgttgattgttgcgtcatgctcaagcatatgctgtgttgcatgtcgtcttgtgttctaac

SEQ ID NO: 1413 - DNA, 3011 bp, Oryza sativa
gccgcgaaaatcgccccagatcggtggatgggcgatctgtgagccgcggcagggggagagagagagagagagaggaagctgaagccatgatggtgagttctaggtttgtggccgtgcttcttctggtggcgctggcgccggcggcgcgggggcagggaggaggagggggcaactcgagcgccccggcggcgtcgccgccggggccgttcgtgccgcgggacaacatcctgctcgactgcggcgcgacggggcaggccaacgacacggacgggcggctctggaccggggacacgggctccaagtacctgccggcgaacctcgccgccgcggccgccaccgcgcaggacccttctgtgccgcaggtgccgtacctcaccgcgcgcttctccgcggcgcccttcacctactcgttcccggtcggcgccgggcgcaagttcctcaggctccacttctacccggcgaactactccaaccgcaacgccgccgacgcgctcttctccgtctccatccccgaccccaacatcacgcttctctccaacttcagcgcctaccagaccgccctcgccctcaacttcgactacctcgtccgcgaattctccgtcaatgtcactgcctcaaccctcgacctcactttcacaccggagaagggccacccaaacgccttcgccttcgtcaacggcatcgaggtcgtctcctcccccgacctctttggcagctccaacccgatggaggtcaccggcgacggcagcggcacgcctttcccgatcgacgccggtactgctatgcagaccatgtaccggctcaacgtcggcggcaacgcgatctccccctccaaggacacgggcgggtatcggtcatgggaagatgacacgccatacataccctttgcgtcattcggggtgagctacgcgaatgacaccaatgttcccataaattaccctgacagtattccgcagtatgtggcgccggcagatgtctactctacggcgcggtcgatggggcctgacaacaatgtgaatttgcaatacaatctcacctgggcaatgcaggtggatgctggttatcagtatctcgtgaggctccatttctgtgaaatacagtctgggatcagtaagatcaatcaacggacatttgacatctacatcaacaaccagactgcttttagtggcgctgatgtgattgcgtggtctactgggcttggcattccagtgtacaaggattttgtggtgttccccatgggttcagggcctatggatttgtgggtggatctacatccaaatgtcaaaaacaagccacagtactataatgctatcctcaatgggatggaggtttttaagttgcagcttactaatgggagccttgctgggctcaaccctgtccctagtattgtaccaacagcgtcgggtggaaattctgggaagaagtcaagtgttggtccaattattggaggagtgattggaggtctggtagttcttgcacttggatgttgctgcttctttgtgatctgcaagcgtcggcagagagcaggtaaggattcaggaatgagtgatgggcattctggttggttgccgctctcactttatggcaactcacacacttccagctcagccaagtcacacactactgggagccatgcttcgtctttgccatccaacctgtgccgccatttctcatttgtggagatcaaggctgcgacaaacaactttgatgagtccctcctccttggcgtgggtggttttggtaaagtttaccgtggagagattgacggaggagcaaccaaggtggctatcaagcgtggaaacccattgtctgagcagggtgtgcatgagttccaaacagagatcgagatgttgtcgaagctccgccaccgacatcttgtgtcgcttattggttactgcgaggagaagaatgagatgatcctggtctatgactatatggctcacggaactcttcgtgagcacctgtacaagacccaaaatgcaccactttcttggaggcagcgcttggatatctgcattggtgcagctcgtgggcttcactacctacacactggtgcaaagcacaccatcatccaccgtgatgtgaagacgacaaacatcctcctcgatgagaagtgggtagccaaggtttcagattttggtttgtccaagactggtccaacaatggatcatacgcatgtgagcacagttgtcaagggcagttttggttatcttgatcctgagtacttccgcaggcagcagcttactgacaaatctgatgtctattcttttggtgttgtactgtttgaggtcctatgtgctcggcctgccttgaatcccactcttgcaaaggaagaagttagcttggctgagtgggcattacactgccagaagaagggtattcttgatcagattgttgatccccacctgaagggaaagattgctccacaatgtttcaagaagtttgcagaaacagctgagaagtgtgtttctgatcagggcattgaccgtccttcgatgggagatgtgctgtggaacttggaatttgcccttcaaatgcaggaaagtgcagaggagagcggaagccttggatgtgggatgtcagacgacagcactccccttgtgatagttggaaagaaggatcccaatgatccatctatcgagtcaagcaccacgacaacgacaactacctcgataagcatgggtgagcagagtgttgcaagtattgactcggatgggctgacgcctagtgctgtcttctcgcagatcatgaaccccaagggacggtgaggtaacaatgtctcggtttgttaccctgcaggcataatctattcattcagcatatgttcatgagtttgcccttatgttctcttgaattatggatcggaagtcagataattgtttcaaattagatggttctgtctttccctgtgttttctccctgatgtagtgcctataagcttatcggcatgtattgtaatataccataccactgctattgacccaacgaatgatactgtatgagagagtgat

SEQ ID NO: 1414 - DNA, 4179 bp, Oryza sativa
gcggtagcgagacggctccagcacgacgcggtaagcgagcgagcacgagcagtagggcggagtaggtcgccgttgccgttgctggtggcctctcccacttaatgccgcggccgtaatcccgaagcctcacatcacacccccccccccccctttcctcacgcgagctccccctccaccaccgccgccgccgccgcggctgccactctcggttcctcttcctccccaccgagctccaccccccacgaatcttagcctcccactcctcttcacgccgcgccgctaagagcgatcgagccgggggtttccgtcagagacgccgcgaaaatcgccccagatcggtggatgggcgatctgtgagccgcggcagggggagagagagagagagagaggaagctgaagccatgatggtgagttctaggtttgtggccgtgcttcttctggtggcgctggcgccggcggcgcgggggcagggaggaggagggggcaactcgagcgccccggcggcgtcgccgccggggccgttcgtgccgcgggacaacatcctgctcgactgcggcgcgacggggcaggccaacgacacggacgggcggctctggaccggggacacgggctccaagtacctgccggcgaacctcgccgccgcggccgccaccgcgcaggacccttctgtgccgcaggtgccgtacctcaccgcgcgcttctccgcggcgcccttcacctactcgttcccggtcggcgccgggcgcaagttcctcaggctccacttctacccggcgaactactccaaccgcaacgccgccgacgcgctcttctccgtctccatccccgaccccaacatcacgcttctctccaacttcagcgcctaccagaccgccctcgccctcaacttcgactacctcgtccgcgaattctccgtcaatgtcactgcctcaaccctcgacctcactttcacaccggagaagggccacccaaacgccttcgccttcgtcaacggcatcgaggtcgtctcctcccccgacctctttggcagctccaacccgatggaggtcaccggcgacggcagcggcacgcctttcccgatcgacgccggtactgctatgcagaccatgtaccggctcaacgtcggcggcaacgcgatctccccctccaaggacacgggcgggtatcggtcatgggaagatgacacgccatacataccctttgcgtcattcggggtgagctacgcgaatgacaccaatgttcccataaattaccctgacagtattccgcagtatgtggcgccggcagatgtctactctacggcgcggtcgatggggcctgacaacaatgtgaatttgcaatacaatctcacctgggcaatgcaggtggatgctggttatcagtatctcgtgaggctccatttctgtgaaatacagtctgggatcagtaagatcaatcaacggacatttgacatctacatcaacaaccagactgcttttagtggcgctgatgtgattgcgtggtctactgggcttggcattccagtgtacaaggattttgtggtgttccccatgggttcagggcctatggatttgtgggtggatctacatccaaatgtcaaaaacaagccacagtactataatgctatcctcaatgggatggaggtttttaagttgcagcttactaatgggagccttgctgggctcaaccctgtccctagtattgtaccaacagcgtcgggtggaaattctgggaagaagtcaagtgttggtccaattattggaggagtgattggaggtctggtagttcttgcacttggatgttgctgcttctttgtgatctgcaagcgtcggcagagagcaggtaaggattcaggaatgagtgatgggcattctggttggttgccgctctcactttatggcaactcacacacttccagctcagccaagtcacacactactgggagccatgcttcgtctttgccatccaacctgtgccgccatttctcatttgtggagatcaaggctgcgacaaacaactttgatgagtccctcctccttggcgtgggtggttttggtaaagtttaccgtggagagattgacggaggagcaaccaaggtggctatcaagcgtggaaacccattgtctgagcagggtgtgcatgagttccaaacagagatcgagatgttgtcgaagctccgccaccgacatcttgtgtcgcttattggttactgcgaggagaagaatgagatgatcctggtctatgactatatggctcacggaactcttcgtgagcacctgtacaagacccaaaatgcaccactttcttggaggcagcgcttggatatctgcattggtgcagctcgtgggcttcactacctacacactggtgcaaagcacaccatcatccaccgtgatgtgaagacgacaaacatcctcctcgatgagaagtgggtagccaaggtttcagattttggtttgtccaagactggtccaacaatggatcatacgcatgtgagcacagttgtcaagggcagttttggttatcttgatcctgagtacttccgcaggcagcagcttactgacaaatctgatgtctattcttttggtgttgtactgtttgaggtcctatgtgctcggcctgccttgaatcccactcttgcaaaggaagaagttagcttggctgagtgggcattacactgccagaagaagggtattcttgatcagattgttgatccccacctgaagggaaagattgctccacaatgtttcaagaagtttgcagaaacagctgagaagtgtgtttctgatcagggcattgaccgtccttcgatgggagatgtgctgtggaacttggaatttgcccttcaaatgcaggaaagtgcagaggagagcggaagccttggatgtgggatgtcagacgacagcactccccttgtgatagttggaaagaaggatcccaatgatccatctatcgagtcaagcaccacgacaacgacaactacctcgataagcatgggtgagcagagtgttgcaagtattgactcggatgggctgacgcctagtgctgtcttctcgcagatcatgaaccccaagggacggtgaggtaacaatgtctcggtttgttaccctgcaggcataatctattcattcagcatatgttcatgagtttgcccttatgttctcttgaattatggatcggaagtcagataattgtttcaaattagatggttctgtctttccctgtgttttctccctgatgtagtgcctataagcttatcggcatgtattgtaatataccataccactgctattgacccaacgaatgatactgtatgagagagtgatacgcatgatccacactcccttttttgttatcttaatcatgtgttcggtcggagccccaacacaacagctgctgagctgcacttattgtcttgtataatattgttcatcatactcgattgttggcagagctaggttgagtccattttggcaaaatcgctgtgtgcaaagatgttagcatgtggcattgaattagaggtgttgggtcgatgattctagaaagcttttatgctgctatattttgaccatgctagatgccgattgttgcatctgtcgtgctcatgcacatacaccaacgaaccttgttttccttgtcttcttgtcttacaattgtgtatctataatataggtgttgaactgttgtactgtactagtgccgttatctggatattcattgatggtgtactaacagctgcgtagataattgaagtgtctggatccagattgctttgtattcggtgtcatcccatcttatcagcttttttttttccgagcaataatgtattggattttttttagtagctcgcctaacctactaattgcttggttttttccccgtgatggttggtgattatcttgcttatatctgtgtgcaagataaagagtaactgtatgcaggtacagtctaatgatacaattgaagatatttggatgaaagagtcgcaccattgcgtgaatttgtatcatcttgatgaaccgtggactatgatattccggggtgttatttttctcaagtgcacattctgactttctgagatgaatgggtcgatgacaccgtcaacaccgaaccttgttttcttcttcttggtgttcctttcagtggcctttctttaggctagtaatttttcttaccaac

SEQ ID NO: 1415 - DNA, 3264 bp, Oryza sativa
acatcacacccccccccccccctttcctcacgcgagctccccctccaccaccgccgccgccgccgcggctgccactctcggttcctcttcctccccaccgagctccaccccccacgaatcttagcctcccactcctcttcacgccgcgccgctaagagcgatcgagccgggggtttccgtcagagacgccgcgaaaatcgccccagatcggtggatgggcgatctgtgagccgcggcagggggagagagagagagagagaggaagctgaagccatgatggtgagttctaggtttgtggccgtgcttcttctggtggcgctggcgccggcggcgcgggggcagggaggaggagggggcaactcgagcgccccggcggcgtcgccgccggggccgttcgtgccgcgggacaacatcctgctcgactgcggcgcgacggggcaggccaacgacacggacgggcggctctggaccggggacacgggctccaagtacctgccggcgaacctcgccgccgcggccgccaccgcgcaggacccttctgtgccgcaggtgccgtacctcaccgcgcgcttctccgcggcgcccttcacctactcgttcccggtcggcgccgggcgcaagttcctcaggctccacttctacccggcgaactactccaaccgcaacgccgccgacgcgctcttctccgtctccatccccgaccccaacatcacgcttctctccaacttcagcgcctaccagaccgccctcgccctcaacttcgactacctcgtccgcgaattctccgtcaatgtcactgcctcaaccctcgacctcactttcacaccggagaagggccacccaaacgccttcgccttcgtcaacggcatcgaggtcgtctcctcccccgacctctttggcagctccaacccgatggaggtcaccggcgacggcagcggcacgcctttcccgatcgacgccggtactgctatgcagaccatgtaccggctcaacgtcggcggcaacgcgatctccccctccaaggacacgggcgggtatcggtcatgggaagatgacacgccatacataccctttgcgtcattcggggtgagctacgcgaatgacaccaatgttcccataaattaccctgacagtattccgcagtatgtggcgccggcagatgtctactctacggcgcggtcgatggggcctgacaacaatgtgaatttgcaatacaatctcacctgggcaatgcaggtggatgctggttatcagtatctcgtgaggctccatttctgtgaaatacagtctgggatcagtaagatcaatcaacggacatttgacatctacatcaacaaccagactgcttttagtggcgctgatgtgattgcgtggtctactgggcttggcattccagtgtacaaggattttgtggtgttccccatgggttcagggcctatggatttgtgggtggatctacatccaaatgtcaaaaacaagccacagtactataatgctatcctcaatgggatggaggtttttaagttgcagcttactaatgggagccttgctgggctcaaccctgtccctagtattgtaccaacagcgtcgggtggaaattctgggaagaagtcaagtgttggtccaattattggaggagtgattggaggtctggtagttcttgcacttggatgttgctgcttctttgtgatctgcaagcgtcggcagagagcaggtaaggattcaggaatgagtgatgggcattctggttggttgccgctctcactttatggcaactcacacacttccagctcagccaagtcacacactactgggagccatgcttcgtctttgccatccaacctgtgccgccatttctcatttgtggagatcaaggctgcgacaaacaactttgatgagtccctcctccttggcgtgggtggttttggtaaagtttaccgtggagagattgacggaggagcaaccaaggtggctatcaagcgtggaaacccattgtctgagcagggtgtgcatgagttccaaacagagatcgagatgttgtcgaagctccgccaccgacatcttgtgtcgcttattggttactgcgaggagaagaatgagatgatcctggtctatgactatatggctcacggaactcttcgtgagcacctgtacaagacccaaaatgcaccactttcttggaggcagcgcttggatatctgcattggtgcagctcgtgggcttcactacctacacactggtgcaaagcacaccatcatccaccgtgatgtgaagacgacaaacatcctcctcgatgagaagtgggtagccaaggtttcagattttggtttgtccaagactggtccaacaatggatcatacgcatgtgagcacagttgtcaagggcagttttggttatcttgatcctgagtacttccgcaggcagcagcttactgacaaatctgatgtctattcttttggtgttgtactgtttgaggtcctatgtgctcggcctgccttgaatcccactcttgcaaaggaagaagttagcttggctgagtgggcattacactgccagaagaagggtattcttgatcagattgttgatccccacctgaagggaaagattgctccacaatgtttcaagaagtttgcagaaacagctgagaagtgtgtttctgatcagggcattgaccgtccttcgatgggagatgtgctgtggaacttggaatttgcccttcaaatgcaggaaagtgcagaggagagcggaagccttggatgtgggatgtcagacgacagcactccccttgtgatagttggaaagaaggatcccaatgatccatctatcgagtcaagcaccacgacaacgacaactacctcgataagcatgggtgagcagagtgttgcaagtattgactcggatgggctgacgcctagtgctgtcttctcgcagatcatgaaccccaagggacggtgaggtaacaatgtctcggtttgttaccctgcaggcataatctattcattcagcatatgttcatgagtttgcccttatgttctcttgaattatggatcggaagtcagataattgtttcaaattagatggttctgtctttccctgtgttttctccctgatgtagtgcctataagcttatcggcatgtattgtaatataccataccactgctattgacccaacgaatgatactgtatgagagagtgatacgcatgatccacactcccttttttgttatcttaatcatgtgttcggtcggagccccaacacaaca

SEQ ID NO: 1416 - DNA, 2888 bp, Triticum aestivum
gacatcctgctcgactgcggcgccacggggaagggcaacgacacggacggccgggagtggcgtggcgacgccggctccaagtacgcgccgccgaacctcgcctccgccgacgcgggggcgcaggacccctcggtgccgcaggtgccctacctcaccgcgcgggtctccgcggcgcccttcacctactccttcccgctcggccccggccgcaagttcctccgcctgcacttctacccggccaactactccggccgcgccgccgccgacgccttcttctccgtctccgtcccggcagccaaggtcacgctcctctccaacttcagcgcctaccagaccgccacggcgttcaacttcgcctacctcgtgcgcgagttctccgtcaacgtcaccggcccgaccctcgacctcaccttcaccccggagaaggggcgccccaacgcctacgccttcatcaacggcatcgaggtcgtctcctccccggatctcttcgacctcgccacaccgttcttcgtcaccggtgacggcaacaaccagccgttcccgatggaccccggtgctgctctgcagaccatgtaccggctcaacgtcggaggccaggccatctccccttccaaggactccggcggggctcggtcatgggacgacgacacgccctacatttacggtgcaggggctggggtgtcgtacccgaacgatcccaatgtcacaatcacctaccctcccagtgtgccgggatatgtggcgccactggatgtctatgccacggcgcgatcaatggggatagacaagggtgtgaacttggcctacaatctcacctggatagtgcaggtggatgctgggttcacataccttgtgaggctccatttctgcgagatacaatccccaattgataagccgaatcagcgggtgttcaacatttacctcaacaaccagactgccgtggaaggtgctgatgtgctccagtgggtggatccgcgtagtaccggtaccccattgtacaaggatttcgtggtcggcactgtgggttcagggattatggatttctgggtggctcttcatccggatatacggaacaagccacagtactatgatgctattctcaatgggatggaggtgttcaagctgcaacttactaatgggagcctcgcggggccaaaccctgtcccaagtgctgatccagcggcgcataccgggcaagggaagaagagttcgcttgtcgggcctattgctggtggagtaattggaggtttggcagtgcttgcacttggatattgctgcttcatttgcaagaggcggaggaaagtggccaaggatgccggcatgagtgatggccattctggttggctgccgttgtcgctgtatggcaattcacacacttcaagctcagccaagtcgcatgctacagggagtattgcttcatctttgccatccaacctgtgccgccatttctcctttgcagagatcaaggctgcaacgaagaactttgacgagtcacggatccttggtgttggtgggttcggtaaagtttaccagggagagatcgatgggggcacaactaaggtggctatcaagcgtggcaaccccttgtctgagcagggcatacatgagttccagactgaaattgaaatgctgtcaaagctccgccaccgccatcttgtgtcgctgattggttactgcgaggacaagaatgagatgatcctggtctatgaccacatggcccatggaactctgcgtgagcacctatacaagacccagaatgcgccgcttagctggaggcagcgtttggagatctgcattggtgcagcccgtgggctgcactaccttcacaccggtgcaaagcacaccattatccaccgtgatgtgaagaccacaaacatcctcctggatgagaaatgggtcgccaaggtttcagattttggtctgtccaagactgggccgtcgatggatcacacacatgtgagcacagttgtcaagggcagtttcggttacctagatcctgaatacttccgcaggcagcagctcaccgagaagtctgatgtgtattcatttggcgtggtgctgttcgaggtcctctgtgctcggcctgccttgaaccccactcttgcaaaggaagaagtcagcctggcagaatgggcattgcactgccagaagaagggaattctggatcagattgttgatccctacctaaagggaaagatcgttccgcagtgcttcaagaagtttgccgagacagctgagaagtgcgttgccgacaacggcatcgagcgcccttcgatgggagatgtgctttggaacctggagtttgctcttcagatgcaggaaagcgcggaggagagcggaagcttcggctgtgggatgtcggatgaggagggcgctcccctggtgatggctggaaagaaggatcccaatgacccgtcaatcgattcaagcaccaccacgaccacgacaacttccctaagcatgggcgaccagagcgtcgcgagcatcgactcggacgggctgacgccgagcgcggtcttctcgcagatcatgaaccccaaggggcggtgaggtaaaaatccggttctgcttgtcgcccttcgggcctaatttattcattcagcatatttttcatgaatttgtgcacttgatctggcaagttatggactgggggtcagagaattgtttcatactgtaccattagacatttctgccttgccttgtattttcttcttcttcttcttcagcgttgtgatgactcgatgcttattagcatgtgtaattacggccgctgccacgtgttattgacccagcaagtaaatactgtatgagaaagtgatgtgcatggccttttcccctttttcgccttcattcatgctcctttccgaatcctggtgattgacacggga

SEQ ID NO: 1417 - DNA, 2941 bp, Triticum aestivum
acgacatcctgctcgactgcggcgccacgggaaggggaacgacacggacggccgccacgtgggacggcgaccccggggtccaagtacgcgccgcccaacctcgcctcggccagccccggggcggccaggacccctcccgtgccgcaggtgccctacctcaccgcccgggtctcggcggcgcccttcacctactccttcccgctcggccccggccgcaagttcctcaggctgcacttctacccggccaactactccaaccgcgacgccgccgacgccttcttctccgtctccgtcccggccgccaaggtcacgctcctctccaacttcagcgcctaccagaccaccacggcgctcaacttcgcctacatcgtacgcgagttctctgtcaacgtcaccggccagaacctcgacctcaccttcaccccggagaagggccaccccaacgcctacgccttcatcaacggcatcgaggtcgtctcctcccccgacctctttgacctcgccacgccgcaattagtcaccggtgacggcaacagccagccatacgagatggatcctgctgctgctctgcagaccatgtatcggctcaacgtcggaggccaggccatctccccttccaaggactccggcggggctcggtcatgggacgacgacacgccttacatctatggtgcaggggctggggtatcgtaccagaacgatcccaatgtcacaatcacctaccctgacaatgtgccgggatatgtggcaccttcggatgtctatgccacggcgcgatcaatggggccagacaagggtgtaaacatggcctacaatctcacctggatattgcaggtggatgctgggtaccaataccttgtgaggctccatttctgtgagatacaatccccatttactaaacccaatcagcgggtgttcaacatctacctcaacaaccagactgccattgaaggtgctgatgtgatccagtgggcggatcccaatggtattggtaccccagtgtacaaggactatgtggtgagcactgtgggttctgggattttggatttctgggtggctctacacccagatgcagagacgaagccacagtactatgatgctattctcaatgggatggaggtgttcaagctgcaacttactaatgggagcctcgtggggctcaatcctgtcccaagtgctgatccaccagcgcatagcgggtcaggagacaagaaatctaaagtcgcgcctattgttggtggagtaattggaggtttggcagtgcttgcgcttggatattgctgcttcatctgcaagcgtcggaggaaagcggccaaggctagcggcatgagtgacggccattctggttggctgccattgtcgctgtatggccattcacacacttcaagctcagccaagtcgcatgctacagggagttatgcttcatctttgccgtccaacctgtgccgccatttctcctttgcagagatcaaggccgcaaccaaaaactttgatgagtcacggatccttggcgttggtgggttcggtaaagtctaccatggagagattgacgggggcacaactaaggtggctatcaagcgtggcaatcccttgtctgagcagggcatacatgagttccagactgaaattgaaatgctgtcaaagctccgccaccgccatcttgtgtcgctgattggttactgcgaggacaagaatgagatgatcctggtctatgaccacatggctcatggaactctgcgtgagcacctatacaagacccagaatgcaccgcttagctggaggcagcgtttggagatctgcattggtgcagctcgtgggctgcactaccttcacaccggtgcaaagcacaccattatccaccgtgatgtgaagacaacaaacatcctactggatgagaaatgggtcgccaaggtttcagattttggtctgtccaagactgggccatcgatggatcatacacatgtgagcacagttgtcaagggcagttttggttacctagatcctgaatacttccgcaggcagcagctcaccgagaaatctgatgtctattcgtttggtgtggtgctgttcgaggtcctctgtgctcggcctgccttgaacccgactcttgcaaaggaagaagttagcctggcagaatgggcattgcactgccagaagaagggaattctggatcagattgttgatccctacctaaagggaaagattgttccgcagtgcttcaagaagtttgccgagacagctgagaagtgcgttgccgacaatggcatcgagcgcccttcgatgggagatgtgctttggaatttggagtttgctcttcagatgcaggaaagtgcggaggagagcggaagctttggctgtgggatgtcggatgagggcactcccctggtgatggctggaaagaaggatcccaatgacccatcgatcgattcaagcaccaccacgaccacgacaacttccctaagcatgggcgaccaaagtgtcgcgagcatcgactcggacgggctgacgccgagcgccgtgttctcacagatcatgaaccccaaggggcggtgaggtaaaaatctgggcctgcttgtcgcccttgaggcctaatttattcattgagtctattttcatcagtttgtgccatcttgcaagttatggattgggggtcagagtattgtttcacgttagacatttctgcattgccttgttttttcttgttcagcgttgtactgactctgctttttagcatgtgtaactaccgccgctgctacgtgttattgacccgacaagtaaagtgatgtgcacggccttttcctttttctttttggcttcatgtcatgctcctttccgaatcctggtgattgacacgggacgggatcatccatgttgtgttgacgttgattgttaccagtcatgctcaagcatatgctgtgttgcatgtcgtcttgtgttcaat

SEQ ID NO: 1418 - DNA, 1161 bp, Glycine max
gtcccccacacacactctctctccctctccttcctccctcgctttctctctccccgcgatggagaaagccgagagctccgcctccacatcagagccagactccgacgacaaccaccaccgccacccgacgaaccaccacctcaaccctccctccggcctcaccccgctcgagttcgcctccctcgtcccctccgtcgccgagcaccactcctacctcgtcggccccggccaatgctcctccctcctcgcccagcgcgtccacgcgcctccagacgccgtctggtccttcgtccgacgcttcgacaagccccaaacctacaagcacttcatcaagagctgcgccgtcaaagagcccttccacatggccgtcggcgtcactcgcgacgtcaatgtcatctccggcctccccgcagccacgagtaccgagcgcctcgacttcctcgacgacgtccgccgcgtcaccggcttcagcatcatcggtggcgaacaccgcctccgtaactaccgctccgtcaccaccgtccactccttcgacgacgacaacgcctccgccgacggcaagatctacaccgtcgtcctcgaatcctacgttgtcgacgtccccgacggcaacaccgaagaggacacgcgtctcttcgccgacaccgtcgtcaagctcaacctccagaagctcgcgtccgtcaccgaaggaaccaacggcgacggtgacggtaagccacactcgcggtgaggaagcaagcaagcctcaataaaaaaatatatatatattaaagcaaaaaaaagaaaagaaaaagggaattggaatttgaaacaaatctctccctccccaattcataaaaaaggagaaaagcaaaacaagtttttctctcttttctttttattttcctaaattcattttgttttcgttttattttatttttttcggctgagactctcgttttttttttttttctgtttttgatgattttgtttgcgcgctcgcaagcaatagcatgtcctccatggtcgtcgtcgtggatgcaccgttgaatttttgtcattacaatggaagagggcatttcagtcaatgcacgtgtacaggaaatgttgactttgtgatgcttgttcatcgtgtctttttaacccgttctgttctgtgaatatcatttactttttctgctc

SEQ ID NO: 1419 - DNA, 1063 bp, Vigna unguiculata
cgccatggagaaaggtgagagctccgcctccacatcggagccagactccgacgacaaccaccgcatcccgaccaaccaccacctcaaccctccctccggcctcacaccgcacgagttcagctccctcgtcccctccatcacggagcaccacacctacctcgtcggccccggccaatgctcctcccttctggcccagcgcgtccaggctccaccggaagccgtctggtccgtcgtccgccgcttcgacaagccccagacctacaagcacttcatcaagagctgtgccgtcaaagaccccttccacatggccgtcggcgtcacacgcgacgtcaatgtcatatccggcctccccgccgccaccagcaccgagcggctcgacctcctcgacgacgaccgccgcgtgaccggtttcagcatcatcggcggcgaacaccgcctcagcaactaccgctccgtcaccagcgtccacgccttcgactccgacgcagacgctaagatctacaccgtcgtcctcgaatcctacatcgtcgatgtccccgacggcaacaccgaagaggacacgcgtctcttcgccgacaccgtcgtcaagctcaaccttcagaagctcgccaccgtcaccgaaggaacaaaccgcgacggtgaccataagccacactcacggtgaagcaaaccaaaccagcactacgcaaatctcaataaaaacaaaaaaaaaattaaacaaaagaagggattggaatttgaaacaatcgctccctcgcttaccaattcataaaaagagagaaacaagtttttctctgttttcttttctttatttttttttcttgggaaattcatttagttttcctttattttttttcgggtaagactctggttttgtgtttttgatgattttgtttggcggtagctagcatgtcctccttggtgatccgttgaattttgttattacaatgggtgagggcattttggtcaatgcaggtgtacaggaaatgttgacttgtgatgtttgttcttcatggtgtctttcaaaccgttctgtgaatatcatcatttgcttttcccctgg

SEQ ID NO: 1420 - DNA, 1093 bp, Vigna unguiculata
  misc_feature (741)..(741): n is a, c, g, or t
aacgctctctctctttctctcactctctccgccatggagaaaggtgagagctccgcctccacatcggagccagactccgacgacaaccaccgcatcccgaccaaccaccacctcaaccctccctccggcctcacaccgcacgagttcagctccctcgtcccctccatcacggagcaccacacctacctcgtcggccccggccaatgctcctcccttctggcccagcgcgtccaggctccaccggaagccgtctggtccgtcgtccgccgcttcgacaagccccagacctacaagcacttcatcaagagctgtgccgtcaaagaccccttccacatggccgtcggcgtcacacgcgacgtcaatgtcatatccggcctccccgccgccaccagcaccgagcggctcgacctcctcgacgacgaccgccgcgtgaccggtttcagcatcatcggcggcgaacaccgcctcagcaactaccgctccgtcaccagcgtccacgccttcgactccgacgcagacgctaagatctacaccgtcgtcctcgaatcctacatcgtcgatgtccccgacggcaacaccgaagaggacacgcgtctcttcgccgacaccgtcgtcaagctcaaccttcagaagctcgccaccgtcaccgaaggaacaaaccgcgacggtgaccataagccacactcacggtgaagcaaaccaaaccagcactacgcaaatctcaataaaaacaaaaaaaanattaaacaaaagaagggattggaatttgaaacaatcgctccctcgcttaccaattcataaaaagagagaaacaagtttttctctgttttcttttctttatttttttttctttggaaattcatttagttttcctttatttttttttgggtaagactctggttttgtgtttttgatgattttgtttggcggtagctagcatgtcctccttggtgatccgttgaattttgttattacaatgggtgagggcattttggtcaatgcaggtgtacaggaaatgttgacttgtgatgtttgttcttcatggtgtctttcaaaccgttctgtgaatatcatcatttgcttttcccctgga

SEQ ID NO: 1421 - DNA, 1282 bp, Phaseolus coccineus
taaccgttcctcaaagtctcgttccgcaagtgccaaacagcgtcacttacacactctctccttctcacgctctctctctttctctctccccgccatggagaaaggtgagagctccgccaccacatcggagccagactccgatgacaaccaccgcatcccgaccaaccaccacctcaaccctcctttcggcctcaccccgcatgagttcggctccctcgtcccctccatcacggagcaccacatctacctcgtcggcccgggccaatgctcctccctcctcgcgcagcgcgtccaggctccgcccgaagttgtatggtccgtcgtccgccgcttcgacaagccccagacctacaagcacttcatcaagagctgcgccgtcaaagagccctttcacatggccgtgggcgtcacacgcgatgtcaatgtcatctccggcctccccgccgctactagtacagagcggctcgactacctagacgacgaccgccgcgttaccggtttcagcatcatcggcggcgaacaccgcctccgcaactaccgctccgtcactaccgtccacgccttcgactccgacgcagacgctaagatctacaccgtcgtcctcgaatcctacatcgtcgacgtccccgacggcaacactgaagaagacacgcgtctcttcgccgacaccgtcgtcaagctgaaccttcagaagctcgccaccgtcaccgaaggaacaaaccgcgacggtgactataagccacactcacggtgaagcaaaccaaacgaaaccaccactgcgcaaatctcaataaaaacaaaaaaaattaaacaaaagaagggattggaatttgaaacaatcgctccctcgctcaccaattcataaaatgagaaaaacaagtttttctctcttttcttttctttatttttctctttggaaattcatttagttttccttaatttttttcgggtgagactctggttttgtgtttttgatgattttctttggcggtagctagcatgtcctctttggtggtccgttgaattttgttattacaatgggtgagggcattttggtgaatgcaggtgtacaggaaatgttgacttgtgatgtttgttcttcatggtgtctttcaaccgttctgtgaatatcatcatttacttttcctctggatttgattccgtgtacatatcttctcttttttctcccatgagtgcaagcctacttaaagaagatgctttcttctgtggattgaacatgcttatgctattattgcacgaatcaaataagtttactgtcaaa

SEQ ID NO: 1422 - DNA, 1100 bp, Cajanus cajan
cgcaagtgccaatagcgtccccaacacacactctctctctttctttctctctccccgcgatggagaaaggcgagagctccgcctccacgtcggagccagactccgacgagagccgccacccgacggcccaccacctcaccccgcccgccggcctcaccccggacgagttcgtctcgctcgtcccctccgtcatggagcaccacacctacctcatgggccccggccaatgctcctccctcctggcgcagcgcgtccacgcgccgcccgacgccgtctggtccgtggtccgccgcttcgacaagccacaggcctacaagcacttcatcaagagctgcgccgtcaaacaccccttccacatggccgtcggctgcacccgcgacgtcaatgtcatctccggccttcccgccgccaccagcaccgagcgcctcgacctcctcgacgacctccgccgtgtcaccggcttcagcatcatcggcggagaacaccgcctccggaattaccgctccgtcaccaccgtccactccttccaccaccacgacgacgacgacgacgataagatctacaccgtcgtcctggagtcctacatcgtcgacgtccccgacgggaacaccgaggaggacacgcgtctcttcgcggacaccgtcgtcaagctcaacctccagaagctcgcctccgtcaccgaaggaaccaaccgcgacggtgacgctaagccgcacgtgcggtgaaccaccactccacaaaataaaagaaaaaatattcaaaatttggaatttgaaacaatcgctccgcccccaacgaattcataaaaggagaaaaacaagttttattttctttgttccttttttttttttttcttgaaattcattttgttttcttttttcgggtgagagtgtttgtttagcatgtcctccttggtcgtggtggatgcaccgttgaattttgtcattacaatgggtgagggcaaatcggtcaatgcacgtgtacaggaaatgttgacttgtgatgttcatcgtctttttaactgttctgtgaatatcatttccctttttttgcttttcctcctctcgattttattccatatcttttcctttttctcccaa

SEQ ID NO: 1423 - DNA, 694 bp, Glycine max
gccactcacaaaacaatataacttaattgccttaaggaacgttcgagaccacagaggtttctctagtcttcttctgtggagagcttgttttctcttgttcattcatctcacttccaattaaggaacaagctttccaccaatttgaatcaccaatggctcgctctttctccaacctcaaggttctctctgctcttgtcgccgacggattctccaacactctcaccaggcgtgggtacgcagtagcgacacaaagcgcaacaagaggaggagcagcctccatcagcggcaagtcaggggaagacaaggtactaggaggaggtgctgaaaaggtttcgtgggtcccagaccctgtcactggttactacaaaccggagaacatcaaagagattgatgttgctgagctgagagccacggttttgggcaaaaaattcaaccactaggctctacttaatttcaataattaacctttttggtctcacgtgaatatgttatatgatatatgaagttcacagaaccttcggggattattcagcatggggtttttttcttgtatttctctcttgagaatttggactagcatatgaccaaattaatgtttactagtgtgattggatctcccgttgaaaactcaaagctatgcttctgttgaattcactttcgccgaataataggagtattttgaatctttctatgc

SEQ ID NO: 1424 - DNA, 572 bp, Cajanus cajan
gttaccacacaaacaaaatagaatttgggcactggaacattcgagaccacagaggtttctctagtcctctgtggagaccttgatttctcttgttcattcatttccacataatggctcgctctttcagcaacgtcaaggttctctctgctctagtcgccgatggactctccaacactctcaccaggcgtggttacgcggcagcgacgcaaagcgcaacaaggggaggaggtggctccatcagcggcaagatagcaccaaaatcaggggaagacaaggtaggaggtgctgaaaaggtttcatgggtaccagaccctgtcactggttactacaaaccagagaacaccaaagagattgatgttgctgagcttcgagcaacgcttatgcgcaaaaaattcaaccactaatttcaatgaccttttatagttctattgttgtatttctctcctgagatatctatgaccaacttaatgtttcttagtgtattggatctcccgttgaaaactaaaaaatatatatgctttaattagttgatttctctttggttgaacttgaattaaatttggaagtttcta

SEQ ID NO: 1425 - DNA, 519 bp, Cajanus cajan
caaaatagaatttgggcactggaacattcgagaccacagaggtttctctagtcctctgtggagaccttgatttctcttgttcattcatttccacataatggctcgctctttcagcaacgtcaaggttctctctgctctagtcgccgatggactctccaacactctcaccaggcgtggttacgcggcagcgacgcaaagcgcaacaaggggaggaggtggctccatcagcggcaagatagcaccaaaatcaggggaagacaaggtaggaggtgctgaaaaggtttcatgggtaccagaccctgtcactggttactacaaaccagagaacaccaaagagattgatgttgctgagcttcgagcaacgcttatgcgcaaaaaattcaaccactaatttcaatgaccttttatagttctattgttgtatttctctcctgagatatctatgaccaacttaatgtttcttagtgtattggatctcccgttgaaaactaaaaaatatatatgctttaattagttgat

SEQ ID NO: 1426 - DNA, 747 bp, Phaseolus coccineus
ataacaaaacaacttgccttcaagaacgttctagaccacagaggtttctctagtcttctgtggagagtttgtttcctgttcttcgttcgcatccgaggaacaagctttccgcagttgaacaccctttcgtcaactcaatcaccatggctcgctctttcactaccgttaaggttctctctgctcttgtcgccgacggattctccaacactctcaccaggcgtgggttcgcggcggcggcggcgacacaaagcgcaaccagaggaggaggtgcctccatcagcggcaacataaccccaaaatcaggggaggagaaggggagaggtgctgaaaaggtttcgtgggtccctgaccctgtcacaggttactacaaacctgagaacaccaacgagattgatgttgctgacctgcgagctatggttttgggcaaaaaattcaaccactgatttcaacacacgacctctttggtcacttatatgttacatgtctctcgaagttcacagaacttttggggattattcactctgagtcaatcatctacatcagttgttgtatttctctctaaagagttaagaccactttgttagcttcattgcatctcctttggaaaactcataactatgctttatctgtattctctctgataaataacaggaattatttgtaacttctcaaatcttctttctctccattagacattatttactatttgtgacgatttacctggattaatttgagatgatttaggaa

SEQ ID NO: 1427 - DNA, 759 bp, Vigna unguiculata
ggaacaaaataacttgccttcaggaacgttctagaccacagaggtttctcttgtcttctgtagagagcttgtgttctcttcttcattcgcatccgaggaacaagctttcgtcaactcaatcacccatggctcgctctttcgctaacgttaaggttctctctgctcttgtcgccgacggattctccaacactctcaccaggcgtgggtttgcggcggcggcgacacaaagcgcaaccagaggaggtgcctccatcggcggcaatatggtcccaaaatcaggggaagagaaggtgagaggtggtgaaaaggtttcgtgggtgccagaccctgttactggttactacagaccagagaacaccaacgagattgatgttgctgacctgcgagctatggttttgggcaaaaaattcaaccactaatttcaacttcaacacagaacctctttggtcacttggacgttagatgtatctcgaagttcacggaaccttcggggattatttactataaagcaatcatctacatcagtttttgtatttttctctacagaattaataagatcactttgttagcgccattcatctccggttgaaaactcgtaactatgctttttgctgtattctcactggaaaataacattgtaactttctaagcaaacctctcaaatcttctttgtccaatttttttctttttttctttttttttcacacaagtatgctattttcttccatatttgtttgctatatggtagattttttgtgt

SEQ ID NO: 1428 - DNA, 761 bp, Vigna unguiculata
  misc_feature (624)..(624): n is a, c, g, or t
ggataacaaaataacttgccttcaggaacgttctagaccacagaggtttctcttgtcttctgtggagagcttgtgttctcttcttcattcgcatccgaggaacaagctttcgtcaactcaatcacccatggctcgctctttcgctaacgttaaggttctctctgctcttgtcgccgacggattctccaacactctcaccaggcgtgggtttgcggcggcggcgacacaaagcgcaaccagaggaggtgcctccatcggcggcaatatggtcccaaaatcaggggaagagaaggtgagaggtggtgaaaaggtttcgtgggtgccagaccctgttactggttactacagaccagagaacaccaacgagattgatgttgctgacctgcgagctatggttttgggcaaaaaattcaaccactaatttcaacttcaacacagaacctctttggtcacttggacgttagatgtatctcgaagttcacggaaccttcggggattatttactataaagcaatcatctacatcagtttttgtatttttctctacagaattaataagatcactttgttagcgccattcatctccggttgaaaactcgtaactatgctttttgctgtattctcnctggaaaataacattgtaactttctaagcaaacctctcaaatcttctttgtccaatttttttctttttttctttttttttcacacaagtatgctattttcttccatatttgtttgctatatggtagattttttgtgt

SEQ ID NO: 1429 - DNA, 565 bp, Phaseolus coccineus
  misc_feature (425)..(425): n is a, c, g, or t
aggtttctctagtcttctgtggagagtttgtttcctgttcttcgttcgcatcctaggaacaagctttccgcagttggacaccctttcgtcaactcaatcaccatggctcgctctttcactaccgttaaggttctctctgctcttgtcgccgacggattctccaacactctcaccaggcgtgggttcgcggcggcggcggcgacacaaagcgcaaccagaggaggaggtgcctccatcagcggcaatagaaccccaaaatcaggggaggagaaggggagaggtgctgaaaaggtttcgtgggtcccagaccctgtcacaggttactacaaacctgagaacaccaacgagattgatgttgctgacctgcgagctatggtttggggcaaaaaattcaaccactgatttcaacacacgacctctctggncacttatatgttacatgtctctcgaagttcacagaacttttggggattattcactgagtcaatcatctacatcacttgttgaattcctctctagagagttaaaaccactttgttagcttcattgcatctccattggaaaa

SEQ ID NO: 1430 - DNA, 2016 bp, Phaseolus coccineus
  misc_feature (601)..(601): n is a, c, g, or t
  misc_feature (828)..(828): n is a, c, g, or t
cataatccatgaaaatgcagaacctcaaactgcaactactcttactcctctcactttcaacctttcaggctgttttctccttcacaaatgggttgttgccaaatgggaacttcgagaggggcccaaaggcatcagaaatgaagggttcggtggtgattgggcagaatgcgattcctaactggacgataacggggctggtcgaatacataaaatcaggacagaaacagggtgacatgttgctggttgtgcctgagggtgactatgcagtgagacttggcgatgaagcttccatcaagcagaaggtgaagctgaatgaggggtttttctacgccatcacgttcggtgctgctagaacctgtgcacaagaggagaaacttaatgtctctgtggttcctaccactgagaagagggactggggaatcatccccattcagaccatgtatggcagcaatggctgggagtctttcacttgtggcttcagagcagatttcccagaagctgaaattgtcatccataaccctggcaaagaagaggaccctgcttgtggtcccctcatcgatcagttgccctcaaggttttggaccccccaaaagaaccaganctaatttgctgaaaaatggaaacttcgaagaagggccatatctgttccctaactcgtcttggggggcattgatcccaccccacattgaggatgctcacagtcctttaccagggtggatagtggagtctctcaaggctgtgaagtacattgattcggatcactttgcagtgcctgagggaaaaagagccattgaacttgttgcagggaaagagagtgcccttgcacangtcgtgatcaccacaattggaagggtctatgacctcactttcgctgtgggtgatgccaacaatgcatgtgaaggttccatgatcgtggaagcatttgcaggtgcagaaactgtccaaattccatatcaatctaagggcaaaggaggttctgtgagagggaaacttcggttcaaggctgttgcaacacgaacacgtctcaggttcctaagcacattttacaccatgaagagtgataactctggttctctgtgtggacctgtgatagatgatgtaaaattgctgagtgttcgttatcccagacgtgcttgatcatgagattccacagcaaatacaatgaaaacaggtgcttgattgttgcagttgagcatatatagtagatgattctggtaataatatatagaagagtgagcattgatgagtgagtgagtgagtttaccatgtatctatttttccatcaaaatcaaatgcactgctgagtcagagagagttcttccattaatgcaactcaaattcaacaaataattcctgttatttatcagagagaatacagataaagcatagttatgagttttccaaaggagatgcaatgaagctaacaaagtggtcttaactctttagagagaaatacaacaactgatgtagatgattgactcagagtgaataatccccaaaagttctgtgaacttcgagagacatgtaacatataagtgaccaaagaggtcgtgtgttgaaatcagtggttgaattttttgcccaaaaccatagctcgcaggtcagcaacatcaatctcgttggtgttctcaggtttgtagtaacctgtgacagggtcagggacccacgaaaccttttcagcacctctccccttctcctcccctgattttggggttatgttgccgctgatggaggcacctcgtcctctggttgcgcttcgtgtcgccgccgccgccgcgaacccacgcctggtgagagtgttggagaatccgtcggcgacaagagcagagagaaccttaacggtagtgaaagagcgagccatggtgattgagttgacgaaagggtgttcaactgcggaaagcttgttcctcggatgcgaacgaagaacaggaaacaaactctccacagaagactagagaaacctctgtggtctagaacgttcttgaaggcaagtttgtttttgttactccccggcca

SEQ ID NO: 1431 - DNA, 1297 bp, Cajanus cajan
gggcagcccctatataaagagagtcaagaactttgtaagagcattcaaaaattgagctgaaagtgaaagagaaaacaacaaattagaagagcaattaaccatggcaaataagtaccatgttagatcaattagtttgcctactagatctcatcctagcaccattagagtggaagaggagttaagcaagctcaagatttgggaagaaacatccacatccatatccacattagattccattcacactggcctatccttgcttgaagatttgtaccttagtttggatgatcttctcaacatggcatcaacccaacaagtgatttctcaccatagaggtgataagtgtgtggaagaggtgttggatggttctgtgagaattttggacacatgtggcatcacaagggacaccatgttgcaaatcaaggaaaatgtccaagcccttcactctgctcttaggagaagaaaaggagagtcatgtgttgaaacaagtgtggctgagtacaaattgttcaccaagatgatgaagaagaatgctaacaagttgatcacatctttgaagcagatggatggaaaatttggggtgtcaccacttttgggtcttgatcatcaccttggtgctgtgattagagtgcttagggaagccattctgatcaacttgtcagtttttcaatttattttgtcattcttgaccatgtcttcgtcgaattctaagggaaccaagtggttggtggtggcaaagttgatgcacaagggggtgaaaccttgtgaagaaaactccgagaatgtgaatgagttgcagtgtgtggaagcagctttgagcacccttttgaatgaaggtgctaatgatgagaagatgcaggtggcacatgagagattggaggctttggagaatgccactgaaagtgttgagaatggcttggagagtgtgtttaggcgattgattaaaactagagcttcccttttgaacattatctcccagtagagtgttttcaatagcaatttttatcaaatcctgcaaatgcatccaaattttagggatctgctgaggattattacctcaatgatttgtagatgtataatattcaaaagtaatgcattgaaatgtaaagaaaatgttcattgtctatataacgatggttccctataaccaaggtattcaaaattgagatcttactaaagattgcaaagggaagtattgatcgtaaaacgaaagatcgtaacatggatcataagatcctacaaaatttatgaaattcatatatacatacacataagttttgtagtaaaaaaaaaaaaaaaa

SEQ ID NO: 1432 - DNA, 1101 bp, Phaseolus coccineus
agcccttatataaagagagtgaaggacttgttaagagcatcccaaaattaagcttctattgaagagaaaaaagcaacaacttagaagagtaaatggcaaataagtaccatgttcgttcaattagtttgccttctaggtctcatcctagcaccattagggtagaggaggagctgagcaagctaaagacttgggaaggaacatccacatcctcttcacactccattcagactgctctatccttgcttaaagacctctaccttgccttggatgatcttctcaacatgtcatccacacaacaagtgatttctctccacaaaggtgacaaatgtgtggaagaggtgttggatggttccatgagaattttggatatgtgtggcatcacaagggacaccatgttgcaaattaaggagaatgtccaagcccttcactctgcccttcgaagaagaaaaggagattcgagtgttgaaacaagtgtggctgagtacaaactgttcgctaagaagatgaagaggaatgtgaataagttgatcacatcattgaagcagatggatggcaaatttggggtgtccccacttttggatcttgatcaccaccttgcttgtgtgactagagtgcttagggaagtcattgtgatcaacttgtcagtgttccaatctattttgtcattcttggcaatgtcttcatcgaattcgaaggcaacaaccaaatggtttctggtggcaaaatttatgcacaagggggtaaaaccatctgaggaaaactcagagaatgagaatgagttgcagtgtgtggaaatagctttgagcactcttctgaatgaaggcactcacgatgacaacattcgggtggcgcatgaaagattggaggctttggagaatgccattgaaagtgttgagaatggcttggagagtgtttttaggcgcttgattaaaactagagcttcccttttgaatatcatctcccagtagggtgctttcagtagcaacttttctacaatcctgatatgcatacgagttttaggggtatgctaaggaatgatttgtacatgtaaagaaatataatgaaatgtaaaaaaagatgtttattctctacattatgatg

SEQ ID NO: 1433 - DNA, 1511 bp, Glycine max
tcaaatccaattcaccaaacatggttgatctagattggcaaacaaagatggttcactccaacatgcctccaaagtcccccaaactctctctcccggataataacattccaatcccccttcgccagaacgacatcaccgcagcgtcgtctccaatctgcgctgcctacgacaactacctccgcctccctgagctcagagccctctgggcctccaacgacttccctaattgggccaacgagcccatcttaaagcccaccttacacgccctcgaaatcaccttccgcttactcgcaaccgttttatccgacccgaggccgtacataaacaagcgcgagtggacccggcgggtggagtctctcgccacggcccaaattcagatcatagctatgctgtgtgaagacgaagaagaaaaccccgagacacgtggcacgacgccaccggtgagtgacattaacggcttcatcgctcaaagcagaagctacagcgaggagagcctgctcccgcgcctcgccacgtggcacaaatccaaggacgtggcgcggagaatcctcgattcggtagagtaccagatgatgaggtgcacgtacaccttaggtttaggagaggcgaatctcgcgggtaagaagatattcctttacgacgccgtttgcaggccgagcgagattcactcgttggagacgacgccgtttgattacgtggggaactgcgagaacaagacgctgcacgcgacgcagcagatcgcggagtgttggacgcgcgcggtgaggaagctgctggagagagtggcggagtcggtggagagaaaaacgttggagaaggcggcgagggagtgtcacgcggtggagcggatctggaagttgttaacggaggttgaggacgtgcacgtgatgatggatccggaggatttcttgaggttgaagaaggagttgggaatgatgagaaattgcggggaaatggtggcgttttgcttcaggtcgagggagctcgtggaggtggcgaggatgtgtagggatctgaggcagaaggtgccggagatattggaggtggaggtggaccccacgggtgggcccgggatgatggaggcggcgatgaaggtttactcggagaaagagaaaaggaacgggttcgagaaggttcatgttttgcaggggatgcaggcgattgaggtggcgatgaagaggttcttctacgcctataagcaggttgtggcggttatgatggggagctccgaggccgataatgggttcactcagatattccttgaacccacttatttccctagcttagatgctgccaagacctttctcgcttattattgggaaaataataatcaaaatgtggttccctgctagttaattaaaaaattaatcaattaattcctagtcatatatacttactcacacaaacgggaaaacaaagagaaaaaaaaaaaggactaaatttttgtaataggttggtgtaaacaaatctttgtctgtaaaataatatttatttgactattcttttggatc

SEQ ID NO: 1434 - DNA, 1959 bp, Glycine max
gaaaaaaatggagatagagaagagcactaagagcaatgcggaaatgggggagaaagaagagaagaagaagaagcatcgacgaggaggcatcagaacattacctttcattcttgcaaatgaagtgtgtgacagatttgcaagtgctggttttcatggtaacttgataagttacttaacacaagagctgaacatgccattggtatcagcctcaaacacactgacaaactttggaggaacatctagcttcacccctctcattggggcaatcgtggcagattcctttgctggacgcttttggaccattactgttgcttctctcatttatgaattgggattgattagcatcacagtatcagctatactgccacaatttcggcccccaccatgcccaacacaagtgaattgccaagaagccacatcctcacaactgtggatactctacatctccctcctcctcacatctgttggatcaggtggcattagaccatgtgttgtgcccttttcagcagaccaatttgacatgaccaaaagtggtgtagcatcaaggaagtggaacctcttcaattggtactttttcagcatgggcttggcttctcttagtgctttgaccattgtggtttacattcaagacaacatgggctggggttggggccttggaattccatgcattgccatgttgatatccataattgcctttgtgttgggctcaccactttataagactgtgaaaccagaagggagccctttggttcgtttggcccaagtaaccgtggcagctataaagaaaaggaaggaggctttgccagaagatccccagcttttgtaccataattgggaacttgatactcctatttctttggaagggaggcttctacactctaatcaatataaatggttggacaaggctgcaattgtcacagaggaggaggcgagagatcaaactacaacaccaaacttatggaaattagccactgtccacagagttgaggagctaaaatccatcatcagaatgcttccaatttgggcatcaggaattctgctcataacttcttcatcacatctacacagctttgtgattcaacaagctcgcactatggaccgtcacctttctccctcgttccaaatttcccccgctagcatgtccattttcagcgtgctaaccatgatgtcaggagttgttctatacgaacgccttttcgttccctttgcgcgtagattcacagggaacccttctggaatcacatgcttgcaaagaatgggaataggtttcataattaacatcatagccactgtggttgctggcctaatggaaatgaaaaggaaatcatttgctgccaagtaccacttattggatgatccaaaagccactattcctattagtgtgttctggttggtacctcagtattgtcttcatggggtggctgaaattttcatgtctgttggacatttggaatttctctttgagcaggcacctgaaagcatgagaagcagtgctacagcactgtactgcataaccacagccattgggaactacatgggtacattgctggtatcattagttcataagtatactggcaaggagaataattggttgccagataggaacctcaataggggtggattggactactattattttcttcttagtgggattcaagttgtgaatctcgtttattatttgatatgtgcttggttttacacttataagcccgtggatgaaattagtgaaaggaccaaggaagaagatttggaacaagccaatgaacatatctcacctgatgacaagttattaaaggatggtagggatgaagaaaagagagaattaacgaaagatgaatgaattgatggggttgatattagcttttagcattgttgaactctaagtaatgttcttttcctcatcaaatggcatatgtaagcacagggtagagcaagtcttctgttttatgctttttatgt

SEQ ID NO: 1435 - DNA, 2066 bp, Phaseolus coccineus
agacccacagaagaaggataatagactgtgaataacagaagtgaaggagcagaaaaatggagatagagaagaaggcgaagaagagtgaggaaatggagggtgagaaagaagtgaagaggagcgaacctcgacgaggaggcatcagaacattacctttcatccttgcaaatgaactgtgtgacagatttgcaagtgctggttttcatggtaacttgataagttacttgacccaagagctgaacatgccattggtgtctgcctcaaacacattgacaaactttggtggaacgtctagcttcactcctctcattggagctattatagcagattcctttgctggacgcttttggaccattactgttgcttctctcatttttgaactgggattggttagcatcactgtatcagctatactgccacattttcgacctccaccgtgtcctacacaagtgaactgccaagaagccacatcctcgcaactatggatactctacatctccctcctcctcacatctgttggatcaggtggcattagaccttgtgttgttcccttttcagcagaccaatttgacatgaccaaaactggtgtggcatcaaggaaatggaacctcttcaactggtactttttcagcatgggattggcttctctaagtgctttgaccattgtggtttacattcaagacaatatgggatggggttggggccttggaattccaagcattgccatgttgatatccatcattgcctttgtgttgggctcaccactctataagactgtcaaaccagaaggaagccctttggttcgtttagcccaagtaatcgcagcagctgtaaagaaaaggaacaaggctttaccagaagatcccaagcttttgtaccacaattgggaacttgatgctcccattgctttggaaggcatgcttctacactctgatcaatataaatggttggacaaggctgcaattgtcacagaggaggaggcaagagatccatctacaacaccagacttatggaggttagccactgtccacagagttgaggagctaaaatctatcatcagaatgcttccaatatgggcatcaggaattttgctcataacttcttcatcacatctgcacagctttgtaattcaacaagctcgtacaatggatcgccacctctctccctctttccaaatttcaccagcaagtatgtccattttcagtgtgctaaccatgatgtcaggagttgttctatacgaccgcttttttgttccctttgcccgtaggttcacagggaaaccttctggaatcactagcctacagagaatgggaataggcttcataattaacatcatagccactgtggttgctgctctgattgaaatgaaaagaaaatcagttgctgccagataccacttattggatgatccaaaagccattattcctataagtgtgttctggctggtgcctcagtattttctgcatggggtggctgaaattttcatgtctgttgggcatttggaatttctctttgagcagtcaccagaaagcatgagaagcagtgctacagctctgtactgcataaccacagccattgggaactacttaggtacattactggtgacattggtgcataagtatactggcaatgagaggaactggcttccagataggaacctcaataggggtggattggactactattactttcttgttactgtcattcaacttgtaaatcttgtttattattttatatgtgcttggttttacacttacaagcccgtggcagaaactacagaacggaacaaggaagaagatttggaacaaaccaacgaacatatctcatcttacaatttcaaagatggtgaggaggaagagaagagaggatttacaaaagttgaatgaattgataggcttgatattagattttagcattgttgaattatgtgttcttttcctcatcaaatgacctatgtaagtgtacactgcatctacttaatgtttttttttatgtttagttgaacttatataaccatctaactaagccactcttttcgttatttagaaagggcatttttgtcattt

SEQ ID NO: 1436 - DNA, 2072 bp, Cajanus cajan
acacaaggtacattactcactcactgccttcagaaaaaatggagatagagaagagaactaagggttgtgaggaggtggaccagaaagaagagaagaagaagaagaagcatcaacaaggaggcataagaacattacctttcatccttgcaaatgaagtgtgtgacagatttgcaagtgctggttttcacggtaacttgataagttacttgacccaagaactgaacatgccattggtggctgcctcaaacacactgacaaactttggaggaacatctagcttcacccctctcattggggctattatagcagattcctttgctggtcgattttggactattaccattgcttctctcatttatgaactgggattgatcagcatcacagtatcagctattatgccaaatttgcgccccccaccatgcccaacacaagtaaactgccaagaagccacatcctcacaactgtgggtactctacatctgcctcctcctcacatccattggatcaggtggcattaggccctgtgttgtgcccttttcagcagaccaatttgacatgtccaaaagtggtgttgcatcaaggaaatggaacctctttaattggtactttttcagcatggggttggcttctctaagtgctttgaccattgtgatttacattcaagacaacatgggctggggttggggccttggaattcctaccattgccatgctcatatccatcattgcctttgtgttgggctcaccactctacaagacagtgaagccagaaggaagccctttggttcgtttggcccaagtaatagtagcagctataaagaaaaggaaggaggctttaccggaagatcccaagcttttgtaccaaaattgggaacttgatgatcctatttctttggatggcaggcttttacactccaaacaatataaatggttggacaaggctgcaattgtcacagaagatgaggctagagagccaagtgcaacaccaaacttatggcaattagccactgtccacagggttgaggaattaaaatctatcattagaatgcttccaatttgggcatcaggaattctgctcgtaacatcttcatcacatcttcacagctttgtaattctacaagctcgcacaatggaccgccacctcactcactcgttccaaatgtccccagccagcatgtccattttcagtgttctaaccatgatgtcaggagttgttctatatgagcgcctttttgttccctttgcccgaagattcacagggaacccttctggaatcactagcttgcaaagaatgggaataggctttgtaatcaacatcatagccactgtggttgcaggatttttggaaatgaaaagaaaatcagtagctgccaagtaccaccttttggacgatccaaaagccactattcctatgagtgtgttttggttggtacctcagtattgtcttcatggggtggctgaaatcttcatgtctgttgggcatttggaatttctctttgagcagtcacctgaaagcatgagaagtagtgctactgctttgtactgcgtaacctcagcaattgggaactacacaggcacattgttggtgtcattagtgcataagtacactggcaaggagaggaattggcttcctgataggaacctcaataggggtagattggactactattattttcttgctagtgggattcaagttgtaaatttcgtttattatttaatatgtgcttggttttacaagtacaagtccttggaagaaattattgaaaggaagaaggaagaagatttggaacaagccgatgaacatgtctcatctgtcaatttaaaggatggtagggaggaagaaaagagaggatttacaaatggtgaataaattgatggggttgatattagttttgagcattgttaggaatgttattttcctcgttaaatggcatatgtaaacatagggtagagcatgccttttgctttatgactagttgtacttctttaaccatctagcattaaggtactattttagtaaaaaaatttaagaaaatattttataatatctattataagatccacatcatttctg

SEQ ID NO: 1437 - DNA, 2032 bp, Lotus japonicus
gaatatggagatagagaagaagattgtgagcagtgtgaggatgacagagaaagaagtggaaacgccagaaaatgataataggaagcaacatcgtcgaggaggcattcgaacattgcctttcatccttgcaaatgaagcatgtgacagatttgcgagcgctggattccacagtaacctgataagttacttgacgcaggagctgaatatgccattagtggcagcttcaaacattctcacaaactttggtggaacatctagcttcactcctctcattggggctttaattgcggattcctttgctggccgcttctggactattactattgggtctctcatctatgaactgggattggttagtatcactgtatcagttcttcttccgaacatgcgccctccaccatgcccaacacaagtgaattgccaagaagccacatcatcacaattgtctatactttacatctgtctcctcctcacatctcttggctcaggtggcataagaccatgtgttgtgccattttcagctgaccaattcaacatgaccaaagatggggtggcatcaaggaagtggagcctcttcaattggtactttttcatcatgggatttgcttctctaagtgctttgaccattgttgtttatgttcaagacaatttgggctgggcctggggccttggtattccaaccattgccatgttgatatcaatcattgcctttgtgttgggcgcacccctctataagagtgtgaaaccagaagggagtcctttggttcgtttggcccaagtgattgtggcagctgtgaagaagaggaatgaagctttaccaaatgattgcaagcttttataccaaaatagggaacttgatgctcctattgctttagaaggaaggcttttacactcagatcaatataagtggttggacaaggctgcaattgtgacagaggaagaggctaaagattcaaaagcacccccaaacctgtggaaattaaccactgtccacagagttgaggagctaaaatccatcattagaatgcttccaatttgggcttcaggaatcttgctcataacttcatcatcacacataggtagttttgtgattcaacaagctcgcacaatggaccggcacctctctcactcgagctcattccaaatatcccctgccaacatgtctattttcagtgtcctaaccatgatgataggagttatgttatatgaacgcttctttgtcccattcgtgcgtcgattcacagggaacccttccggaatcacatgtttacagagaatgggggtaggctttgtcgttaacattgtagccactatagtttcagcactagttgaaatcaagagaaaagaagttgcagccaagtaccatttattggatgatccaaaagccattattcctattagtgtgttctggttggtgccacagtattgtcttcatggggtagctgaagttttcatgtctgtggggcatttggaatttctctttgatcaatcacctgaaagcatgagaagcagtgctacagctttgtactgcataactatagctattggaagctatttgggtacatttttggtatcattagtgcacaattacacaggcaaagaaaggaattggttacctgatagaaaccttaataggggcagacttgagtgctattattttcttgttagtgggattcaagttttgaatttcatttattatgtgatttgtgcttggttttacacttacaagcccttggaagaactcagtgaaaggatcgaggaagaagatttggaacaagctgatgaaaatgtctcatttgtcaatttaaaacatggtaaggaggaagaaaagaagcaattcacaaaagatgaatgaaattataatgtcagttggtagtagttaataagaattatagaactcgggtgaatatgttcaagtcctcatcaagtggcatatataagcactagagaaagtgtgtaatctttgtattttattttcatgtgtacttgtataatcattagatatttatgagtcatttggttaacatttgct

SEQ ID NO: 1438 - DNA, 2120 bp, Medicago truncatula
gaatattgttggaggagtggtatatatagagacacttaaacaaagtgtcaagtatccatgattgaggagaaatggagatagagaaagggattaagaacaatatggagatggtagaaaaagaagtggagacagacagcaagaaaatgaaccaccctcgtcgaggaggaatccgaacattacctttcattcttgcaaatgaagtatgtgatagatttgcgggcgctggatttcacagtaacttgataagttacctaacccaagagttgaatatgccattggtagctgcttcaaatacactcacaaactttggtggaacatctagcttcacccctcttattggggctttacttgcagactcatttgctggaagattttggaccatcactgttggatgcctcatctatgaactgggattgattagtattacggtatcaactatactaccacatttccgtcctccaccatgtccaacacaagtaaattgcaaagaagccacatcttcacaattattaccactctacatgtctctcctcctcacatctcttggatcaggcggcattagaccttgtgttgtacctttttcggcagaccaattcgacatgacaaaagaaggtgtagcttctaggaaatggaacctcttcaattggtactttttcatcatgggttttgcttctctaagtgctttaaccattgtggtttatgttcaagacaatgtgggttggggttggggacttgggattccaaccattgctatgatgatatcagtaatttcatttgtgttgggctcaccattgtataagactgtgaaacctgaaggaagtcctttggttcgtttggcgcaagtggttgtggctgctgtaaagaaaaggaaggagacattacctgatgaccctaaatttctataccacaacagggagcttgatgctgctatttctttagaaggaagtcttttacactcaaatcaatataaatggttggacaaggctgcaattatcacagaagaagaggccaaagattcaaatgcaccaccaaacctttggaatttagtcactgtccatagagttgaggaactgaaagctatcatcagaatgcttccaatttgggcttcaggaattttgctcataatgtcttcatcacatttaggtagttttgtcattcaacaagctcgttcgatggaccgtcacctcactcattcattccaaattgcaccagccaatatgtcaatttttggtgtcctaaccatgatgataggagttatgctatatgaacgctttttcgttccattcgcccgtagattcacaaagaatcctgctggaatcacatgtttacaaagaatgggagtagggtttgtggttaacattatagctactatagtttcagcactagtggaaacgaaaagaaaaacagttgctgcaaagtttaacttattggatgatccaaaagcaataatcccttttagtgtattttggttagtacctcaatattgtcttcatggagtggctgaagttttcatgtctgttggacatttggaatttctctttgatcaatcacctgaaagtatgagaagtagtgctactgctttgtattgcataactacagccattggtaattattctggtacattattggtatcaatagtccataagtatactggtaaggaaaataattggcttcctgatagaaaccttaataggggtagattggactactactattatcttattagtggcattcaagtaataaatttaatttattatatagtatgtgcttggttttacacttacaagccaatgggtgaagtttgtgaaaggagcaaggaagaagatttggaacaagcaagtgcaaacatatcaattgagaatttaaaagatggtaaggaggaagaaaagaaagggtttactaaagatgaatgaaattatggtgtggttgatattattcagtataaataagcttggttaaactctagtgaatgtttttagcttttgtaaaaaaaaaaaaaaaaaaaactctagtgaatgaatgttcaactcctatatgcaagttaagtgtttaagaaatggaaatagtgtgaagttttattttattttcatatttacttctatcataatttgatattaaaa

SEQ ID NO: 1439 - DNA, 1992 bp, Medicago truncatula
agctaagaatattgttggaggagtggtatatatagagacacttaaacaaagtgtcaagtatccatgattgaggagaaatggagatagagaaagggattaagaacaatatggagatggtagaaaaagaagtggagacagacagcaagaaaatgaaccaccctcgtcgaggaggaatccgaacattacctttcattcttgcaaatgaagtatgtgatagatttgcgggcgctggatttcacagtaacttgataagttacctaacccaagagttgaatatgccattggtagctgcttcaaatacactcacaaactttggtggaacatctagcttcacccctcttattggggctttacttgcagactcatttgctggaagattttggaccatcactgttggatgcctcatctatgaactgggattgattagtattacggtatcaactatactaccacatttccgtcctccaccatgtccaacacaagtaaattgcaaagaagccacatcttcacaattattaccactctacatgtctctcctcctcacatctcttggatcaggcggcattagaccttgtgttgtacctttttcggcagaccaattcgacatgacaaaagaaggtgtagcttctaggaaatggaacctcttcaattggtactttttcatcatgggttttgcttctctaagtgctttaaccattgtggtttatgttcaagacaatgtgggttggggttggggacttgggattccaaccattgctatgatgatatcagtaatttcatttgtgttgggctcaccattgtataagactgtgaaacctgaaggaagtcctttggttcgtttggcgcaagtggttgtggctgctgtaaagaaaaggaaggagacattacctgatgaccctaaatttctataccacaacagggagcttgatgctgctatttctttagaaggaagtcttttacactcaaatcaatataaatggttggacaaggctgcaattatcacagaagaagaggccaaagattcaaatgcaccaccaaacctttggaatttagtcactgtccatagagttgaggaactgaaagctatcatcagaatgcttccaatttgggcttcaggaattttgctcataatgtcttcatcacatttaggtagttttgtcattcaacaagctcgttcgatggaccgtcacctcactcattcattccaaattgcaccagccaatatgtcaatttttggtgtcctaaccatgatgataggagttatgctatatgaacgctttttcgttccattcgcccgtagattcacaaagaatcctgctggaatcacatgtttacaaagaatgggagtagggtttgtggttaacattatagctactatagtttcagcactagtggaaacgaaaagaaaaacagttgctgcaaagtttaacttattggatgatccaaaagcaataatcccttttagtgtattttggttagtacctcaatattgtcttcatggagtggctgaagttttcatgtctgttggacatttggaatttctctttgatcaatcacctgaaagtatgagaagtagtgctactgctttgtattgcataactacagccattggtaattattctggtacattattggtatcaatagtccataagtatactggtaaggaaaataattggcttcctgatagaaaccttaataggggtagattggactactactattatcttattagtggcattcaagtaataaatttaatttattatatagtatgtgcttggttttacacttacaagccaatgggtgaagtttgtgaaaggagcaaggaagaagatttggaacaagcaagtgcaaacatatcaattgagaatttaaaagatggtaaggaggaagaaaagaaagggtttactaaagatgaatgaaattatggtgtggttgatattattcagtataaataagcttggttaaactctagtgaatgtttttagcttttgt

SEQ ID NO: 1440 - DNA, 2872 bp, Phaseolus coccineus
aaacaggtccaagtgtagatgagggaagagctacacatggcaactcacctccgattctctaaactctgaataagcaatttccatttcccagggaagcaaatagtcacgtacacgttcccaatattactcgctacactactctagttcattcattgtgagtccccataatcctttctatgcttcaccgtatcacccattcctcttctccctctcttctcctcctaccacgtcttctctcacaccaacccttcccctcttcaaatttcaaattccctttctcactctccccaaaacgtttcactctcaacctcatctccatggcttcatctcattccctccacaaccacactaaccgactcgcttcccaacagagcccttaccttctccaacacgcacacaaccctgttgattggtatccgtggggcgaagaagccttcgccgaagcgcgcaggcgcgacgtgcctatcttcttgtcaattggttacagcacttgtcactggtgtcatgttatggaggtcgagtctttcgaagacgcagcggttgccaagctgttgaacgattggtttgttagcattaaggtggatcgagaggagcgaccagatgttgataaggtatacatgacgtatgtgcaggctttgtatggtggaggaggttggcccctgagtgtgtttctttcacccgacttgaagcctttaatgggtggaacttacttcccccctgatgataagtatgggcgacctggatttaagactatacttagaaaggtaaaacaggcttgggatagtaagagggatatgctgattaagagtggagcatttgcaattgaacagctttctgaggcaatgtctattagttcaacttctgataaactgcctgatggggttccggctgatgcattacgtctgtgctcagagcagctctctgggggctacgattcaaagtttggtgggtttggatctgcaccaaagtttcctagaccagttgagataaacttgatgctttatcactccaaaaagttggaggagacaggaaaattggatggagctaatggaagtcagaaaatggttttatttagcttgcaatgcatggcaaaaggcgggattcacgatcatattggagggggctttcacagatacagcgtggatgagtgctggcacgttccacattttgagaagatgctatatgatcaaggacagcttgctaatgtttatctagatgcgttttctatcactaaagataccttctattcatatatatcacgggatatccttgattatttaagaagagatatgattggtccagagggtgaaatcttttcagcagaggatgctgacagtgcagagaccgaaggagctgcaagaaaaaaggaaggagccttttacatatgggcaagcaaagaggtccaagacatacttggagagcatgctgctctttttgaggagcactattacataaagcaatcgggtaactgtgacctctctggaatgagtgatcctcacaatgaattcaaagaaaagaatgtcctgatcgaaagaaaggaactttcagaactggcatcaaaatatggcatgtcagttgagacatatcaagaaattcttggagaatgtaggcgtaagttgtttgaagcaaggtcaaggcgtccaaagccacatttggatgacaaggttattgtatcttggaatggattggcagtctcttcttttgctagggcttctaagattctcaagagcgaagctgaagggaccaaattctactttcctgttgttggcactgaaccaaaggagtacatgaggattgcagaaaaagcagcgtttttcattagaaaggaactttatgatgtggagactcgcaggctataccatagtttcagacgttctccgtctaaagctcctggtttcttggatgattatgcttttctgatttcaggattgctggatctgtatgagtttggtggtggagttagttggcttctatgggccattgaattgcaggaaacccaagattctctgtttcttgacaaggctggaggtggatatttcaataatacaggagaagatccttcagttctcctccgcgtgaaggaagatcatgatggggcagaaccctctggaaactcggtttctgctataaatcttataagattggcttccatggtttctggaagtaaggccgagaattataagcgaaatgcagaacatctattggcagtttttgagaaaagattgaaagatatggctatggcagtgcctctaatgtgttgtgcagcagacatgttgcgtgtaccttctcggaaacaagtggtcgtggttggtggaagaacgtctgaggaatttgaaaacatgcttactgcagctcatgcgttatatgaccccaacagaacagttatacatatagaccccagcaacaaagaagagatggaattttgggaagtaaataacagcaatgtctctctgatggcgaaaaataactatgccgtcaacaaggttgtagctcttgtttgccaaaacttcacctgtagcccccctttgactgatcgttcttcacttgaagctttgctctccaaaaaaccttcttcgttcacataagctattggttgtgatttgagtaggatcgtcagtgaaagctcccctcttggagatccccgttttcatctacataaatagttggttcggatttctgtgtaaaataaaggtaggcaaaattctccgttgagttgagttcagggattgatgcatggatgcatccccttttcgtttgcctgtgttcaggggccacaatttttcctcaaatttgacaaagaatgatgcaagtttgtatatgtgtgtacaataaagtcaaaatgtcacggctatatctttccatagatacaaaa

SEQ ID NO: 1441 - DNA, 3016 bp, Cajanus cajan
acacacatttctaacttaacaacactccttctgttctattctatgctccaccgcatcacccactcctcttcttcctctcttctcctccttccccgtcttctctctcaccactctctcccttccaatttcaaattcccaccaaaacctctcactctctcactcagactcctctccatggcatcatctcacaaacacaccaaccgcctcgcttccgaacagagcccttaccttctccaacacgctcacaaccccgttgattggtatccctggggccaagaagccttcgccgaagcgcgccgccgagacgcgcctatcttcttgtcaattggttacagcacttgtcactggtgtcatgttatggaggtcgagtctttcgaggacgaagcggttgccaacctgttgaacgattggtttgttagcattaaggtggatcgagaggagcgaccagatgttgataaggtatacatgtcgtatgtacaggctttgtatggtggaggaggttggcccctgagtgtgtttctttcacctgacttgaaacctttaatgggtggaacttacttcccccctgatgataagtatggacgacctggatttaagactatacttagaaaggtaaaagaggcctgggacagtaagagggatatgctaattaagagtggatcatatgcaattgaacagctttctgaggcaatgtctgctagttctgattctgataaactgcctgatggggttcccgccgaagcaatacatctatgctcagagcagctctctgggagctatgattcaaagttcggtgggtttggatctgcaccaaagtttcccagaccagttgaggtcaacttgatgctttatcactccaaaaagttggaaaatatggggaagttggatggagctgatggaagtaagaaaatggttttgtttagcttgcaatgcatggcaaaaggtgggattcatgatcatattggaggggggtttcacaggtacagtgtggatgagtgctggcatgttccacattttgagaagatgctatatgatcaagggcagcttgctaatgtttatctagatgcattttctatcacaaaagataccttttattcatatatatcacgggatatcctcgattatttaaggagagatatgattggtccagaaggtgaaatcttttcagcagaggatgctgacagtgctgagactgaaggggctgcaagaaaaaaggaaggagccttttacatatggacaagcaaagaggttgaagacatacttggagagcatgctgctctttttgaggagcactattacatcaagcaaccgggtaactgtgacctatctggaatgagtgatcctcacgatgaattcaagggaaagaatgtcctgattgagagaaaggaatcttcagaaatagcatcaaaatatggcatgtcaggtgagacatatcaaggcattcttggagaatgtaggcgtaagttattcgaagtaaggtcaaggcgtccaaagccacatttggatgataaggttattgtatcttggaatggactggcaatctcagcttttgctagggcttctaagattctcgagggtgaacctgaagggaccaaattctactttcctgttgttggcactgaaccaaaggaatacatgagaattgcagaaagagcagcattctttattagaaatcaactttacaatgtggagactcacaggctacaccatagtttcagacgttctccatcaaaagctcctggtttcttggatgattatgcttttctgatttctgggttgctggatctctatgagtttggcggtggaattaactggcttatatgggccattgaattgcaggaaacccaggatgctttgtttcttgatagagatggaggcgggtatttcaataatacaggagaagattcttcagttctcctccgcgtgaaggaagaccatgatggggcagaaccctctggaaactcaatttctgctattaatcttataagattggcttgcatggttgctggaagtaaggctgagcattataagaaaaatgcagagcatctattggcagtttttgagaaaagattgaaagatatggctatggcagtgcctctaatgtgttgtgcagcagacatgttgcgtgtaccttctcggaaggaagtggtcgtggttggtgaaaggacgtccaaggaatttgaacacatgcttgctgctgctcatgcattatatgatcccaacagaacagttattcatatagatcccaataacaaagaagagatggaattttgggaagttaataacagcaatattgctctcatggcgaaaaataactatgctgtcaacaaggttgtggctcttgtatgccaaaacttcacttgtagccccccagtcactgatcatgcgtcacttgaagctttactctccaaaaaaccttcctcttcgttcacataagttattggttctgatttgagtaggaaaaatagttaacgtcagtgaaagctccctcttagagatccccctttccatctgcagaactagctggttctgatgtctgtgtcaaataaaggtaggtaatattctccgttgagctgagttttgggattgatgcatacccttttcgtttgctcacgaagccataatttttcttcaaaattgacacaggatgaatgatggaagtatgtatatgtaggtaacggttcaaataattatcagttgcgtcagttgagatcctgttcgcttatgtttctacttcatttttctagatgaattgcacaataaagtcaaaaaggcatggctaagatatccttcgtgcctgttggttcgtgccatatatattgtagaattgttaaaaagttttccaatctgcgatattccttggttttcgagacatttttcttgtttggtatgattggatgtgtattattttatttatggtattaaaaaacgtaggttgcactgtgatgtataaaaaagtttcttcgctttcgtaacacaatataatctatctctgtatctccaaatataaagaaaa

SEQ ID NO: 1442 - DNA, 3225 bp, Cicer arietinum
ggatggaggagacgaggacaaagaagagccacttgtcatgcaataaaccattccaagtgttgacaacagaaagtagtgtatatggcaagcaactctcacaagcaattcgaagagaacggtactagctagctactaataataatcgtagcatatatttcagtaacattctcattccgattttgcttcttcacaacaacacttctatgcttcatcagaggtctatcgttgttcttaatcgccttttctataaacacttatcaaccaccacaactacaaactttcgattccctttctcattttcacgtttcacacttccaaacattctctcaatggcaactcttcattccaatcaacacaacaacttcaccaatcgacttgcttcagaacaaagcccttatcttctccaacacgctcataaccctgttgattggtatccatggggagaagaagctttcgctgaagcacgccgccgagatgcacctatcttcttatcaatcgggtacagcacttgtcactggtgtcatgttatggaggttgagtcttttgaggatgaggggattgctaagttgttgaatgattggtttgttagtattaaggtggatcgagaggagcgaccagatgttgataaggtgtatatgacgtatgtgcaggctttgtatggtggaggaggttggcctctgagtgtatttctttcacctgatttgaaacctttaatgggcggaacttattttccccctgatgataaatatggccgacctggatttaagactatactcagaaaggtaaaagaggcttgggaagataagagggatatgctagttaagagtggagcatttgcaattgaacagctttctgaggcattgtctagtagttcagattctggtaaattgcctgatggtgtttctgacgaggcattacagctatgctctgaacagctctctgagagctatgattcagaattcggtggttttggatctgcaccaaaatttccgagacctgttgagatcaacttgatgctttaccactctaaaaagttggagaatactggaaagctggatggagctaacgaaagtcagaaaatggtcttctttaccttgcaatgcatggcaaaaggaggcattcacgatcatgttggaggggggtttcacagatatagcgtggatgagtgctggcacgttccacattttgagaagatgctttatgatcaagggcagcttgctaatgcttatttagatgctttttctatcacaaaaaataccttctattcatgtatatcacgggatatcctggactatttgaggagagatatgattggtccagaaggtgaaattttttcagcagaggatgccgacagtgcggagactgaagcggccacaagaaaaaaggaaggagccttttacatatggaccagggaagaggttgaagaaatacttggagagcatgctgctcttttcgaggagcactattacataaagcagatggggaactgtgacttatctagaatgagtgatcctcacaatgagttcaagggaaataatgtcctgattgagagaaatgatgcttcagaaatggcatcaaaatatggcatgtcggttgaaacatatcaagaaattctaggagaatgcaagcgtaagttgtttgaagtaaggtcaaagcgcccaaagccacatttggatgataaggttattgtatcttggaatggactggcaatctcgtcttttgctagggcttctaagattctaaagggtgaagctgaagggattaaattcaactttcctgttgttggcactgaaccgaaggagtacatgagaatagctgaaaaagcagcatcctttattaggaagcaactttacaatgcagagactcacagactacaacatagtttcagaaattctccatcaaaagctcctggtttcttggatgattatgcctttatgatttctggattgctggatctctatgaatttgggggtggaatcaactggcttttatgggccattgaattgcaggaaacccaggatgctttgtttcttgatagggatggagggggatatttcaataatacaggagaagattcttcggttcttctccgtgtgaaggaagaccatgatggagcagaaccctcagggaactcagtttctgcaataaatcttataagattagcttccatggtctctggaagtaaggctgagcattataagggaattgcagaacatctattggcagtttttgagaaaagattgaaagatatggctatggcagtgcctttaatgtgttgtgcagcagacatgctttgtgtaccttctcggaagcaagtggtggtggtgggcgaaaggacttccgaagaatttgaaaccatgcttgcggcagctcacacattatatgatcccagcagaacagttattcatatagatcccaacaacaaagaagagatggaattttgggaagtaaataacagcaatattgctctaatggcgaaaaataactatgcagtcagcaaggttgtagctcttgtatgccaaaacttcacttgtagtccccctgtgactgatcatttgacacttgaagctttgctctcccaaaaaccctcatccaagttgaaataagctatttagttctgatttatgtgtaggggaaaaggtccatgccagtgaaaactccctcttaaggatcctcctctcgatatgcataacttattcgttctgacttctgtatcaaataaaagtagacgttattctccatgacgtaacagggattgataaatgctctagtcgtttgcctgtgtacaagaatcctgaaattttcttcaaaattcatacagaactagtgcaggtacctataccatgcagagagtacatcttttatttatttacggggagatgaatttcattcaaacaataacagaggaggattcattacagacaatgaacccaacagattctgggacgcagcctgacccagacttagattcttgctgtttggctaagctaaccgatccatgagcaactttgtttttgcatcttctaataaaagtaacactaacagagagtacatatttgctccagaaaatatgcgacaaaaatgtatcactcaatgcaatcattttaattatattcttataactctgtttcaacggatatggtactttagtacaatagtacctaccccaaaacctttttttggtacacctaccccaaaaccttttaaccacaacctctcttgtat

SEQ ID NO: 1443 - DNA, 2530 bp, Lotus japonicus
ctgacacatgctcactgagtgaccaaaacacacttccaaatttccaatccaagcaaacagaccaagactcacattcacatactcttgtcttctcttctttctatgttgatactccaccaccttcataggtctcttggtcgcattttccactatcaccaccaccacctcctaccctcctcaaattcccctttctcattctcactccctctcaatctcaaactgaagaagaaacctctctctctctcactctcaaattcaatggcaacttcccactccaacccccaccacaaacacgccaatcgcctcgccgcagaacaaagcccttatcttctccaacacgctcacaaccccgttgattggtatccctggggtgaagaagctttcgccgaagctcgccgccgagatgccccaatcttcttatcaattgggtacagcacttgtcactggtgtcatgttatggaggttgagtcttttgagaatgaggagattgccaagttgttgaacgactggtttgttagtattaaggtggatcgagaggagcgaccggatgttgataaggtatacatgacgtatgtgcaggctttgtatggtggaggaggttggcccctgaatgtgtttctttcacctgacttgaaacctttaatgggtgggacttactttccccctgatgataagtatggacgacctggatttaagactttacttagaaaagtaaaagaggcttgggaagataagagggatatgctggttaagagtggagcttttgcaattgaacagctttctgaggcattgtctggtcgttcagattctgataaattggccgatggtgttccagatgatgcgatacgtctatgctcagagcagctctctgatagctacgattcaaagtttggtgggtttggatctgcaccaaagtttcccagaccagttgagataaacttgatgctttaccactccaagaagttggtggaggccgggaagttggctagagctcatgaaagtcagaaaaaggttttctttagcttacaatgcatggcaaaagggggcattcatgaccatattggaggaggttttcacagatatagcgtggataagtgctggcatgttccacattttgagaagatgctatatgatcaagggcagctggctaatgtttttttagatgctttttctatcacaaaagataacttcttttcatgtgtatcaagggatatccttgattatttaaggcgagacatgattggtccagaaggtgaaatcttttcagcagaggacgctgacagtgcagagactgacggagctacaacaaaaaaggaaggagccttttacgtatggaccagtaaagaggttgaagacatacttggagagcatgcagctctttttgaggagcattattacataaaggagtcgggaaactgtgacctgtctagaatgagtgatcctcacgatgaattcaagggaaagaatgtcctgattgagagaaaggatccttcagaaatggcatcaaaatatggcatgtcagttgagacatatcaagaagttctaggcgaatgtaggcgtaaattgtttgaagtgaggtcaaggcggtcaaggccacatttggatgataaagttattgtatcttggaatggactggcaatctcatcttttgctagggcctccaagattctcaaggttgaacctgaagggaccagattcaactttcctgtagtcagcactgaaccagggaatacatgagagttgcagaaaaagcagcattctttatcaggaagcaactttatgatgcggagactcacaggctacatcatagtttcagaaatctccatctaaagctcctggtttcttggatgattatgcatttctgatttgtggattactagatctctatgagtttggtggtggaatcaactggcttcaatgggccgttgaattgcaggaaacccaggatgctctgtttcttgataaagatggaggtggttatttcaataatactggagaagatgcttcagttcttctccgtgtgaaggaagaccatgatggggcagaaccttctgggaactcagtttctgtgataaatcttacaagattggcttccatggtttctggaagtaaggcagagcaatataaacgaaatgcagaacatttattggctgtttttgagaaaagattgaaagatacggctatggcagtgcctctgatgtgttgtgcagctgacatgctgcgtgtaccttcccccaagcaagtggtggtggttggtgaaaggacttgtgaggaatttgaaagcatgcttgctacagctcatgcattatatgatcccaacagaacagttattcatatagatcccaacaacaaagaagagatggagttttgggaagtaaataacagcaacattgctctcatggcaaagaataactattcaatcaacaaggttgtagctcttgtatgccaacacttcacttgtagcccccctgtgactaatcattctgcacttcaagctctgctttctaaaacatcctcgtcttcgtcgaca

SEQ ID NO: 1444 - DNA, 2829 bp, Medicago truncatula
ggagagtacatggcaactcaccaaggactttgagttcgaaacaaaaataacacaagagtgacaactaactagtgtgttctgttaataacttaccaaattcgcttctacgttagtacacatttctatcatattctatgcttcatcaaaggtctataagcgttcttaatcgctttttctatcataaccaaaaacacttccccacatcaacgaaatttcgaacccctttcaaattctcacgtgttacacttccgaaggttctatcaatggcaacatcatctcattccgatcaacacaagtttaccaatcgacttgcctcagaacaaagcccttatcttcttcaacacgctcataaccctgttgattggtatccatggggtgaagaagctttcgctgaagcacgccgcagagatgctcctatcttcttatcaatcgggtacagcacttgtcattggtgtcatgttatggaggttgagtcttttgaggatgagggaattgccaagttgttaaatgattggtttgttagcattaaggtggatcgagaggagcggccagatgttgataaggtatacatgacgtatgtgcaggctttgtatggtggaggaggttggcccctgactgtgtttctttcacccgacttgaaacctttaatgggtggaacttactttccccccgaagataaatatggccggcctggatttaagactatactcagaaaggtaaaagaggcttgggaaaataagagggatatgctagttaagagtggaacatttgcaattgaacagctttctgaggcactgtctagtagttcgaattctgataagttacctgatggtgtttctgaagatgcattacgtctatgctcagagcagctctctgagaactatgattcagaatacggtggttttggatctgcaccaaaatttccaagaccggttgagatcaacttgatgctttacaaatctaaaaagttggaggataccggaaagttagatggagctaacaaaagtcagaaaatggttttctttaccttgcaatgcatggcaaaaggaggcgtccacgatcatgttggaggagggtttcacagatatagcgtggatgaatgctggcatgttccacattttgagaagatgctttatgatcaagggcagcttgctaatgtttatttagatgctttttctatcacaaaagacaccttctattcatctttatcacgggatatcctggactatttgaggagagacatgattggtccagaaggtgaaattttttcagcagaggatgctgacagtgcggagaatgaaggggatacacgaaaaaaggaaggagccttttacgtatggaccagcaaagaggttgaagacttacttggagaacatgctgctctttttgaggagcactattacataaaacaaatgggtaactgtgacctatctgaaatgagtgatcctcacaatgaattcaaaggaaagaatgtcctgattgagagaaaggactcttcagaaatggcatcaaaatatggcatgtcaattgagacatatcaagaaattcttggagaatgcaggcgtaagttgtttgaagtaaggttgaagcgcccaaagccacatttggatgataaggttattgtatcttggaatggactggttatctcatcttttgctagggcttctaagattctaaagggtgaagctgaagggatcaaattcaactttcctgttgtcggcactgaaccaaaggagtacttgagaatagcagataaagcagcatcctttataaagaatcaactttacaacacagagactcacagactacaacatagtttcagaaattctccatctaaagctcctggtttcttggatgattatgcctttttgatttctggattactcgatctctatgaattcggaggtgaaatcaactggcttttatgggccattgaattgcaggaaacccaggatactttgtttcttgacaaggatggtggtggatatttcaataatacgggagaagattcttcggttcttctccgtgtgaaggaagaccatgacggggcagaaccctcagggaactctgtctccgcgttaaatcttataaggttggcttcattggtttctggaagtaaggctgagcattataagcgaaacgctgaacatctattggcagtttttgagaaaagattgaaagatacggctatggcggtgcctttaatgtgttgtgcagcagacatgctgcgtgtaccttcccgtaagcaagtggtattggtgggtgaaaggacttccgaggaatttgaaagcatgcttggtgcagctcacgcattatatgatcccaatagaacagttattcatatagatcccaacaacaaagaagagatggatttttgggaagtaaataacagcaatattgctttgatggcgaagaataactattcaggcagcaaggttgtagctcttgtatgccaaaacttcacatgtagtgcccctgtcactgatcattcgtcacttgaagctttgctctcccaaaaaccctcctcatagttgaataaagatatttgggattcatgaggggggaaaagtgcatgccagtcaaagctccctcttaaatttcccccttgcttggtagttggtatacatataacttattagttctaactactgtatcaaataaaagtagatgttgagctagatgattgtaaatatactcaagtggttggcctgtgcacaagagtcttgaaattctcttcaaaattcacacagaatgaagaaagtgtatgtgtacttttgtgtaggtcacttttgaaacaggtttaaatgttccatttgctccttccaaata

SEQ ID NO: 1445 - DNA, 2828 bp, Medicago truncatula
ggagagtacatggcaactcaccaaggactttgagttcgaaacaaaaataacacaagagtgacaactaactagtgtgttctgttaataacttaccaaattcgcttctacgttagtacacatttctatcatattctatgcttcatcaaaggtctataagcgttcttaatcgctttttctatcataaccaaaaacacttccccacatcaacgaaatttcgaacccctttcaaattctcacgtgttacacttccgaaggttctatcaatggcaacatcatctcattccgatcaacacaagtttaccaatcgacttgcctcagaacaaagcccttatcttcttcaacacgctcataaccctgttgattggtatccatggggtgaagaagctttcgctgaagcacgccgcagagatgctcctatcttcttatcaatcgggtacagcacttgtcattggtgtcatgttatggaggttgagtcttttgaggatgagggaattgccaagttgttaaatgattggtttgttagcattaaggtggatcgagaggagcggccagatgttgataaggtatacatgacgtatgtgcaggctttgtatggtggaggaggttggcccctgactgtgtttctttcacccgacttgaaacctttaatgggtggaacttactttccccccgaagataaatatggccggcctggatttaagactatactcagaaaggtaaaagaggcttgggaaaataagagggatatgctagttaagagtggaacatttgcaattgaacagctttctgaggcactgtctagtagttcgaattctgataagttacctgatggtgtttctgaagatgcattacgtctatgctcagagcagctctctgagaactatgattcagaatacggtggttttggatctgcaccaaaatttccaagaccggttgagatcaacttgatgctttacaaatctaaaaagttggaggataccggaaagttagatggagctaacaaaagtcagaaaatggttttctttaccttgcaatgcatggcaaaaggaggcgtccacgatcatgttggaggagggtttcacagatatagcgtggatgaatgctggcatgttccacattttgagaagatgctttatgatcaagggcagcttgctaatgtttatttagatgctttttctatcacaaaagacaccttctattcatctttatcacgggatatcctggactatttgaggagagacatgattggtccagaaggtgaaattttttcagcagaggatgctgacagtgcggagaatgaaggggatacacgaaaaaaggaaggagccttttacgtatggaccagcaaagaggttgaagacttacttggagaacatgctgctctttttgaggagcactattacataaaacaaatgggtaactgtgacctatctgaaatgagtgatcctcacaatgaattcaaaggaaagaatgtcctgattgagagaaaggactcttcagaaatggcatcaaaatatggcatgtcaattgagacatatcaagaaattcttggagaatgcaggcgtaagttgtttgaagtaaggttgaagcgcccaaagccacatttggatgataaggttattgtatcttggaatggactggttatctcatcttttgctagggcttctaagattctaaagggtgaagctgaagggatcaaattcaactttcctgttgtcggcactgaaccaaaggagtacttgagaatagcagataaagcagcatcctttataaagaatcaactttacaacacagagactcacagactacaacatagtttcagaaattctccatctaaagctcctggtttcttggatgattatgcctttttgatttctggattactcgatctctatgaattcggaggtgaaatcaactggcttttatgggccattgaattgcaggaaacccaggatactttgtttcttgacaaggatggtggtggatatttcaataatacgggagaagattcttcggttcttctccgtgtgaaggaagaccatgacggggcagaaccctcagggaactctgtctccgcgttaaatcttataaggttggcttcattggtttctggaagtaaggctgagcattataagcgaaacgctgaacatctattggcagtttttgagaaaagattgaaagatacggctatggcggtgcctttaatgtgttgtgcagcagacatgctgcgtgtaccttcccgtaagcaagtggtattggtgggtgaaaggacttccgaggaatttgaaagcatgcttggtgcagctcacgcattatatgatcccaatagaacagttattcatatagatcccaacaacaaagaagagatggatttttgggaagtaaataacagcaatattgctttgatggcgaagaataactattcaggcagcaaggttgtagctcttgtatgccaaaacttcacatgtagtgcccctgtcactgatcattcgtcacttgaagctttgctctcccaaaaaccctcctcatagttgaataaagatatttgggattcatgaggggggaaaagtgcatgccagtcaaagctccctcttaaatttcccccttgcttggtagttggtatacatataacttattagttctaactactgtatcaaataaaagtagatgttgagctagatgattgtaaatatactcaagtggttggcctgtgcacaagagtcttgaaattctcttcaaaattcacacagaatgaagaaagtgtatgtgtacttttgtgtaggtcacttttgaaacaggtttaaatgttccatttgctccttccaaat

SEQ ID NO: 1446 - DNA, 2606 bp, Glycine max
tcctctccatggcatcatctcattcccacatacacattaatcgactcgcttccgagcagagcccctaccttctccaacacgcacataaccctgttcattggtatccctggggtgaagaagccttcgccgaagcgcgccgccgagacgcgcctatcttcttgtcaattggttacagcacttgtcactggtgtcatgttatggaggtcgagtctttcgaggatgaagcggttgccaagttgctgaacgattggtttgttagcattaaggtggatcgagaggagcgaccagatgttgataaggtgtacatgtcgtatgtgcaggctttgtatggtggaggaggttggcccctgagtgtgtttctttcacctgacttgaaacctttaatgggtggaacttacttcccccctgatgacaagtatggacgacctggatttaagactatacttagaaagttaaaagaagcttgggatagtaagagggatatgctgattaagcgtggatcatatgcaattgaacaactttctgaggcaatgtctgctagttcagattctgataaactgcctgatggggttccagctgatgcgttacgcctatgctcggagcagctttctgggagctatgattcaaagtttggtggttttggatctgcaccaaagtttcccagaccagttgagataaacttgatgctatatcactccaaaaagttggaagatacggggaagttggatggagctaatagaattcagaaaatggttttctttagcttgcaatgcatggcaaaaggcgggatgcatgatcatattggagggggatttcacagatacagtgtggatgagtgctggcatgttccacattttgagaagatgctttatgatcaagggcagcttgctaatgtttatctagatgcgttttctatcacaaaagataccttttattcatatatatcacgggatatccttgattatttaaggagagatatgattggtccagaaggtgaaattttttcagcagaggatgctgacagtgcagagactgaaggagctgcaagaaaaaaggaaggagccttttacatatggacaggcaaagaggttgcagacatacttggagagcatgctgctcttttcgaggagcactattacatcaagcaatcaggtaactgtaacctatctggaatgagtgatcctcacgatgaattcaagggaaagaatgtcctgattgagagaaaggaaccttcagaactggcatcaaaatatggcatgtcaattgagacatatcaagaaattcttggagagtgcaggcataagttgtttgaagtaaggtcaaggcgtccaaagccacatttggatgataaggttattgtatcatggaatggactggcaatctcatcttttgctagggcttctaagattctcaagggtgaagttgaagggaccaaattctactttcctgtcgttggcactgaagcaaaggggtacttgagaattgcagaaaaagcagcattctttatttggaaacagctttacaatgtggaaactcacaggctacaccatagtttcagacattctccgtctaaagctcctgctttcttggatgattatgcttttctgatttctggattgctggatctctatgaatttggtggtggaattaactggcttctatgggccattgaattgcaggaaacccaggatgccttgtttcttgataggacaggaggtggatatttcaataatacaggagaagattcttccgttctcctccgggtaaaggaagaccatgatggtgcagaaccctcaggaaactcagtttctgctataaatcttataagattggcttccatggttgctggaagtaaggctgagcactataagcaaaatgcagaacatctattggccgtttttgagagaaggttgaaagatatggctatggcagtgcctctaatgtgttgtgcagcagacatgttgcatgtaccttcacggaagcaagtggttgtggttggtgaaaggacttctggggactttgaaaacatgcttgctgcagctcatgcattatatgatcccaacagaacagttattcatatagatcccaacaacaaagaagagatgggattttgggaagtaaataacagcaatgttgctctcatggcaaaaaataactttgcagttgacaaggttgtagctcttgtatgccaaaacttcacttgtagcccccctgtcactgatcattcgtcacttgaatctttgctctccaaaaaaccttcctcttcattaacataagctattggttctgattagtaggaaaaatagtagctccctcttagagatcctccttttcgtctacagaactagttggttctgacttctctgtcaaataaactaataaaggtaggtaatattctccgttgagttgagggattgatgcatatccttttcgtttgcctgtgctcaacaagccataatttttctttaaatgtgatacagaatgatggaatcatggatatataattgtatatgtattatgtaggcaatggttgaaataattatcttctccagttggggtctgttctcatatgtttgtacttcatttttttctcgttgaactggcac

SEQ ID NO: 1447 - DNA, 1033 bp, Cyamopsis tetragonoloba
cacgagggttgatctgatttcatggacggacacgattcagaagacccaaagcagagcactgctgatatgacagcttttgtgcaaaatctccttcaacagatgcaaattaggttccagacaatgtctgactccatcatttcgaaaattgatgagatgggaaaccgcattaacgagttggagcaaagcatcaatgacctaagagcagagatgggggtggagagcaatccatcacctgtggcccctcttaagccaaaggaagaagtgtcaaacaaagaagagggttcagcttagtctgatacatcaataatttgctattctgtatctttagttcagaattcagatatttgccatgtatctatgatttctctcactctcttttatagctaaacttggcatactgttcatatatatatagataaaacaaaaaagtactgctgcctaattgtttgtttttcccattcgaaatgggtgccattgggtgctatttgtgtgaaaacgcgtcctctccggggcttcattgtggacgggaattgtatctgcagtttctcactctcaatcgtccaatttacaatttaatattgcgtttatagttatgatgagtatcaactttctcctccattctcatcctcaccatctccatcaccacctacatatttctatggtggcaatcaaattcaaacccgtgtacgctctgaaacagcacctgtaactatacctcacccaatgatgggcaaaagctccagaaatctttctcctaatttctcagatcctaatagaaattctcttccccctttatctcccagaaggaatgatgcttcatcacaggagtctccatctgcaatcaggccattcaggaaattagaaccttcaaggactggtcaaaagcttgtcagacatagcaaggaagactcacggcggccctccggactgttatcttctagtggctcaccccgtgttggcattttctagaacctcgagtagactatcttttcccagacgacttcccgatggtgaccttttcatgtccttttga

SEQ ID NO: 1448 - DNA, 525 bp, Glycyrrhiza uralensis
gaatctttgggtttggcatgaatatctagtttggacccaaacgtgtgtccatttttaggtcgcctttgaggctttgaaacttgttgaaggagttgcaggtgcagcgttgatcaaaccatggatggacatgactcagaagacccaaagcaaagcactgctgacatgactgcttttgtgcaaaatcttcttcagcagatgcaaatcaggttccagaccatgtcagactccatcatttcaaagattgatgagatgggaaaccgtatagatgagttggagcaaagcatcaatgacctaagagcagagatgggagtggagagctccccatcacctgtggcccctgctaagccaaaggaagaagagtccaacaaagaaggttcagcttaactaacgtttgttgtctcgtgatacatcaggattttgtcactgtgtatctatcttgtgagtgcagaagtggttcacaattcagatatatttggcatgtaacttaatgatgcattctctcttttgtagctaaagttatctttt

SEQ ID NO: 1449 - DNA, 636 bp, Vigna unguiculata
ggagagtggaagtctgcacttattttcttgtggtatagactttgaaagcagttgaaggagttggaagtgaaattttaatcatagcatggacggacatgattctgaagacccaaagcaaagcactgctgatatgacagcttttgtgcaaaatcttcttcaacagatgcaaattaggttccagacaatgtctgactccataattacaaagattgatgagatgggaaaccgtataaatgagttggaacaaagcatcaatgatctaagagcagagatgggagtggagagcactccatcacctgtggcccctgttgcccgtgctaagcgaaaggaagaagagtcgaacaaagaagaaggttctgcttgagttacatttgtgttctactgtcttgttttgtatcttgtcgtagtgtctgaagtccatttagacttaaagttcaccttttaacgcagttcaggattctgggacactgtatctagcgaactttctctttggtagctaaaaattactgttcaaactatgtaaaatgcaaagtctcgtcgttgatttcttgtgtttttataattggtatgtgctagattgggtgccatgtgtttgtggatgatatttcctatactataaattgcttgattactttg

SEQ ID NO: 1450 - DNA, 597 bp, Cicer arietinum
aattcacaattcagtttttgaaacttgttgaaggaatttccagcagttgcaggcaccgttcattcatcaaatcatggatggacatgattcagaagacccaaagcaaagcactgctgatatgactgcttttgtgcaaaatcttcttcagcagatgcaaactaggttccaaacaatgtccgactccatcatttcaaagattgacgatatgggaagccgtataaatgagttggagcaaagcatcaatgacctaagagcagagatgggagtggagggctctccatcacctgtggcacctgctaagccaaatgaagaagagtcgaacaaagaaggttccgcttaagtaacattgttcaactgcccttttttgttgtctcgtgatacatcagggtcttgtcactgtaccttgggagtatagaagttattcatggtacagatattaggcatggaacatatgagcgaactttctcatttgtagctaaagtttgtcttactgttgaaacagtgctgttgactaattgattctcttttcaatttgaaatgggttagacccggcaatattggtggagtataatttctgttatattgattgctttgttc

SEQ ID NO: 1451 - DNA, 669 bp, Vigna unguiculata
  misc_feature (22)..(22): n is a, c, g, or t
  misc_feature (117)..(117): n is a, c, g, or t
  misc_feature (344)..(344): n is a, c, g, or t
  misc_feature (376)..(376): n is a, c, g, or t
  misc_feature (387)..(387): n is a, c, g, or t
  misc_feature (402)..(402): n is a, c, g, or t
  misc_feature (427)..(427): n is a, c, g, or t
  misc_feature (429)..(429): n is a, c, g, or t
  misc_feature (436)..(436): n is a, c, g, or t
  misc_feature (438)..(439): n is a, c, g, or t
  misc_feature (445)..(445): n is a, c, g, or t
  misc_feature (447)..(447): n is a, c, g, or t
  misc_feature (453)..(455): n is a, c, g, or t
  misc_feature (458)..(458): n is a, c, g, or t
  misc_feature (461)..(461): n is a, c, g, or t
  misc_feature (471)..(471): n is a, c, g, or t
  misc_feature (505)..(505): n is a, c, g, or t
  misc_feature (511)..(511): n is a, c, g, or t
  misc_feature (519)..(519): n is a, c, g, or t
  misc_feature (523)..(523): n is a, c, g, or t
  misc_feature (571)..(571): n is a, c, g, or t
gggatttcactgttaagtaagnagagtggaagtctgcacttattttcttgtggtatagactttgaaagcagttgaaggagttggaagtgaaattttaatcatagcatggacggacangattctgaagacccaaagcaaagcactgctgatatgacagcttttgtgcaaaatcttcttcaacagatgcaaattaggttccagacaatgtctgactccataattacaaagattgatgagatgggaaaccgtataaatgagttggaacaaagcatcaatgatctaagagcagagatgggagtggagagcactccatcacctgtggcccctgttgcccgtgctaagcnaaaggaagaagagtcgaacaaagaagaaggtnctgcttgagtnacatttgtgttctantgtcttgttttgtatcttgtcgtantntctgaantnnatttananttcatnnnttnatncttcttaacncatagttcaggattctggattctgtgacactgtntctagngaactttntctntggtagctaaaaattactgttcaaactatgtaaaatgcaaagtctcgncgttgatttcttgtgtttttataattggtatgtgctagattgggtgccatgtgtttgtggatgatatttcctatactataaattgcttgattactttg

SEQ ID NO: 1452 - DNA, 712 bp, Cajanus cajan
ggtagtgtttggtgtgttttatgtaaatatgtaattgcgtgagtcgtagagtgaagaatatacttatacttgctgggtaagattaaatggaccctagtggaagtgtgagtacccccttgacccttgtttgttcgttgtttaggcttggaaattgattggatttgcaggtgcagcatcatggacggacatgattcagaagacccaaagcaaaacacggctgatatgacagcttttgtgcaaaatcttcttcagcagatgcaaactaggttccagacaatgtccgactccatcatttcaaagattgatgagatgggaaaccgtatagaggagttggagcaaaacatcaacgatctaagagcagagatgggagtggagagcactccatcactgtcccctgctaagccaaaggaagaagagtcgaagaaagaagagggttctgcttgagtaacatttcctgttcaactgccgtgttttcaatgggtctcgtgatacattccggattttgttactgtgtatctagtggactttctctttggtagctaaaactcacagttcaaactaagtaaaaatcacagtactgttgattaattgtgtgagtgtgtgtgtgtgtgtgtgtttttttttcttccaatttgagatgagctagactgggtgctatttgtggatgatatttctattttcgatattttaatatttaaatttcgattacttc

SEQ ID NO: 1453 - DNA, 643 bp, Cajanus cajan
tacttgctgggtaagattaaatggaccctagtggaagtgtgagtacccccttgacccttgtttgttcgttgtttaggcttggaaattgattggatttgcaggtgcagcatcatggacggacatgattcagaagacccaaagcaaaacacggctgatatgacagcttttgtgcaaaatcttcttcagcagatgcaaactaggttccagacaatgtccgactccatcatttcaaagattgatgagatgggaaaccgtatagaggagttggagcaaaacatcaacgatctaagagcagagatgggagtggagagcactccatcactgtcccctgctaagccaaaggaagaagagtcgaagaaagaagagggttctgcttgagtaacatttcctgttcaactgccgtgttttcaatgggtctcgtgatacattccggattttgttactgtgtatctagtggactttctctttggtagctaaaactcacagttcaaactaagtaaaaatcacagtactgttgattaattgtgtgagtgtgtgtgtgtgtgtgttgtttttttttcttccaatttgagatgagctagactgggtgctatttgtggatgatatttctattttcgatattttaatatttaaatttcgatta

SEQ ID NO: 1454 - DNA, 768 bp, Medicago truncatula
gctgaaatttcaatttttttaagggagcggtaaatttgtacaagacaaaatggtccttttggattttccttcaacttggtggaactaagccagagagtcctttattggtcgctcacaaagttgattcagcttttgaaagttgaagcacttccattccatttcagaaacgttgttcaaaattcaaatcatggatgcacatgactcagaagacccaaagcaaagcactgctgatatgactgtttttgtgcaaaatcttcttcagcagatgcaaactaggttccagacaatgtctgactccatcatttcaaagattgacgaaatgggaagccgtataaatgagttggagcaaagcatcaatgatctaagagcagagataggagtggagagctctccatcacctgtggcccctgttaagccaaaggaagaagagttgaagaaagaaggttccgcataagataacatcaggattttgtccctgtatcttatgagtatagaggtgattcggaacttagatatttgtcatggaacatatgagtgcactctcttttgtagctaaagtttgtctctgttaaaaaaattacagtactgctgattaatttttcctttttccaattcgagatgatctagacttgttactattggtggaggaaaacttctattatattgattactttgttctccttctgcctgttttatttgcatgctctggttgtttattaattcgtttttagattgcacaaacagggcaattcgtgtccctagatccaa

SEQ ID NO: 1455 - DNA, 597 bp, Medicago truncatula
agagagtcctttattggtcgctcacaaagttgattcagcttttgaaagttgaagcacttccattccatttcagaaacgttgttcaaaattcaaatcatggatgcacatgactcagaagacccaaagcaaagcactgctgatatgactgtttttgtgcaaaatcttcttcagcagatgcaaactaggttccagacaatgtctgactccatcatttcaaagattgacgaaatgggaagccgtataaatgagttggagcaaagcatcaatgatctaagagcagagataggagtggagagctctccatcacctgtggcccctgttaagccaaaggaagaagagttgaagaaagaaggttccgcataagataacatcaggattttgtccctgtatcttatgagtatagaggtgattcggaacttagatatttgtcatggaacatatgagtgcactctcttttgtagctaaagtttgtctctgttaaaaaaattacagtactgctgattaatttttcctttttccaattcgagatgatctagacttgttactattggtggaggaaaacttctattatattgattactttgttctccttctgcc

SEQ ID NO: 1456 - DNA, 488 bp, Medicago truncatula
catgactcagaagacccaaagcaaagcactgctgatatgactgtttttgtgcaaaatcttcttcagcagatgcaaactaggttccagacaatgtctgactccatcatttcaaagattgacgaaatgggaagccgtataaatgagttggagcaaagcatcaatgatctaagagcagagataggagtggagagctctccatcacctgtggcccctgttaagccaaaggaagaagagttgaagaaagaaggttccgcataagataacatcaggattttgtccctgtatcttatgagtatagaggtgattcggaacttagatatttgtcatggaacatatgagtgcactctcttttgtagctaaagtttgtctctgttaaaaaaattacagtactgctgattaatttttcctttttccaattcgagatgatctagacttgttactattggtggaggaaaacttctattatattgattactttgttctccttc

SEQ ID NO: 1457 - DNA, 589 bp, Trigonella foenum-graecum
ggaatatcctttaacttttaggaccgaagtcggagtgtcctttattggcaaagttgaaacttgttgaattgttcattccagctcaagaagaagcgtcgttccaaattcaaatcatggatggacatgactcagaagacccaaagcaaaacactgctgatatgactgtttttgtgcaaaatcttcttcagcagatgcaaactaggttccagacaatgtccgactccatcatttcaaagattgacgaaatgggaagccgtatagatgagttggagcaaagcatcaacgatctaaaagcagagatgggagtggagagctctccattacctgtggcccctgttaagccaaaggaagaagagttgaaaaaagaaggttcggcatgagatacatcaggattttgtccatgtatcttgtgagtatagaagtgattcagagctcagatatttgttatggaacatacgagtgcactctcttttgtagctaaagtaaattacagtactgctgactaatttttcttttttcaattcgagatgagctagactggtcactattggtggaggaaaatttctgttatataattactttgttctcc

SEQ ID NO: 1458 - DNA, 728 bp, Medicago truncatula
cggttctcctcattttcgtttcatttcatttcgaaacgttggtgtaaagctgaaccatcatcttcatcatcttcatcatcattatcaaaatctcatggatagccacgattcaaacgatcctaagcaaagccccgctgatatgaccgcatttgtgcaaaatcttcttcagcagatgcaaagtaggttccagaccatgtctgactccattgttacaaagattgatgatatgggaagtcgtatcaatgagttggagcagagcatcaatgacctgagagctgagatgggagtggagagctctccatcaccagcagcccccgagaagccaaaggaagaagagtcgaaaaaagaagagggttcagattaagtgacattttaatttcaatttctcattgttcttgtcttgcattgtacaatgattgttatggcgcatcaactatctctgtctatgtagtggttctgaaaactaatgtgttgtgtggctgcgtacagcggatcatttgtagctaaatcaccttgctctttttatgatttagccatactactacaattttatattacagtcactttgttgctctcgtattggctattccccagcatgctgctatgtgctgatgaatgaatgaatgagtatgtgaccccaaatcctggtgctgctgtactgatatccatttttttggtactctattccatattttatttaaagtttccaacatcttgataagtggttc

SEQ ID NO: 1459 - DNA, 523 bp, Lotus japonicus
ggacggacaagattcgcaggatcccaagcaaagccctgctgacatgacagcttttgtgcaaaatcttcttcagcagatgcaaagtaggtttcagacgatgtccgactccattgttacgaagattgatgatatgggaagccgtataaatgagttggagcaaagcatcaatgacctacgagcggagatgggagtggagagctctccttcacctgtggcccctgccaagccaaaggaagaagacaaagaggagggttcagcttaaagtgacgtttcaattccaatttctcattgttcttatcttgtattgcactaggattggtatggttcatctatctttatctcaggatgggttcagaaaatagatgtgctgtgttgctatgagtacacctgatcatttgtagctaaatcaccttctgtttttatttactcttacaattttatattgctattactgtgttgcgcacatgcccgttatccactcagtatgctctgggtcgacaaatgaatgaatccatgctcccaa

SEQ ID NO: 1460 - DNA, 705 bp, Medicago truncatula
ttttcgtttcatttcatttcgaaacgttggtgtaaagctgaaccatcatcttcatcatcttcatcatcattatcaaaatctcatggatagccacgattcaaacgatcctaagcaaagccccgctgatatgaccgcatttgtgcaaaatcttcttcagcagatgcaaagtaggttccagaccatgtctgactccattgttacaaagattgatgatatgggaagtcgtatcaatgagttggagcagagcatcaatgacctgagagctgagatgggagtggagagctctccatcaccagcagcccccgagaagccaaaggaagaagagtcgaaaaaagaagagggttcagattaagtgacattttaatttcaatttctcattgttcttgtcttgcattgtacaatgattgttatggcgcatcaactatctctgtctatgtagtggttctgaaaactaatgtgttgtgtggctgcgtacagcggatcatttgtagctaaatcaccttgctctttttatgatttagccatactactacaattttatattacagtcactttgttgctctcgtattggctattccccagcatgctgctatgtgctgatgaatgaatgaatgagtatgtgaccccaaatcctggtgctgctgtactgatatccatttttttggtactctattccatattttatttaaagtttccaacatcttg

SEQ ID NO: 1461 - DNA, 774 bp, Cicer arietinum
ttcgagcggccgcccgggcaggtacgcggggatttcatttcattttgaaaacttgttggagctcagcaattagcacctgcatcgatcaccatcatcatggacagccaggattctcaagacgcaaagcaaagccctgctgatatgacagcatttgtgcaaaatcttcttcagcagatgcaaagtaggttccagaccatgtctgactccattgttacaaagattgatgatatgggaaatcgtataaatgagttggagcagagcatcactgacctgagagctgagatgggagtagaaggctctccatcaccagtggcccccgcaaagtcaaaggaagaagagtcaaacaaagaagagggttcagcttaaagtgacatttcgatttctcactgttcttgtcttggattgcacgatgattggtgtgtttgtctaagtagtggttcagaaaactaatgtgttgtgtggctgaatacagctgattatttgtagctaaatcaccttactgtttttatgatttagcaatacttctgcaattttatattacaatctcgttgttgcccacctacctcgattaccccataattctatatattctatgtgctgaatcgtcgatgaatggatgaaagaatccatgatcccaaatcccgggtgctgctgtactgatacccaatattttgtactttattttcaacatcttgataagtggttccatagattcaattagtttttttcccccttcaaacttttgaatcaagagtgggatatttcattcatcat

SEQ ID NO: 1462 - DNA, 567 bp, Glycine max
atttcaattcattttgaattgaaaccgcggagagtttgcagctgcatcatcgatcatcgtcacctcatggacggacacgattcacaagacccgaagcagagccctgctgacatgactgcctttgtgcaaaatcttctccagcagatgcaaaataggttccagacaatgtccgactccattgttacaaagattgatgatatgggaagtcgcataaatgagttggaacaaagcatcaatgacctaagagcagagatgggagtggagtcctctccatcacctgcgacccctgctaagccaacagaggaaatcaccaaagaagagggttcagcttaagtggcgtgttctgatttcagttgctcgttattcatgtattcatgtattgtattgcacaaggattgatgttatgcatctacttttgtctgctgtagtggttcagaaaacagatgtgctgtatagctatgagtgcatctgattatttgtagctaactcgtattttttttatgacttatgggtacacctatactttatgttgcgattactttgttgccaatgtcatcatgtccattt

SEQ ID NO: 1463 - DNA, 757 bp, Phaseolus coccineus
gaactaaaagggtagttttgtacttacgcaataacttgtagggtgagattaaattgaaacggtctcataggtgcatctcatatcattttgaattgagaccgcggagcagaatattttgcagctgcatcaaaaatcatccatggacggacacgattcacaggaccctaagcaaaaccctgctgatatgactgcctttgtgcaaaatcttcttcagcagatgcaaaataggttccagacaatgtccgactccattgttacaaagattgatgatatgggaagccgtataaatgagttagagcaaagcatcaatgatctaagagcagagatgggagtggagtcctctccatcacctgtgcccactgcaaagccaacagaggacgaaaccaaagaagagggttcagcttaagtggcgttctgatttgagttgctcattattcatgtattgcattgtacaaggattttgatattctgcatctatatttgtctgctgaagttgttcggaaaacagatgtgctgtatacctatgagtgcatctaatcatttgtagctaactcgtatcgctttttatgatttaagggtaaacctattttttatgttgcaacctgcctctttttataactcaccatgctctggctgcccgaatccataccccctgaatccaggggttgctgtactaatattattcattttttattgtttctacaaacctgtttattttcgaaatttttaaagaaagttattgtaaacctcatttacc

SEQ ID NO: 1464 - DNA, 724 bp, Cajanus cajan
tctttccatttcattttgaattgaaaccgcggagccgagagcaatttgctgctgcatcgatcttcatctcattctcatggacgggcaagattcgcaagaccctaagcaaagtcctgctgacatgacagcctttgtgcaaaatcttcttcagcagatgcaaaataggttccagacaatgtccgactccattgttacaaagattgatgatatgggaaaccgtataaatgagttggaacaaagcatcaacgacctgagagcagagatgggagtggagggctctccatcacctgtggcccctgctaagccaacagaggagactaccaaagaagagggttcaacttaagtggcgttctgatttcagttgctcattattcatgtattgcattgcacaaggattgatattatgcatctattttgtctgccttagtagtttagaaaacagatgtgctgtatagctatgagtgcacctgaacatttgtagctaactcgtatgttttttatgacttgagcgtacacctatacatttatgttgcaattaatttgttgccaccattttgcccctttttttctcagcatgctctgggtggatgaaccatggtcccaaatccagggattgctgtactagtaatactcattttttttttttttcaatttttgaaagattgccaagactaaagagcacttgtatgcaaggcttgtaaaaccaatttaccaatgccattgt

SEQ ID NO: 1465 - DNA, 525 bp, Phaseolus coccineus
ggggatatcattttgaattgagaccgcggagctgaatattttgcagctgcatcaaaaatcatccatggacggacacgattcacaggaccctaagcaaaaccctgctgatatgactgcctttgtgcaaaatcttcttcagcagatgcaaaataggttccagacaatgtccgactccattgttacaaagattgatgatatgggaagccgtataaacgagttagagcaaagcatcaatgatctaagagcagagatgggagtggagtcctctccatcacctgtgcccactgcaaagccaacagaggacgaaaccaaagaagagggttcagcttaagtggcgttctgatttgagttgctcattattcatgtattgcattgtacaaggattttgatattctgcatctatatttgtctgctgaagtggttcggaaaacagatgtgctgtatacctatgagtgcatctaatcatttgtagctaactcgtatcgctttttatgatttaagggtaaacctattgtttatgttgta

SEQ ID NO: 1466 - DNA, 517 bp, Trifolium pratense
caaagttcattcaaactcgttctgtgaagcgttcttcaaaattcaaaatcatggatggacatgactcagaagacccaaaacaaagcactgctgatatgactgtttttgtgcaaaatcttcttcagcagatgcaaactaggttccagacaatgtctgactccatcattacaaagattgacgatatgggaagccgtataactgagttggagcaaagcatcaatgacctaagagcagagatgggagtggagagctctccatcacctgctaagccaaaggaagaagggtcgaacaaagaagattcagcataagtaaagcaccgttcaactaccttatttgttgtctcatgatacatcaggattttttccctgtatcttgttagtatagaaatatatttgtcagggaacatatgagtgcactctcttttgtagctaaagtttatctttctgcaaaaaaaaattacagtactgctgactaatctcgactattggtagagagaaatttcttctctgttaaaaaa

SEQ ID NO: 1467 - DNA, 703 bp, Cajanus cajan
aaaccgcggagccgagagcaatttgctgctgcatcgatcttcatctcattctcatggacgggcaagattcgcaagaccctaagcaaagtcctgctgacatgacagcctttgtgcaaaatcttcttcagcagatgcaaaataggttccagacaatgtccgactccattgttacaaagattgatgatatgggaaaccgtataaatgagttggaacaaagcatcaacgacctgagagcagagatgggagtggagggctctccatcacctgtggcccctgctaagccaacagaggagactaccaaagaagagggttcaacttaagtggcgttctgatttcagttgctcattattcatgtattgcattgcacaaggattgatattatgcatctattttgtctgccttagtagtttagaaaacagatgtgctgtatagctatgagtgcacctgaacatttgtagctaactcgtatgtttttatgacttgagcgtacacctatacatttatgttgcaattaatttgttgccaccattttgcccctttttttctcagcatgctctgggtgatgaaccatggtcccaaatccagggattgctgtactagtaatactctattttttttttttcattttttgaaagtattgccaagactaaagagcacttgtatgcaaggcttgtaaaaccatttaccaatgccattgtagaac

SEQ ID NO: 1468 - DNA, 536 bp, Glycine max
gcattttcatttcattttgaattgaaaccgcggagagtttgctgctacatcgatcatcatcacctcatggacggacacgatccacaagacccaaagcagagccctgctgacatgactgcctttgtgcaaaatcttcttcagcagatgcaaaataggttccagacaatgtccgactccattgttacaaagattgatgatatgggaagtcgcataaatgagttggaacaaagcatcaatgacctgagagcagagatgggagtggagtcctctccatcacctgcagcccctgctaagctaacggaggagataaccaaagaagagggttcagcttaagtggcattctgatttcagttgctcattattcatgcattgtattgcacaaggattgatattctgcatctacttttgtctgctgtagtggctcagaaaacagatgtgctgtatagctatgagtgtatctgattatttgtagctaactcgtattgtttttatgatttatgggtacacctatacttttatgttgcaattacttgttg

SEQ ID NO: 1469 - DNA, 601 bp, Manihot esculenta
gtcgcccccaaacgctcagcatcgtaggcactgtccggtaaccgaccgagcaaagcaaaggaagtcggagattagctatcaaaccaaacaatggacggacatgattccgaagatccgaagcaaagcactgctgatatgactgcttttgtgcaaaatcttcttcaacagatgcaatcccggttccaaacaatgtcagactccattgttacaaagattgacgagatgggaactcggataaacgacttggagcagagcataaatgacttgagagcagagatgggagtggagggctcaccatctcctttggcatccaagcaaaagccgaatgaagacaaccgcggagaaggttcagcttagagtcatttcttccgtgtcagatggttttaatttcatgcgtacttcagtttgttttttcttctttaaaatgtggtttgagaattaaatttttatatctactgttactgttattcccacatgcagtttctctttgaatctggttgggagtaacttctgtcttctggtgctgttgtagaggaaaacttgcaaatctgagatgttattttagttatgatacctgttcagtcatttcttgattgtggcc

SEQ ID NO: 1470 - DNA, 740 bp, Vigna unguiculata
ggaaaaagggtagttctgtacttacacattaagttgtgggatgagattaaattgaaacggtctcatatttgcatctcatatcattttgaattgaaaccgcggagctgagtattttgcagctgcatcaaaaatcatctcatggacggacaggattcacaggaccctaagcaaaaccctgctgatatgactgcctttgtgcaaaatcttcttcagcaaatgcaaaataggttccagacgatgtccgactccattgttacaaagattgatgatatgggaaaccgtataaatgagttggagcaaagcatcaatgatctaagagcagagatgggagtggagtcctctccatcacctgtgcccactgctaagccaacagaggaggaaaccaaggaagggggttcagcttaaatgacgatttgatttcatttgctacatttttcatgtatttcactgtacaaggattttggtactttgcatctatatatgtctgctgaagtggtttggaaaacagagtgcatctaatcatttgtagctaagttttttttttttttgtttttttttatgatttaagggtaaaccaattttttatgttgcagcttgctccctttttaactcagcatgctcatggtgcaggaccccattgtgtgtacttatattattcactttttattgtttctacaaaccctgtttatttttaaacttttgaaagttttgaaagaaagctattgtaaaacagatttccc

SEQ ID NO: 1471 - DNA, 1041 bp, Cucurbita pepo
tagaaagtggggcgaaatgagcatcacttaagcaagcaagacagccattcgccacattcttctttcgcattcttcacccgctaaccggacgattgggcattgcgagttttagcatcatctcccgattgtctcttgaagatccagttttgcagttatggatgggcatgactctgaagatccgaagcaaagcacggctgatatgacggtttttgtgcaaaatcttcttcaacaaatgcaatctaggttccaaaccatgtctgactccattatcacaaagatcgatgagatggggagccgcataaatgaattggagcagagcatcaacgatctaaaatctgagatgggtgttgagggctcaccgtcgccgatgactccttcaaagtcgagtgcagatgaagtgaagaaagatgaaggttctgccttgaaatagttgagagtgtatgctttattgttgagtttgataacttgcaatattctctttttgctattgcctttgtgaaattgaagccaatgcttaggatgaaacagaaaagtgcaatatgttctagacttgtacttgctatttctgcatgatttcttattgataatatagtgatgattatactctatgatgacctcatacaacaactactgctcatctctggtaacaaagtaaacacacaactcgttagcttcggcaacgagcaatagcactgcagccacggtcgtaggggttagcctcagcacctggctggcaattgtagtaagatgctcctctgcgtgagcatggcaccttgttggccctgagcgcatcgtagcttatgtagtttacatcggccaatatgcgtctattgatttcggagtccatctgaaattcaatgtcatccatcatgcagtctgccatggagccatgacaggtagctagagctcgatcgaggacccaactcgggccttttgtggtggtggccaatactgcagtggagaagacgatcaggaatgcagcgatgaagcaaaatggaaggagaacagaaagcttggccaccattcttgctttatctgcta

SEQ ID NO: 1472 - DNA, 692 bp, Quercus alba
atggggatttttctttcattcttctctcgcactcccactcccactcccactcccacaacgcgaaccattgtagctgctgtacggatcacgcacccacacggcttcacctccgaacgaaaaaaaagaaaaaatggatggacatgatggggaagatcctaagcaaagcactgctgatatgactgtttttgtgcaaaatcttctgcagcagatgcaaacaaggttccaacaaatgtccgactcgattgttacaaagattgatgagatgggaggccgcataaatgaattggagcaaagcatcaatgatctacgagcagagatgggcgtggagagctctccatctccagttcccccaaccaagccacagttagatgatgtgaagaaagaggaaggttctgcatagtgttgatgctgtgcatgttttacatggagtgatgagtttggtttgatgcccactttctttgtctgcgattagtctggagaatgaaaacactgctgttatggaatattatttagtgccttatatgtttttgtagttaaatgctgtttttctttcagaaatacagtgctgggagtagttattttctcccccattgaaatgtgttggtcgtttgacaataatggggaagttatgaatatgaatatctgtttcaattattattatatttttatcgatcatgcagtgcaagtggccc

SEQ ID NO: 1473 - DNA, 598 bp, Trigonella foenum-graecum
aaccttggtgtggagctgaaccaccgtcatcatcatcatcaacatctcatggatagccacgattcaaacgacgcgaagcaaagccctgctgatatgacagctttcgtgcaaaatcttcttcagcagatgcaaagtaggttccagaccatgtctgactccattgttacaaagattgatgatatgggaaatcgtataaatgagttggagcagagcatcaatgacctgagagctgagatgggagtggagagctctccatcaccagcagccccagagaagccaaaggatgaagagttgaaaaaagaagagggttcagattaaagcgacattttaatttcaatttctcattgttcttgtcttgcaatgcacgatgattggtatggtgcatcaactatctttgtctaagtagtggttcagaaaattaatgtgttgtgtggctgagtacagccgataatttgtagctaaatccttacagtttttatgatttagcaatacttctacagttttatattacagccagattgttgctctcataccctctattccccctgcatgctatttgttgatgaatggagtctatgatcccaaatcatgtggctgc

SEQ ID NO: 1474 - DNA, 2130 bp, Glycine max
atctctcattctctctgttttctccaaagcaaaaccttccctacacactttcaatggccgccaaaacggtaacccctgacgccgtttcgatgctcctggcaaacacttgccccgattcctcatcggatctccccgaaatcgttgttcaagttctcgatctcaaggcgacaggcaataaatacatgtttactgctaatgatggaaaaacgaaactgaaagctatgatttcttcggatatgtgctctcaggtgctctccggggctattcaaaacctaggtcttattcgcgtccttgattacactgtcaacgtaatacccaataaatcggacaaatacctcattgtcactaaatgtgaacctgtatctcctgcgcttgaaattgagataaagagtgaggaatctggatctgggattcttttgaagtccaaggtagagggtggagtcaatactgaaggtcctgctgctgctgggattcttctcaagcccaaacaagtagtgacaaaatctgccaatcagattctacgcgaacatggaaattcggctcctgctgcacgaatggcaatgacgcgtagagtgcgtcctcttgtttccttaaacccttatcagggtaattggacaataaaggttagcgttacgagcaaagggaacatgcgtaactataaaaatgctaggggtgatggttgtgtcttcaatgtcgaattgacggatgaagatggtactcagattcaggcaaccatgtttaataatgctgcgaggaaattttatgacaaatttattctgggaagggtttactacatttcaaaggggactttgaaagttgctaacaagcagttcaaaaccgtgcaaaatgattatgaaatgacgcttaatgagaattctgaggtggaagaggtagccggtgaagcaagttttgttcccgaaacgaagttcaactttgtgcagattgatcagctgggtcctcatgtaaataagtccgagcttgtcgatgtcattgggattgttaagaatgtgtcttcaacaatgaccattcgtaggaagagcgacaatgagagtattccaaagcgtgacattactattgctgatgacaccaagaagacagtagttgtgtccttgtggaatgaacttgcaactaccacaggacaagagttactggacattgttgataaatctccagttgttgcaatcaaatctctcaaggttggggacttccaaggtgtttctttgtcaactataggcaaaagtgtggttctggtaaatccagtcatacccgaagcaaaaaatctcagaagctggtatgattttgaaggcaaggatgctgcaatggactctgtaggctctggttcaagtccaacatctaacaatgggattagatcagtgtacactgatcgtgttttactttctgacataacctcaaacccatcattgggggatggcaagcccgcatttttcagtcttagaggacatataagcttcataaagcctgatcaggcaatgtggtatcgtgcctgtaagacatgcaataagaaagttactgaaagcgttggttctggatatttgtgcgatggatgccagaaaagcgatgagcagtgcagtttaaggtatattatggttgccaaggtttctgatgcaagcgctgagacttatatctctgcctttaatcaggaagctgagaagatcattggatgctctgctgatgatctagataaccttaaatcacaagagggagaagttaatccttatcagatgacattgaaggaagctacttgggctcaacatctttttcgggtaagtgttactccgaacgagtataatggcgagaagagacaaaggataacagttcgggcagttgttcctgttgacttcgctgctgagtcaaggtttctgctggaagatttatcaaagatgagagcataagatggatatgcggattcacagtttctacatttttttgctaacggttgtttagtatgttaccggttgtaattattaattaattccctaggtggcttatattatacattttgccgagttttatagaatatctttgccatccacatggttactgattttccattatgtcatcagtgattcctcaaaaagctttgcctcaatgaaagtgatttttctttca

SEQ ID NO: 1475 - DNA, 2167 bp, Phaseolus coccineus
actcttattcttctctcttcattcctttctcttctccaaaacttccctccaatggctgcaaaatcaatcacacccgacgccgtttcgacgctcctcgctaacccttcccccgattcttcgtcggatctttccgacatcgttgttcaagtagttgatctcaagcctagcggcaatagatacatgttctctgccagtgatggaaaaaagaaactgagggcgattcttccttcgaatatgtattctgaggttctttccgggaacattcaaaacctaggtcttgttcgcattcttgattacactctcaacgacatccctaacaaatctgaaaagtaccttattgtcacgaaatgtgagccggtatctcccgctcttgaaaaggagatcaagagcgatgagcctgcgattcttttgaaacccaaggaagaggttggtgcgaagagtgaaggtgctgctgggattcttttgaagcaaaagcaggaagtggtgacaaaatctgctgctcagattctaaatgaacaacatagaaattcggctcctgctgcacgcttggcaatgacacgtagggtacgtcctcttgtttcgttgaacccttatcagggtaattggacgataaaggttagcgttacaagcaaagggaacatgcgtacctataagaatgctaggggtgaaggttgtgtattcaatgttgaattgactgacgaagaaggtactcaaatccaggcaaccatgtttaacgatgccgcgaggaaattttatgacagatttgttctgggaaaggtttactatatttcgaaggggactttgaaagttgctaacaaacagttcaagactgtgcaaaatgactatgaaatgacgctcaatgagaattctgaggtggaagaggtggcggacgaagcaagttttgtcccagaaacaaaatttagctttgtccagattgatcagttaggtccttatgtcaacaagtctgaacttgtggatgtcattggagttgttaagagtgtgtcttcaacaatgagcattcgtaggaagagtgacaacgagagcattccaaagcgcgacattactattgctgatgaaacgaagaagacagtggttgtgtcgttgtggaatgatcttgctactaacacgggacaagagttactggacattgttgataaatctccagttgttgcaatcaagtctctcagggttggggacttccaaggtgtttctttgtcaactataagcagaagtgtagttctggtaaatccagacgtacctgaagctaagaaactcagaagctggtatgaatttgaaggaaaagatgctgcaatggacgctctaggttctggttcaagtccgacatctaataatggaattagatcagtgtactctgatcgtgttgctctttctcacataacctcaaaccaatcattgggggatatgaagcctgcatttttcagccttaaaggatatataagcttcataaagcctgaccaggcaatgtggtatcgtgcctgtaagacatgcaataagaaagttactgaaagcattggttctggatattggtgcgaaggatgccagaaaagcgatgaacagtgcagtttaaggtatattatggttgctagagtttgcgatacaagtggtgaggctttcatctcggtttttaatgatgaagctgagaagattgttggatgctctgctgatgacttagatgaccttaaatcacaagaaggagaagataatccttataatctgaaattgaagcaagcaacttgggttccacatcttttccgcgtgagtgttagccagaacgagtataataacgaaaagcggcaaaggattacagctcgggcagttgttcctgttgacttcgccgcagagtcaaggattatgctggaagaaatatcaaagatgagagcataagagatggatatgcagatttatagtttctatatctttttgagtgatggtactggttgtaattattaattccctatgtggtttatcatacattttcagacttatggaaatatgcgctaaatttttgtcatccacatgttcataattttccatcatgacattagtgattcctcaaatattcttccccaattaggtagaaaagtttgcactctatgttttgattagatttttcattcagtgtcataatacagtatattttactaat

SEQ ID NO: 1476 - DNA, 2138 bp, Cajanus cajan
acacactttcttccaatggccgccaaatcagtcactcacgacgccgtttccacgctcatcgcaaacccttcccccaattcttcatccgttttccccgagatcgtcgttcaagtcctcgatctcaagcccagcggcaacagatacatgtttaatgctagtgatggaaaaatgaagctcagggcgattcttccctcgaatgtttcctccgaggtgcactccgggaatattcaaaacctagggcttattcgtattcttgattacactgtcaacgatatccccaataaatcagagaaataccttattgtcacgagctgtgaaacggtatctcccgcgcttgaaatggagataaaaagtgagggatccgaggaaggtgtagtgaagagtgaaggtgctgctgggattcttctgaagccgaagcaggaagtggtgacgaaatctgctgttcagattctacacgagcaacgtggaaattcggctcctacggcaaggatggccatgacgcgtagggtgcgtcctcttgtttcgttgaacccttatcagggcaattggacaataaaggttagcgttacgagcaaagggaacatgcgtacctataggaatgctagaggggaaggttgtgtcttcaatgtcgaattgacggacgaggatggtacacagattcaggcaactatgtttaatgatgctgcgaggaagttttatgacaaatttgttctgggaaaggtttactacatttcaaaggggactttgaaagttgctaacaaacagttcaaaactgtgcaaaacgagtatgaaatgactctaaatgagaattctgaggtggaagaggtagctggcgaagcgagttttgttccagaaacgaaattcaactttgtccagattgatcagctgggtccttttgtcaacaagttagaactcgtggatgttgttggagttgttaagaatgtgtcttcaacaatgagtattcgtaggaagagtgacaatgagagtattccaaagcgtgacattactattgctgatgaaacgaagaagacagtagttgtgtccttgtggaatgatcttgcaactaagataggacaagagttgctagacattgctgacaattctccaattgttgcaatcaaatctctaagggttggggacttccaaggggtttctttgtcgactataagcagaagtgtggttctaataaatccggacatacctgaagcaaggaagctcagatcctggtatgaccttgagggtaaggatgctgcaatggactctgttggctctggttcaagtccaacgtctaacaatggatctagatcagtgtactctgatcgtgtttctctttctcacataacttctgacccatcattgggggatgtcaagcctgcatttttcagtattagaggatatataagcttcataaagcctgatcaggcgatgtggtatcgtgcctgtaagacgtgcaacaagaaagttactgaaagcattggttccggatattggtgcgaagggtgccagaaaaacgatgaacagtgcagtttaaggtatataatggttgccaaagtttcggatgcaagtggtgaagcttttgtctccgtctttaatgaggaagctgagaagatcgttggatgctctgctgaggagctagatgaccttagatcacaagaaggagaagataatccttatcagctgaaactgaagcaagctacttgggttccacatcttttccgtgttagtgttactcagaacgagtataataacgaaaagcgacaaaggataacagctcgggcagttgttcctgttgacttcgctgctgaggcaaggattatgctggaagaaatatcgaagatgagagtataagatagatacgctgatttgcagtttcgaaatcttttggttaaatatttgagttatgttactggttgtaattattaattccctaggtggtttataatatactttttgctgaattagagaaatatgctccagaatttcctagtgattcacatgttggtgaattttcatttgccattcttgattccttaaattctttaatattgaagagttgtgatgaatgaatcgcgttcttcctatgtttgggttaagtgtttctttcaagatcataatataatagttgaaatttgttaata

SEQ ID NO: 1477 - DNA, 2135 bp, Glycine max
gaggagtgcaacagagaagaatcacattcgcattctcaatcacatccattcattcactcatccatatcccttctttccactaacttctctctctagttgatacaaataaaaaacaaagtttcatactttacgacacccttttctgcaactgatgatggaaggaagctgaaacagtgaaaaacagcaacaacgaccaccctgtctttgttttttgtttgttgagttgaaactttagagaaagtgaatagtgatatggaggcaaagggtgtgcggttcttagcgtatcaatcaatattttcgagcgttggatctggggacttcgatggggtgaagaaactggtggaggaagtgaagaaggaagaagggtcatcgctctctgatgtgatgtctcttcagaacgatgctggagagactgcgctatacatcgctgcagagaataatctgcaagagatgttcagcttcttgctcagcatctgtcactttgaggtcgtcaagattcgctccaaggctgatatgaacgcctttcatgttgctgccaagcgtggcaatctagatattgtgagggagcttttgaatatttggcctgaggtctgcaagttatgtgactcctcaaacaccagtcctctatattctgctgcagttcaagatcacttggatgtggtggatgctatcttggatgtcgatgtcagttccatgttcatagttaggaaaaacggcaaaacttcactgcacaatgctgctaggtatggtgtccatcgtattgtaaaaacacttattgctcgggatccaggaatagtatgcatcaaagataaaaaaggtcaaactgcactgcatatggcggttaaaggacagtgtacttcagttgtggaggagatattactagctgatccttctattttgaatgagcgagataagaagggtaatacagctcttcacatggctacaaggaaatgccgttcacagatagtgggccttttgctaagctattctgctgtggatgttaatgccatcaacaagcagcaggaaacagccttggatttggcagataaactgccatatggagattcagctttggaaataaaggaagcccttgcagaatatggtgctaagcatgccaggtatgttggcaaagaagatgacgcaatggaacttaaaagaactgttagtgatataaagcatgaggtgcagtcacaacttatacaaaatgaaacgacacgacgacgggtttctggtattgccaaggagttgaagaaacttcatagagaagcagttcaaaacaccattaattctgtcacattggttgctgtactttttgcctcaatagcattcttagccatcttcaatttgccgggtcaatatataacggacgaaggaaaagagattgggaaagctaaaatagccgatcatgttagtttccaagtcttctgccttctgaattctacatctcttttcatttctcttgccgttgttgtagttcaaattactttggtagcctgggacacaagggctcaaaagcagattgtgtcggtggttaacaagttgatgtgggctgcatgtgcttgcacttgtggtgcttttctagcaatagcttttgaggttgttggaaagaaaacatggatggctatcaccatcacccttttgggggtacctgttctagttggcactctagcaagcatgtgctactttgtttttcgacaacatttcggcattttccgcagtgattcccagagacgcatcaagagagcaagtggaagcaaatctttctcatggtcttactctgcaaatatatcagatttggatgaatacaattctgacattgagaagatctatgccctgtgagtcaagaatcaagagaaatgtttcaaccttttaactgaaactgttatactactgccaagtgataatgttagctcaccgggatttcatcattcatcttgagtttgcagtttttggtttcaggctgtatgtgattataattaataatcaaaacttgtagatttatgtatatgtaataaaaataatatgaaagggaagtccactacttaagtttgatattggaatgagcattttcattacaatacgaaattaaattttcatctgcaccgtgcaagaaaatagagcttcctatcttaaaa

SEQ ID NO: 1478 - DNA, 2133 bp, Phaseolus coccineus
ccatccattcattcttccatccatatcccttccactaccttctctctctccatctctatcttcatcacacaaaaaaactattcaagttttgtcatttcagctcttctgcaactgggtttcctacatggaaggtagctgaaacagtgaaataacaagaaccctgtttttgttttttgttcgttgaattgagtgagtgagagaaagtgcatgatggagtcaaagggtgtgcggttcttagcgtaccaatcaatattttcgagtgttggatctggggactttgatggggtgaagaaactggtggagaaagtgaagaacgaagaagagtcatcgctctctgatgtgatgtctcttcagaacgatgctggagagactgcactttacatcgctgcagagcataatctgcaagagattttcagctacttgctcaacttgtgtgacttcgaagccctcaagattcgctccaagtctgatatgaacgcctttcatgttgctgccaaacgtggccatctagatattgtgaaggagcttctgaatgtttggcctgagctctgcaagttatgcgactcctcaaacaccagtcctctatattctgctgcagttcaagaccacttggatgtggtgaatgctatcttggatgttgatgtcagttcaatgtttattgttaggaaaaacggaaaaacttcactgcacaatgctgctaggtatggtctggttcgcattgtaaaagcagttattggtagggatccaggaatagtatgcataaaagatagaaaaggtcaaactgcacttcatatggctgtcaaaggacagtgtaccctagtagtggaggagatattactagctgattcttctatattgaatgagagagataaaaagggtaatacagctcttcacatggctacaaggaaatgccgttcacagatagtgatccttttgctaagctactctgcaatggatgttaatgccatcaacaagcagcaagaaacagccttggacttggcagataaactgccttatggagattcagctttggaaatccaggaagcccttgcagaatacggagctaagcatgcaagacatgttggcaaagtagacgaagcaatggagcttaaaagaacagtgagtgacataaagcatgaggtgcagtcacaactcatacaaaatgaaacaactcgtcgaagggtttctggaattgccaaggaactgaagaaacttcatagagaagcagttcaaaacaccattaattcagtcacagtggttgctgttctttttgcctcaatagccttcttggccatcttcaatttgccgggtcaatatcaagtgaaacctggagaagagattggaaaagctaatatagcagatcatcttagtttccaagttttctgctttctgaattccacatcccttttcatttctcttgcagttgtggtagttcaaataactttggtagcctgggacacaagggctcaaaagcagattgtgtcagtggttaacaagctgatgtgggctgcatgtgcttgcacttgtggtgcttttctagcaatagcttttgaggttgttggagggaaaacatggatggctatcaccataacccttttgggagtacctattctagtagggactctgttaagcatgtgctactttgtttttcgccaacattttggtattttccgcagtgattcccagagacgcatcaagagagcaagtggaagcaaatctttttcatggtcttactctgcaaatatatcagacttggatgatgaatacgattctgacattgagaagatctatgccctgtgagaccaagaataatagttaccttaccacacaacataagagcaatgtttcaaccttttaactgaaactgaccatgtttgctcaccggggattacatcattcttctggagtttgcagtttttcgtttcaggctgtgctgctaggcatatcaattgggtttgcacttgctagtatgttattataatcaataatcaacacttgtagatttatgtatatgtaataaaaaaatccgttgtcttatatggtgtaaatttttgcctgttgtaataaacactcatacgacatacgacatgtacgatggatacagagataatctcttaatgtaaaaaaaaagaa

SEQ ID NO: 1479 - DNA, 2105 bp, Cajanus cajan
tccatccattcataattcatccacatcccttccactaccatctctctatctcttccttcatacacaccaaaataataaagtttcacactttcaccgtttccacaactgggtttctgatatggaagggacctgaactcaaaacaaaacaaaaaaaccgttttggtaaatttgttgttgaattcagaattgtgagagagcgaaagtgaatgatggagtcgaagggtctgcggttcatagcgtaccaatcaatattctcgagagttggatctggggactttgatggtgttaagagagtggtggagcaagtgaagaaggaagatgcttcattgctctctgatgtcatgtctcttcagaacgatgctggagaaaccgcgctttacatcgctgcagagaataatctgttagagattttcaggttcttgctcagcttgtgtgactttgacgtcgtcaagattcgctccaagtctgacatgaacgcttttcatgttgctgccaaacgtggccatcgagatattgtgagggagcttttgaatacttggcctgaggtctgtaaattatgcgactcgtcaaacaccagtcctctgtattctgctgcagttcaagaccacttggatgtggtgaatgctatcttggatgtcgatgtcagtaccatgttcatagtcaggaaaaatggcaaaacttcattgcacaatgctgctagatatggcgttgttcaaattgtaaaaacgcttattgctcgggatccaggaatagtatgcatcaaagataaaaaaggtcaaactgcactgcatatggctgtcaaaggacagtgtactgcagtggtggaggagatattactagctgatccttctatattgaatgagcgagataagaagggtaatacagctcttcatatggctacaaggaaaggccgttcacagatagtgaaccttttgctgagctattcggctgtggatgttaatgccatcaataagcagcaggaaacggccttggatttggctgataaactgccatatggagattcagctttggaaatcaaggaagcccttgcagaatatggtgctaagtatgccaggtatgttggtaaagtagatgaagcaatggaacttaaaagaactgtgagtgatataaagcatgaggtgcagtcacagcttatacagaatgagaagactcgccgacgcgtatctggtattgccaaggagttgaagaaacttcatagagaagcggttcaaaacaccattaattctgtgacagtggttgctgtcctttttgcctcaatagcattcttggccatcttcaatttgccgggtcaatatataacggaaggaccagaggctggagaagctaatatagcctctcatcatcatgttggtttccaagttttctgctttctgaattctacatctcttttcatttctctttcagttgttgtagtacaaatcactttggtagcctgggacacaagggctcaaaagcagcttgtgtctgtggttaacaagttgatgtgggctgcatgtgcatgcacatgtggtgcttttctagcaatagcttttgaggttgttggaaagaaaaaatggatggctatcaccatcacccttctgggagcaccaattcttgttggcactctagcaagcatgtgctactttgtttttcgacaacatttcggtattttccgcagcgattcccagagacgcatcaagagagcaagtggaagcaaatctttctcatggtcttactcagcaaatatatcagatttggatgaatataattctgacattgagaagatatatgccttgtgagtcaaggatcacgttatcacataaaagaagagcaatgtttcaaccttttaactgaaactgttataccactgctaagtgatcatgtttgctcgctgggatttcattattcatctcaagtttgcagtttttggtttcaggctgtactactaggcaaatcagttgggtttgcatatgctaatgcgattattattaataataatcaacacttgtagatttatgtacatgtaataaaaaaatatgaaaaggaggtccactactcaagtttgatattggaacgagcattttcattataatacaaaaatgaac

SEQ ID NO: 1480 - DNA, 1918 bp, Cajanus cajan
gggtgagagagcgaaagtgaatgatggagtcgaagggtctgcggttcatagcgtaccaatcaatattctcgagagttggatctggggactttgatggtgttaagagagtggtggagcaagtgaagaaggaagatgcttcattgctctctgatgtcatgtctcttcagaacgatgctggagaaaccgcgctttacatcgctgcagagaataatctgttagagattttcaggttcttgctcagcttgtgtgactttgacgtcgtcaagattcgctccaagtctgacatgaacgcttttcatgttgctgccaaacgtggccatcgagatattgtgagggagcttttgaatacttggcctgaggtctgtaaattatgcgactcgtcaaacaccagtcctctgtattctgctgcagttcaagaccacttggatgtggtgaatgctatcttggatgtcgatgtcagtaccatgttcatagtcaggaaaaatggcaaaacttcattgcacaatgctgctagatatggcgttgttcaaattgtaaaaacgcttattgctcgggatccaggaatagtatgcatcaaagataaaaaaaggcaaaactgcactgcatatggctgtcaaaggacagtgtactgcagtggtggaggagatattactagctgatccttctatattgaatgagcgagataagaagggtaatacagctcttcatatggctacaaggaaaggccgttcacagatagtgaaccttttgctgagctattcggctgtggatgttaatgccatcaataagcagcaggaaacggccttggatttggctgataaactgccatatggagattcagctttggaaatcaaggaagcccttgcagaatatggtgctaagtatgccaggtatgttggtaaagtagatgaagcaatggaacttaaaagaactgtgagtgatataaagcatgaggtgcagtcacagcttatacagaatgagaagactcgccgacgcgtatctggtattgccaaggagttgaagaaacttcatagagaagcggttcaaaacaccattaattctgtgacagtggttgctgtcctttttgcctcaatagcattcttggccatcttcaatttgccgggtcaatatataacggaaggaccagaggctggagaagctaatatagcctctcatcatcatgttggtttccaagttttctgctttctgaattctacatctcttttcatttctctttcagttgttgtagtacaaatcactttggtagcctgggacacaagggctcaaaagcagcttgtgtctgtggttaacaagttgatgtgggctgcatgtgcatgcacatgtggtgcttttctagcaatagcttttgaggttgttggaaagaaaaaatggatggctatcaccatcacccttctgggagcaccaattcttgttggcactctagcaagcatgtgctactttgtttttcgacaacatttcggtattttccgcagcgattcccagagacgcatcaagagagcaagtggaagcaaatctttctcatggtcttactcagcaaatatatcagatttggatgaatataattctgacattgagaagatatatgccttgtgagtcaaggatcacgttatcacataaaagaagagcaatgtttcaaccttttaactgaaactgttataccactgctaagtgatcatgtttgctcgctgggatttcattattcatctcaagtttgcagtttttggtttcaggctgtactactaggcaaatcagttgggtttgcatatgctaatgcgattattattaataataatcaacacttgtagatttatgtacatgtaataaaaaatatgaaaaggaggtccactactcaagtttgatattggaacgagcattttcattataatacaaaaatgaa

SEQ ID NO: 1481 - DNA, 1911 bp, Lotus japonicus
tgatggagtcgaaggctctacgtttcataacccaccaatcaattttctccatagttggatctggggactttgatgggttgaagaaagtggtggagcagctgaaaaacgacgatggtggtggtgatgggtcatcatcatcatcatcatcatcgtcgctttctgaagtgatgtcccttcagaacgatgctggagagaccgcactttacatcgctgcagagcgtaatctgaaggaggtgttcagcttcttgctcaagttgtgtgactatgaggttgttaagattcggtccaggtctgatatgaacgcgtttcatgttgcagccaagcgtggccatctggatatcgtgagggagcttttgagtacttggcctgaggtttgtaagctatgtgattccacgaacacaagccctctatatgctgctgcaggtcaagaccacttggatgtggtgaatgctattttggatgttgatgtcagttccatgtttatagttaggaaaaatggcaaaacttcattacacaatgctgctaggtatgatgtccttcgtatagtgaaagcacttattgcccgggatcctggaatagtttgcatcaaagataaaaagggtcaaactgcactgcacatggctgtcaaaggacagagtacattagtggtggaggagattttactagctgatcctactatattgaatgaacgagataagaagggtaatacagctcttcacatggcgacaaggaaaggccgttcacagatagtgaaccttttgctaatctatacagctacggacattaatgccatcaataagcaacaagaaacagccttggatttggcagataaacttccatatggagattcagctttagaaatcaaggaagccctttcagaatatggtgctaagtatgccaggcatgttggcaaagtagatgaagccatggaacttaaaagaacagtgagtgatataaagcatgaggtgcagtcacagcttatacaaaatgaaaaaactcgcaaacgagtctccggcatcgctaaagaactgaagaaacttcacagagaagcagttcaaaacaccattaattccgtcacagttgttgctgtcctttttgcctctatagcattcttggctatattcaatttgcctggtcaatatataatgacaggatcagagacagggaaggcgaatatagcggatcatgttggattccaagttttttgcttcttgaattcaacatccctcttcatttctcttgcagttgttgtggttcagatcactttggtagcatgggacactagagcccaaaagcagattgtgtcagtggttaacaagctcatgtgggctgcatgtgcttgcacttgtggtgcttttcttgcagtagcttttgaagttgttggaaagaaaacatggatggctattaccatcaccattttgggagtgccaattcttttggggactctagcaatcttgtgctactttgtgtttcgccaacattttgggatttttcgcagcgattcgcagaggcggatcaagagagcaagtggaagcaaatctttctcatggtcttactctgcacatatctcagatttggatgatgaatataattctgacattgagaagatctatgctctatgaggtataaaccaagaatcaaatgttacccaaagaacactgtttcaactttttgactgaggctggtatcccactgctgaggtttcaagtgactattcagatgtttgcccactgggatatagatcattcatcttgagtttgtagtttaaagtttcagttagagtttgcatttgctaatgtctgagattatgattactaatcagcacttgtagatgtatgtatatgtgaaaaaaataaaaatagaaatgagttccactgctaaagttgactaaggaacaagcattcttaacac

SEQ ID NO: 1482 - DNA, 2116 bp, Cicer arietinum
ttttgtgatggagtcgaagactctgcgtttcatgacccatcaatcaattttttccatggttggatctggagaccttgatgggttaaagaagttggtggaagagctgaagaaggaggataatgataatgggtcgtcatcatcatcatcatcgatgttggtttctgatttgatgtgtcttcagaatgagcatggagaaacaacactttacatagctgcagagcgtaatttgaaacaagtttttagctttttgcttcaattgtgtgattttgaggttctaaagattcggtccaagtctgatatgaacgcctttcatgttgctgctaagcgtggcaatttggatattgtgagggagattttgagtgtctggcctgaggtttgtaagttatgcgactcctcaaacaccagccccctatattctgctgcagttcaagaccacctggatgtggtgagtgctattttggatattgatgtcagctccatgtttatagtcaggaaaaacggaaaaacagcgctacacaatgctgttaggtacggcgtccttcgaattgtgaaagcccttatttcccgggatccaggaattgtctgcatcaaagataaaaaaggtcaaactgcattgcatatggctgtcaaaggacagtgtacatcagtggtggaggagatattacaggctgatcctactatattgaacgaacgagataagaagggtaacacagctcttcacatggctacgaggaaaagccgttcgcagatagtgatccttttgctaagctatgcatctttggatgttaatgccatcaataagcagcaagaaacagccttggatttagcagataaacttccatatggaacttcagctttagaaatccaagaagccctcgcagaatacggtgccaaatatgcaagacatgttggtaaagtggatgaagctatggaacttaaaagaacagtaagtgacataaagcatgaggttcagtcacaactcatacaaaacgaaaaaactcggcgacgagtttctggcatagctaaggaattgaagaaacttcatagagaagccgttcaaaacaccattaactctgtcacagtggtcgcagtccttttcgcctcaatagcattcttggctatattcaatttgcccggtcaatatataactaaaggatcagagacaggaaaatctaacatagctgatcatgtaggattccaagttttttgtctcttgaattctacctctcttttcatttctcttgcagttgttgttgttcaaatcactttggtagcttgggacacaagagctcaaaagcagattgtatcggtcgttaacaagctgatgtgggctgcttgtgcttgcacgtgtggcgcttttcttgcgatagcttttgaggttgttggaaagaaaaatggatggcaatcaccataactgttgtagggacaccaattttagttgggactctagcaagcatgtgttactttgtttttcgacaacattttgggactttccgcagcgattctcagagacgaatcaagagagcaagtggaagtaaatctttctcatggtcttactctgcaaatatatcggatttggatgatgaatacaattcagacattgagaagatctatgctttgtaagatagtgattgtgcgttaccgcacaatacaacattggatggtggatgtgtatagtatggtccgaaataagttccgatccattgtgggcaacttcttacaagcattgatatattataaaattatagtgattatgattttataatatatcattggttgttaaaagtcggcccattatggatcaaaacgcatttggagtgtactaaagtttcttcacaacacaaacaatatttcgagtttccaccttttaaccgaaaccagaggagtttccttagtgataaggtttgcttactaggattcatctctctagtttatctgctagaagttttaggctgtacttggcaatgtctgtgattataattaataatcagcacttgtagatttatatgtatatgtcatgaagggaaaaggcatttatgtaatttatttttagtatcatgcacaagagaactgtgcttcctccctagccctgttgtgatcgaaaatgagagggtga

SEQ ID NO: 1483 - DNA, 2345 bp, Medicago truncatula
ttccattctctctctattttccttcttcttcttcttcttcattgctactctttttatctatgatgattatgatgatagtgaaattctttgacttcaagtgaaacataaactcaaaaaactaataaaaatcatatttttactttttttttttttttttttttttttttttgtgatggagtcgaagggtctgcgtttcatgacccaccaatcaatattcaccacggttggatctggagaccttgatgggttgaagaaactgttagagaaacttaataaggaagaagatggtgatataagtaatgggtcatcatcatcatctatgtcggtttctgatgttatgtctcttcaaaatgatcatggtgaaacaccactttacatagctgcacacaataatctgaaggaagttttcacctttttgattaaattatgtgactttgaggttctcaagattcgttctaagtctgatatgaacgcttttcatgttgcagctaagcgtggccatcttgatattgtgagggagattttgagtgcctggcctgcggtctgtaagttgtgcgactcgacaaacaccagtcccctatatgctgctgctgttcaagatcacttggatgtggtaaatgctattttggatgttgatgtcagctccatgtttatagttagaaaaaatgggaaaactgcactacataatgctgttaggtatggcgtcgaccgtattgtgaaagcacttattgtccgtgatccaggaatagtttgcatcaaagataaaaaaggtcaaactgcgctacatatggctgtcaaaggacagagtacgtcagtggtggaggagatattacaagctgatcctactatattgaacgaacgagataagaagggtaataccgctcttcacatggctacgcggaaaggccggtcacagatagtgagctatttgctaagctatgcagctgtggatgttaatgccatcaataagcaacaagaaacagccttggatttggcagataaactgccatatggatcgtcagctttagaaatccaagaagcactttcagaatatggtgctaaatatgcaagacatgttggtaaagtagatgaagccatggaacttaaacgaacagtgagtgatataaagcatgaggtgcagtcacagctcatacaaaacgaaaaaactcgccgacgagtttccggtatagctaaggaattgaaaaaactccatagagaagccgttcaaaacaccattaactctgtcacagtggttgctgttctttttgcctcaatagcattcttggctatattcaatttgccgggtcaatatattatgaaaggatcacatataggagaatctaacattgcggatcatgttggattccaaattttctgtctcttgaattcgacgtctcttttcatttctcttgcagttgttgttgttcaaatcactttggtagcttgggacacaagggctcaaaagcagatcgtgtctgttgttaacaagctaatgtgggctgcttgtgcttgcacgtgcggtgcttttttggcgatagcttttgaggttgttggaaagaaaaaatggatggctattaccataactggtttagggataccaattctagttgggactctggcaagcatgtgctactttgtttttcgacaacattttggcattttccaaagtgattcccagagacgcatcaagagagcaagtggaagcaaatccttctcatggtcttactctgcaaatatatcagatatagacgaatacacttcagacattgagaagatctatgctttgtaagctggtgattgagtgctaccacgcaatataacactgaatatgtatagtataatccaaatcagttttaacaattatcgatactttataaagttataatcattttgatttggtaaaaatgctgatgaggatcaaaatatcaatgattatagttttataatatatcagtggttgttaaaagtcagtccattatcgacaagaactttcctgatagcaccatattgtatagatgtagaggatctaatttcctgtttccagcttttaactgaaacctgaggagttacggatggcacttcagtgcctttgatgtttccttacctggatttatctctctagttatcagcttgaagttttaggttgtgcctggcaacctctttaggtttgcattttctattgtctgtgattatataattaataatcagcacttgtagatgtatgtatatatgtgataaaaggaaaaggcatttatgtaaagtatttcaagcaacacgtacaagagaagtgcttcctccctaagcctgctatgatagaaaattagaggatgaaaagttgaaaggag

SEQ ID NO: 1484 - DNA, 2177 bp, Medicago truncatula
tgtgatggagtcgaagggtctgcgtttcatgacccaccaatcaatattcaccacggttggatctggagaccttgatgggttgaagaaactgttagagaaacttaataaggaagaagatggtgatataagtaatgggtcatcatcatcatctatgtcggtttctgatgttatgtctcttcaaaatgatcatggtgaaacaccactttacatagctgcacacaataatctgaaggaagttttcacctttttgattaaattatgtgactttgaggttctcaagattcgttctaagtctgatatgaacgcttttcatgttgcagctaagcgtggccatcttgatattgtgagggagattttgagtgcctggcctgcggtctgtaagttgtgcgactcgacaaacaccagtcccctatatgctgctgctgttcaagatcacttggatgtggtaaatgctattttggatgttgatgtcagctccatgtttatagttagaaaaaatgggaaaactgcactacataatgctgttaggtatggcgtcgaccgtattgtgaaagcacttattgtccgtgatccaggaatagtttgcatcaaagataaaaaaggtcaaactgcgctacatatggctgtcaaaggacagagtacgtcagtggtggaggagatattacaagctgatcctactatattgaacgaacgagataagaagggtaataccgctcttcacatggctacgcggaaaggccggtcacagatagtgagctatttgctaagctatgcagctgtggatgttaatgccatcaataagcaacaagaaacagccttggatttggcagataaactgccatatggatcgtcagctttagaaatccaagaagcactttcagaatatggtgctaaatatgcaagacatgttggtaaagtagatgaagccatggaacttaaacgaacagtgagtgatataaagcatgaggtgcagtcacagctcatacaaaacgaaaaaactcgccgacgagtttccggtatagctaaggaattgaaaaaactccatagagaagccgttcaaaacaccattaactctgtcacagtggttgctgttctttttgcctcaatagcattcttggctatattcaatttgccgggtcaatatattatgaaaggatcacatataggagaatctaacattgcggatcatgttggattccaaattttctgtctcttgaattcgacgtctcttttcatttctcttgcagttgttgttgttcaaatcactttggtagcttgggacacaagggctcaaaagcagatcgtgtctgttgttaacaagctaatgtgggctgcttgtgcttgcacgtgcggtgcttttttggcgatagcttttgaggttgttggaaagaaaaaatggatggctattaccataactggtttagggataccaattctagttgggactctggcaagcatgtgctactttgtttttcgacaacattttggcattttccaaagtgattcccagagacgcatcaagagagcaagtggaagcaaatccttctcatggtcttactctgcaaatatatcagatatagacgaatacacttcagacattgagaagatctatgctttgtaagctggtgattgagtgctaccacgcaatataacactgaatatgtatagtataatccaaatcagttttaacaattatcgatactttataaagttataatcattttgatttggtaaaaatgctgatgaggatcaaaatatcaatgattatagttttataatatatcagtggttgttaaaagtcagtccattatcgacaagaactttcctgatagcaccatattgtatagatgtagaggatctaatttcctgtttccagcttttaactgaaacctgaggagttacggatggcacttcagtgcctttgatgtttccttacctggatttatctctctagttatcagcttgaagttttaggttgtgcctggcaacctctttaggtttgcattttctattgtctgtgattatataattaataatcagcacttgtagatgtatgtatatatgtgataaaaggaaaaggcatttatgtaaagtatttcaagcaacacgtacaagagaagtgcttcctccctaagcctgctatgatagaaaattagaggatgaaaagttgaaaggag

SEQ ID NO: 1485 - DNA, 1026 bp, Glycine max
attgaagaattccgcggaattcttgatttgcagcccaaaaagtaaaacggaagaagcttcgtcctttctgtccctgcccgcagataaaccaaattgcaagtcacacatacacgatatgataccccgtcctccctctcttcacttttgactattgacttcctcaaccgatccactcttctctctatctgcagatggcaagtgggtttggggaatcaacagggagatcacccccaagcccttcctacttcaacaacaataataacaatgatgctgccaattttgaatgcaacatttgctttgaattagcgcaagacccgataattactttgtgtggtcatcttttctgctggccctgtctttacaaatggcttcactttcactcacaatcacgagaatgcccggtgtgcaaggccctcgtggaggaggagaagctggttcccttgtatgggagaggaaagtcgtcgactgatccaagatcaaaatctattccgggcgataacatcccgcatcgtccggctggtcagaggcctgaaactgctcctccacctgaaacaaatcattttcatcaacatgggtttggatttatgggtggcttggggggatttgcgccaccgccgatggcaacaacaagatttgggaattttgcattgtccgcagcttttggtggttttataccatccttattcaactttcagttgcatgggtttcatgatgctgccatgtatgggggaggggctggttttcctcatggatttgccaatacatttcatggtgtccatgctcatggattccctctgcgcacccatcaagggcaacaagattattatttgaagaagcttcttctatttgttgttttgtgtgttgttcttgcttttatatggcaataggttggatacaatctctagcagtatctgacttctgctctgataggtcttctgatgtgctctttgttttgtaactaaggagtaaggatgttgttcatatgataatactgtcttattaatcttgtagttcttttctttgtga

SEQ ID NO: 1486 - DNA, 1276 bp, Cajanus cajan
ggttcctatcccttcctttctgcagaatcagataaaccaaattgcaagtcactcatgaatcatattaccctctctcttcactattgactattgacttctccaaccgatccattcttctctcaatttttcgctttccacagatggcaagtgggtttggggaatcagcaggcaggtcacccccaagcccttcctacttcagcaacaataataacaatgatgctgccaattttgaatgcaacatttgctttgaattagcgcaagaccccataattactttgtgtggtcatcttttctgctggccttgtctttacaaatggcttcaccttcactcgcagtcgcgagaatgccctgtgtgcaaggctcttgtggaggaggagaagctggttcccttgtatgggagaggaaagacttcgactgatccaagatcaaaatctattccaggtgttaatatcccgcaccgtccggctggtcagaggcctgaaactgctcctccacccgaaacaaatcattttcatcaacatggatttggatttatgggtggcttgggaggtggatttgcaccacccccggtggcaaccacaagatttgggaatttcgcattgtctgcggcttttggtggttttattccgtccttgttcaactttcagttgcatggttttcatgatggggccatgtatgggggagcagctggtttcccacatggattttctcattcatttcatggtgttcatgctcatggatatcccctgcgcacacatcaagggcaacaagattattatctgaagaggctgcttttatttattgttgtctgtgttcttcttgcttttgtttggcaatagattgggtacaatctaagacagctagcagaatcagacttcttctctgatagattttctggtgcgctctttattttttaactaaggagtaaggatatttgttcatataataatattgtcttattactcttataggcacttgatttgcacagtatccatgtgcgaaaattcatatatgaaggatgggaagcaccaaacccatagatataaatttaatggttgttatacagagtttgagactactatatagctgaactagtgaagttatgctcttgcatttttttttgtgttctcattttttaaagtacatgttgctaatgctatatctaaaattattttggcggatggtaatttcattattctctagctttcttgatttaagggttttacttggttgattattgttaacttcaactgtcttagttgtgggtttgcatgca

SEQ ID NO: 1487 - DNA, 1213 bp, Vigna unguiculata
gacttactcatttcatcgattcttctctcaatttttttccctttctccagatggcaagtgggtttggggaatcaactgggaggtcacccccaagcccttcgtacttcaacaacaataatagcaatgatgctggcaattttgagtgcaacatttgctttgaattggctcaagaccccattattactttgtgtggtcatcttttctgctggccttgtctttacaaatggcttcactttcactcacagtcacgagaatgcccggtttgcaaggccctcgtggaggaggagaagctggttcccctgtatgggagaggaaagacctccactgacccgagatccaagtctattccgggcatgaatatcccacatcgtccggccggtcagagacctgaaactgctcctccaccggaaacaaataatttccctcatcatgggtttggatttatgggtggcctgggaggatttgcgccaccgccaatggcatcaacaagatttgggaatttcggattgcctgcagcttttggtggctttataccgtcctttttcaactttcagttgcatgggtttcacgatggggccttgtatggaggagcgtctggttttcctcatgggttttctaatacatttcatggtatccatgctcatggatatcctcttcgcacacatcaaggtcaacaagattattatttgaagaagctgcttctagttgttgttttctgtgttcttcttgcttttatttggcaatagattggataccatctcaggttgctagcagaacaagacttctgctatgataggtcttctggtgcgctttgttttgtaactgaggagtaaggataatgttcatagaataatactgtcttattactcttgttgtcctgttctttctgtcacccaacttgcatggtatccatgttttaaagcagaacacccattcttagtaataaagataccagttgtatcacgcatagatattaatttcatggtcattaagtgtttgagactacaagacacatgaaatagtgagtttgtgctctttgttttcctgtgttctcgtttttttctagtacatgttgacaatactatctggtgttatatctaaaatatgttgatgcatagtactttttgtacttttaacattcttgatttaagggttatacttattattaatatcaaaagtcttagacgtgggtctgtgcaaaaaaagaaaaaaa

SEQ ID NO: 1488 - DNA, 1255 bp, Vigna unguiculata
atatgaatatgatactgtcccctttcttctcttttcaccattgacttactcatttcatcgattcttctctcaatttttttccctttctccagatggcaagtgggtttggggaatcaactgggaggtcacccccaagcccttcgtacttcaacaacaataatagcaatgatgctggcaattttgagtgcaacatttgctttgaattggctcaagaccccattattactttgtgtggtcatcttttctgctggccttgtctttacaaatggcttcactttcactcacagtcacgagaatgcccggtttgcaaggccctcgtggaggaggagaagctggttcccctgtatgggagaggaaagacctccactgacccgagatccaagtctattccgggcatgaatatcccacatcgtccggccggtcagagacctgaaactgctcctccaccggaaacaaataatttccctcatcatgggtttggatttatgggtggcctgggaggatttgcgccaccgccaatggcatcaacaagatttgggaatttcggattgcctgcagcttttggtggctttataccgtcctttttcaactttcagttgcatgggtttcacgatggggccttgtatggaggagcgtctggttttcctcatgggttttctaatacatttcatggtatccatgctcatggatatcctcttcgcacacatcaaggtcaacaagattattatttgaagaagctgcttctagttgttgttttctgtgttcttcttgcttttatttggcaatagattggataccatctcaggttgctagcagaacaagacttctgctatgataggtcttctggtgcgctttgttttgtaactgaggagtaaggataatgttcatagaataatactgtcttattactcttgttgtcctgttctttctgtcacccaacttgcatggtatccatgttttaaagcagaacacccattcttagtaataaagataccagttgtatcacgcatagatattaatttcatggtcattaagtgtttgagactacaagacacatgaaatagtgagtttgtgctctttgttttcctgtgttctcgtttttttctagtacatgttgacaatactatctggtgttatatctaaaatatgttgatgcatagtactttttgtacttttaacattcttgatttaagggttatacttattattaatatcaaaagtcttagacgtgggtctgtgcaaaaaaagaaaaaaa

SEQ ID NO: 1489 - DNA, 761 bp, Cajanus cajan
aaattgcaagtcactcatgaatcatattaccctctctcttcactattgactattgacttctccaaccgatccattcttctctcaatttttcgctttccacagatggcaagtgggtttggggaatcagcaggcaggtcacccccaagcccttcctacttcagcaacaataataacaatgatgctgccaattttgaatgcaacatttgctttgaattagcgcaagaccccataattactttgtgtggtcatcttttctgctggccttgtctttacaaatggcttcaccttcactcgcagtcgcgagaatgccctgtgtgcaaggctcttgtggaggaggagaagctggttcccttgtatgggagaggaaagacttcgactgatccaagatcaaaatctattccaggtgttaatatcccgcaccgtccggctggtcagaggcctgaaactgctcctccacccgaaacaaatcattttcatcaacatggatttggatttatgggtggcttgggaggtggatttgcaccacccccggtggcaaccacaagatttgggaatttcgcattgtctgcggcttttggtggttttattccgtccttgttcaactttcagttgcatggttttcatgatggggccatgtatgggggagcagctggtttcccacatggattttctcattcatttcatggtgttcatgctcatggatatcccctgcgcacacatcaagggcaacaagattattatctgaagaggctgcttttatt

SEQ ID NO: 1490 - DNA, 1371 bp, Phaseolus coccineus
atgatatgaatatgatactgccccctttcttctcttttcaccattgacttccgcatttcatccattcttctctcaattttccccctttctccagatggcaagtgggtttggggaatcaactgggaggtcacccccaagcccttcatacttcaacaacaataataatagcaatgatgctgggaattttgagtgcaacatttgctttgaattagcgcaagaccccataattactttgtgcggtcatcttttctgctggccttgtctttacaaatggcttcactttcactcacagtcacgagaatgcccggtttgcaaggccctcgtggaagaggacaagctggttcccttgtatgggagaggaaaaacctccactgatccaagatcaaagtctattccgggcatgaatatcccagatcgcccggccggtcagagacctgaaactgctcctccaccagaaacaaatagttttcacccacatgggtttggatttatgagtggctttgcaccaccgccaatggcaacaacaagatttgggaatttcggattgcccgcagcttttggtggttttataccgtcctttctcaactttcagttgcatgggtttcacgatggggccttgtatcggggagcctctggttttcctcatggattttctagtacatttcatggtgttcatgctcacggatatcctcttcgcactcatcaaagtcagcaagactattatttgaagaacctgcttctaggtgttgttttctgtgttcttcttgcttttatttggcaatagattggataccatctctggttgctggcagaacaagacttctgctatgataggtcttctggtgcgctttgttttgtaactgaggagtaaggataatgttcatagaataatactgtcttattactcttgtagtcccgttctctgtgacacccaacttgcgtggtatccatgtgttaaatctaaagcatgaaagcagaacaccaattcttaggaataaagataccagttgtatcatccatagatattaatttcatggtcagtatactgtgtttgagactacaagacagttgaaatagtgaagttctgccctttgttttcttgtgttctcattttttccggtacatgttgacagtactatctggtgttatgtctaaaatatgttgatggatagtactttttacttctaaatatttagggtttatactttcttatattaatttcaacagtcttagatgtggtttgtgcacattctgtgatgttttcattcagcttgtttttgtgctctattttgttgttgtatgaccaggaatggtttttacattacttggacaagtatatagaaatctaagtctttgattggattggtggaa

SEQ ID NO: 1491 - DNA, 1141 bp, Lotus japonicus
ctccttcgacgtgttgactaggaggatctatcgggttcctcagcgtttgttcctgcagatggcgagcgggtttggggaatcaacaagcaggtcacccccaagcccttcctacgccggcaacaataatagtgatgctggcaattttgaatgcaacatttgctttgacttagcccaagaccctattattaccttatgcggtcatcttttctgctggccttgcctttacaagtggcttcattttcactcacagtcacgagaatgcccggtgtgcaaggcactggttgaagaggagaagttggttcccttgtatgggagaggaaagacatcatctgacccgagatcaagatctattcccggtgttaatatcccgcaccgtcctgcaggtcagagacctgagactgctcctccgcctgaaccgaatccctttgctcatcatgggtttggattcacgggtggtttgggagggtttgcacctgcggcaacagcaagatttgggaatttcacactgtcagcagcatttggtggttttataccatccttgtttaactttcaattgcatgggtttcatggtgcgaccatgtatggtggagcgcctggtttcccatatgggttttctaattcatttcatggtggccatgttcatagatatcctttgcacacaggtcaagggcaacaagattattatctcaagaggctgctgttctttgttattttctgtgtggtccttgcttttatttggcaatagtttgaatagagttgagactgctaagtgaatcaaacttgagctcttatcaaccttcatgtgtgctttttaatttctattttttgtaactatggaagttgttcatatcatactctcttattactctagtagttctgttgtctgcagttagtttgtggatcttgatttgcatccatgtgctaaatttcatttggagaccatgaaagtacatacagatatagatgttagtttgatggtcattttatatacctatgaggtagttattgaccttctgtaccaaatggccttctgtatatcatcagggttatgcttgttagttcattttctgttttagatgtggattttgtatgcattgataaaacatattgcttattgagatgtgtttatactgttttacat

SEQ ID NO: 1492 - DNA, 1116 bp, Cicer arietinum
ctttctctttcgaggttttgacttgaacgatccatagttttatcatcgttttgtttcttcagatggcaagtgggtttggggaatcaacaagtaggtcacccccaagccctccctactcaagcaacaataataacaatgatgctggaaattttgaatgcaacatttgctttgacttagcacaagatcctataattactttgtgcggtcatcttttctgttggccttgtctttacaaatggcttcactttcactcacagtcacgggaatgtccggtgtgtaaggcaatgattgaggaggagaagttagttcctttatatgggagaggaaagacatcaactgatccgagatcgaagtctattcctggtgttaatatccctcatcgtcctgccggtcagagaccggagactgctcctccacccgaatcaaatcctttttctcaacatggatttggattcacaggtggattgggaggatttgctccagcagcaactgcaaggtttgggaatttcacattttctgcaggatttggtggttttataccatccttatttaactttcagttgcatggatttcacggtggggccatgtatggtggagccgctggtttcccttatgggttttctaattcatttcatggtggccatgttcatagatatcctcttcacacaggtcaaggccaacaagattattatctgaagaggctgctgatgtttgttattttttgtgtggtacttgcttttatttggcaatagattggatagagttcagacttctgatagaaccaaacttaagctcttatcaatcttcccgtgtgccttttttcgttattattttgtaactatggaggttgttcatattcatactctcttgttacacctgtagtttgtctctatttagtttatcaatcttgatgtgcaaccttgtgcaaaatttcattgcaaggtcatgaaaacacatgcagatatagatgttagtctgatggttataaggttatttactgaggatagatacctgtgagatggttattgaaattatagctttttcctcagttttggttttctcagttaaatacatgttgctgtggttatcttataataagaaattatttacatatct

SEQ ID NO: 1493 - DNA, 1132 bp, Arachis hypogaea
aactgaagctcctgctttccattttgtatttttgacttttgacatgcgggatcgatcgcgtttctgatatctcccctctcttacttcttttggtgtctgcagatggcaagtgggtttggggaatcaacgagcaagtctcccccaagcccttcgtactcgaacaacagcaataacaacaatgatgctggcaactttgaatgcaacatatgctttgatttagcacaagacccaattatcactttgtgtggccacctcttctgctggccatgtctctacaagtggctgcacctccactcgcaatcgcaagaatgccccgtctgcaaggccgccattgaggaggagaagctggttccattgtatgggagagggaagacatcaactgacccgagatcaaaaactattccgggtcttaatatccctcatcgtcctaccggtcagagacctgaaactgcagctcctcctcccgaagcaaaccattttcatcaacatggatttggtctaatgggtggcttgggaggctttgcaccaatggcgactgcaagatttgggaatttcaccttgtctgcggcatttggtggttttataccatccttgttcaactttcaattgcacggatatcataatgggtccatgtatggtggagcagctggttatccttatggatactctaattcatttcacggtgtccatgctcatagatatcctctgcatgctggtcaagggcaacaagattattacctgaagaggctccttctgtttgtcgtcttctttgttgtccttgcttttatctggcaatagatttgatagattgccaccagaaccaaatttatgctctcataaatcttctggtgcgtccttttttcttcttcagggttactaaacaaatttgttcatatagtactctctgttattcttgtagctatgttctttatgatcgctttgcgagacttgacttgcatgatatccccgtgcaaatttcgtgtttagagcatgtaagccaacgcacatgtacacatagatgttaatttgattgtgattatacctgctctcgaatatataaggtagtagaactagtgaagttatgcttattttcattgtcattttaatgttcatatccttatattatatcagc

SEQ ID NO: 1494 - DNA, 848 bp, Glycyrrhiza uralensis
ggcaggatctaccgtttcgtcagcgtttctttctgcagatggcaagtgggtttggggaatcaacgagcaggtcgcccccaagccctccctactcgagcagcaacaataacaacgatgctggaaattttgaatgcaacatttgctttgacttagcacaagaccctatcattactttgtgcggtcatcttttctgctggccatgtctttataaatggcttcactttcactcacagtcaaaagaatgcccggtgtgtaaggcactgattgaggaggagaagttggttcccttatatgggagaggaaagtcatcaactgatccgagatcaaaatctattcctggtgttaatatcccgcatcgtcctgctggtcagagacctgaaactgctcctccacctgatccgaatcctttttctcaacatgggtttggattcactggtggattgggggcatttgcacccgcagcaaccgcaagatttgggaatttcacattctccgcaggttttggtggttttataccatccttgtttaactttcagttgcatggatttcatggtgggtccatgtatagtggagcagctggtttcccttatgggttttctaattcatttcatggcggccatgttcatagaggatatcctctgcacacaggtcaagggcaacaggattattatctgaagagcctgctgctggttgttattttttgtgtggttcttgcttttatttggcagtagattagatagagttcagactgctagtagaaccaaacttaagctcttataaatcttcccgtgtgcttttttttgttattttgtactatggaagttgttcatatcacactcctattactc

SEQ ID NO: 1495 - DNA, 1089 bp, Manihot esculenta
ggaaatagaaagacaaaaaagggggaaaaaaagagagagaaaagaaaataattcttcttagtcaaatcaatttctgtggatttttcagagcttcccgcattatccatttgactattgggatcgatcggatcgatcgatctttttgatttctctatataattagatatagaaggcgtttgattgaggattaaatcgggagatggcaagtggttttggggaatcaacaagcaggccaccccaaaacccctcattttctagcaacagtaatggtgatgctggtaactttgaatgcaatatttgctttgacttagctcaggatcccatagtaactctgtgcggccatcttttctgctggccctgtctttacaaatggctccactttcactcacaatctaaggaatgccctgtttgtaaggctttggtggaggaggagaaattggttcccctgtatggtaggggtaaaacatcaacggaccctagatcaaagtccattcctggtgttaatattcctaaccgcccagctgggcagaggcctgaaacagctcctccgccagaaccaaatcattttgctcaacatggatttggattcatgggagggctgggtggatttgctccaatggcaacagctaggtttgggaattttacattgtctgcagcttttggtgggctcatcccttctctttttaaccttcaattgcatggatttcctgatcctgccatgtatggggcggctgctggctttccttatgggttctctaactcttttcatggcggccatgcacatggatatcctccgcaccaagggcaaggacagcaagattattatctgaagaggctacttctgtttattggtttttgtgttctccttgctctcatttggcaatagattaaatctattttcacatcctgttaatggatgtttagggctcatcattctcacgtctttgtaaagccgttagtgcaccttttttttttctaaatttttttggtaccagggaaattgtccatatcgtacactgtcagaactcttgtagctcctgtatgttttcgtcatctttgtggaatgtgatttgattgttttttcttgtt

SEQ ID NO: 1496 - DNA, 995 bp, Trifolium pratense
  misc_feature (775)..(775): n is a, c, g, or t
  misc_feature (784)..(784): n is a, c, g, or t
ttttgacttcaacaaaagatctatcgtttcttcagatggcaagtgggtttggggaatcaacaagcaggtcacccccaagccctccctactcgagcaataataataacaatgatgctggcaattttgaatgcaacatttgctttgacttagcacaagatcctattattactttgtgtggtcatcttttctgctggccttgtctttacaaatggcttcattttcactcacagtcacgagaatgcccagtttgtaaggcaatgattgaggaggagaagttggttcctttatatgggagaggaaagacgtcaactgatccaagatcgaaatctattcccggtgttaatattcctcatcgccctgctggtcagagacctgaaactgctcctccacctgaatcaaatcctttttctcaacatggatttggattcacaggtggactgggaggatttgcaccagcaacaacggcaagatttgggaatttcacattttctgcaggatttggcagttttataccatctttattcaactttcagatgcatggatttcacggtggagccatgtatggcggagcagctggtttcccttatggattttctaattcatttcatggtggccatgttcatagatatcctccgcacataggtcaaggccaacaagattattatctgaagaggctgctgatgtttgttattttctgcgtggtacttgctctgctttggcaatagattggataggattcagactgctgatagagccggactgaagctcttatcantcttcctgngtgcctttttttcctattattattttgtaactgtggaggttgttcatatcatactctcttgttactgttgtagttcgtctctaattagtttatcgatcttgatatgcatccttaagcaaaatttcatttcaagataatgaaatcaaatgcagatatagatgttagtttgatgtttatatgctgataatatatagctatggcatgattatgg

SEQ ID NO: 1497 - DNA, 723 bp, Phaseolus coccineus
  misc_feature (610)..(610): n is a, c, g, or t
  misc_feature (614)..(614): n is a, c, g, or t
  misc_feature (639)..(639): n is a, c, g, or t
  misc_feature (651)..(651): n is a, c, g, or t
cctttctccagatggcaagtgggtttggggaatcaactgggaggtcacccccaagcccttcatacttcaacaacaataataatagctaatgatgctgggaattttgagtgcaacatttgctttgaattagcgcaagacctcataattactttgtgcggtcatcttttctgctggccttgtctttacaaatggcttcactttcactcacagtcacgagaatgcccggtttgcaaggccctcgtggaagaggacaagctggttcccttgtatgggagaggaaagacctccactgatccaagatcaaagtctattccgggcatgaatatcccagatcgcccggccggtcagagacctgaaactgctcctccaccagaaacaaatagttttcacccacatgggtttggatttatgagtggctttgcaccaccgccaatggcaacaacaagatttgggaatttcggatttcccgcagcttttggtggttttataccgtcctttctcaactttcagttgcatgggtttcacgatggggccgttgtatcggggagcctctggttttcctcatggattttctaagtacatttcagggtggttcatgctcacggatatnctcntcgcactcatcaaagtccacaagantattttttgaanaaaccggcttccaaggggttgttttcggggtcctcctgcctttaattggcaaaaaatgggaaacctctctgg

SEQ ID NO: 1498 - DNA, 991 bp, Medicago truncatula
caacaaggatctatcgttcatttctttcttcaccgttttgtttctcttcatatggcaagtgggtttggggaatcaacaagcaggtcacccccaagccctccttactcaagcaataataataacagtgatgccggcaattttgaatgcaacatttgttttgacttagcacaagatcctattattactttgtgtggtcatcttttctgttggccttgtctttacaaatggcttcactttcactcacagtcacgagaatgcccggtttgtaaagcgatgattgaggaggagaaattggttcctttatatgggagaggaaagacgtcaaccgatccgagatcgaaatctgttcctggtgttaatatccctcatcgtcctgccggtcagagacctgaaactgcacctccacctgaatcaaatcctttttctcaacatggatttggattcacaggtggattaggtggatttgcaccagcaacaactgcaagatttgggaatttcacatttgctgcaggatttggtggattggggggatttataccatccttatttaactttcagttgcatggttttcacggtggggccatgtatggtggagctgctggtttcccttacgggttttctaatgcatttcacggtggccatgttcatagatatcctctacacacaggtcaagggcaacaagattattatctgaagaggctgctgatgtttgttattttttgtgtggtacttgctttactttggcaatagattgaatagagttcagactgccgatataaccaaacataagctcttatcgatctttcagcgtgccttctctttatattattattttgtaactgtggaggttgttcatattatactctgttgttagtttgttactcttgtagtcctctctaattagtttatcgatcttgatatgcgtccttatggaaaatttcatttcaagatcataaaatcaaatgcagatatagatgttagtttgatgatt

SEQ ID NO: 1499 - DNA, 990 bp, Medicago truncatula
caacaaggatctatcgttcatttctttcttcaccgttttgtttctcttcatatggcaagtgggtttggggaatcaacaagcaggtcacccccaagccctccttactcaagcaataataataacagtgatgccggcaattttgaatgcaacatttgttttgacttagcacaagatcctattattactttgtgtggtcatcttttctgttggccttgtctttacaaatggcttcactttcactcacagtcacgagaatgcccggtttgtaaagcgatgattgaggaggagaaattggttcctttatatgggagaggaaagacgtcaaccgatccgagatcgaaatctgttcctggtgttaatatccctcatcgtcctgcggtcagagacctgaaactgcacctccacctgaatcaaatcctttttctcaacatggatttggattcacaggtggattaggtggatttgcaccagcaacaactgcaagatttgggaatttcacatttgctgcaggatttggtggattggggggatttataccatccttatttaactttcagttgcatggttttcacggtggggccatgtatggtggagctgctggtttcccttacgggttttctaatgcatttcacggtggccatgttcatagatatcctctacacacaggtcaagggcaacaagattattatctgaagaggctgctgatgtttgttattttttgtgtggtacttgctttactttggcaatagattgaatagagttcagactgccgatataaccaaacataagctcttatcgatctttcagggtgccttctctttatattattattttgtaactgtggaggttgttcatattatactctgttgttagtttgttactcttgtagtcctctctaattagtttatcgatcttgatacgcgtccttatggaaaatttcatttcaagatcataaaatcaaatgcagatatagatgttagtttgatgatt

SEQ ID NO: 1500 - DNA, 1085 bp, Trigonella foenum-graecum
ttttgactccaacaaggatctatcgttcgtttcttcaccgttttgtttctcttcagatggcaagtgggtttggggaatcaacaagcaggtcacccccaagccctccctactcaagcaacaataataccaatgatgctggcaattttgaatgcaacatttgcttcgacttagcacaagatcctattattactttgtgtggtcatcttttttgctggccttgtctttacaaatggcttcactttcactcacagtcgcgagaatgtccggtttgtaaggctatgattgaggaggagaaattggttcctttatatgggagaggaaagacgtcaactgatccgaggtcgaaatctattcccggtgttaatatccctcatcgtcctgccggtcagagacctgaaactgctcctccacctgaatcaaatccattttctcaacatggatttggattcacgggtggattagggggatttgcaccagcaacaactgcgagatttgggaatttcacatttgctgcaggatttggtggattggggggatttataccatccttatttaactttcagttgcatggatttcacggtggggccatgtatggtggagcggctggtttcccttacgggttttctaatgcatttcacggtggccatgttcatagatatcctctacacacaggtcaagggcaacaagattattatctgaagaggctgctgatgtttgttattttttgtgtggtacttgctttactttggcaatagattgactagagttcagactgccgatagaaccaaacttaagctcttatcaatctctccgtgtgccgttttttaatattattttgtaactgtggaagctgttcatattatactctgttgttactcttgtagttcctctctaattagtttatcgatcttgatatgtgtccttatgcagaatttcatttgaagatcatgaaatcaaatgcaaatatagatgttagtttcatgtttatatacttatgatagatacctatgagatggttattgaaattgtagttttttcccagtttttggtttcctctttgttaagtacatgttgatgtgatcatc

SEQ ID NO: 1501 - DNA, 1131 bp, Glycine max
gttatgattcagaggattatcttttccttgaaaatccataccatgcgctagcgttatcctctttggcctccaaaggttgttatagatagaacagaacgcagaacgcagaacgcaggtttgagtttccttaactgaagcgaactaaaatgggtgcgaacgctaacgacttgtccactgagatagattgtactaagaaggtttccaattgttggggaaatggtcaaataccctttgcacttccttttctcacactccccaattccaacttcaccactctcctctcttcaccacctcaactactccacacatcattcaccactgccgctgacaattttttcagatttgtacactccctcgcttctcagaaccccttcctcaacaaagttctctctctccccgccgaatttcacaccttatgcgtgcagattcggaagcaaaggaacgtggggttggtgtctagtcataatttcgctgccgttttgcccgggggttcggtggcagggctagtggtggctaacggggttctcaatttcttgaacatttacaacactttgctcattgttaggcttgttttgacatggtttcccaacactcctccttccattgttagccccctcagcaccatatgtgacccatacctgaacatattccgtggacttattccccctctgggaggaaccctggatctctctcccattctagcattcttggtcctaaatgcattcaccagcactgctgctgcactccctgccgagcttccagtcacagaacaatcaaaacaaggtcttgcagcgccattgccctctactacttcacagaagaaatggatgagacggtttcaagggaacaggtcaaggacatctggtgatgatgctaaatagaacatgggagagtttatttgtgcctctgtatctgtttattaatttagatacgttgctattgttccatcttgattatgatagttctattctaggcaacacaaattttgagctaatgattccagagattgtagagttatggagttttctgtggaaagctcaaggctcaaactaccacagtcacaatttattttgtttttatttttttacagtacacatcctattgttttctttaatcccaaggtccttattt

SEQ ID NO: 1502 - DNA, 3021 bp, Phaseolus coccineus
tcattcaaaaaccatttgcctttttccaaaccaaccaactcactctcatgttggtggaaaacgtgaggacatcttaaacaaaactccccttttctaactcccttctcctcccactccctcaatttccgcaatggcggcttcagtcgaacaccgtcctttcacctcccaccaacacggcgtcgttcgctccttcaagtcctatccggacgtcccgcgtcctaagaagttacccctgccacaaccactttccgattccacaaacgacaacgacgaggaagccgctgtgtggaaggaactggttcttaagtcgagcgcgggagttgaaccctctattttcgacccgcgcgacgacggaacctccgaccaatggatcaaacggaatgcttccatgatccgtttgacggggaaacaccccttcaacgcggagccgcccctccctcgcctcatgcagcacggcttcatcacccccagtcccatccactacgtccgtagccacggacccgtgccccatgctcgctgggaggactggaccgtcgaggttacgggtctcgttacccggcccacgtgcttcaccatggagcagctggtcaatgacttccccagccacgagttccccgccacgcttgtctgcgctgggaaccggcgcaaggaacagaacatggtgaaacagagcatcggcttcaactggggcgccggcggtgtctctacttcggtgtggcgcggtgtatcgttgcggagcctgctaaagcggtgcgggatctacagccgcgcgaagggggcgcttcacgtgtgcttcgaaggcgccgaggatctgccaggtggcggtgggtccaattacgggaccagtctcatgagggaggttgcactggatccctcccgcgacatcatactggcttacatgcaaaacggggagcttctgtccccggatcacggcttccccgttaggatgataatacccggtttcattggcggccgcatggtgaaatggttgaagcgcatcgttgtcagtaaccagcaatctcaaagtcattaccattacaaggataacaagctatttccatctcacgttgacgccgaacttgccaatgaagaagattggtggtacaagccagagtatattatcaacgaggtcaacataaactccgtcataacaactccctcccaccaagagatcttgcccatcaactcatggacaactcagatgccatattccatgagaggctacgcctattccgggggtgggagaaaggtgacacgtgtggaggtaaccctggacggtggtgaaacgtggcaagtgtgcagtgtggagcgtctggagaaaccgaacaaatatggcaagtactggtgttggtgtttctggtccttggaggtggaggtgttggatatcctcggagccaaagagattgcggtgagagcttgggacgaggcccagaacacccagcccgagaaactcatctggaatactatgggaatgattaacaactgctggttcagagtgaagacgaacgtgtgcaagccgaagaagggtgagattggtatagtgttcgagcaccccacccaaccaggcaatcaatctggcggatggatggccagagagaaacagctggagaaatcatcagaatccaacccaatcctcaagaagagtgtctcctccccattcatgaacaccgccaccaaatcctattccctttccgaagtcagaagacacaacaaccgcgattcagcttggatcattgtcaacggccatgtctacgactgcactcgcttcctcaaagaccatccgggcggcgaagatagcatcctcttaaacgctggcaccgactgcactgaggagttcgaagccatccactccgacaaagccaagaaaatgcttgaagactaccgaatcggggagctcatgaccaccgactacacctctgattcctcatcctccaacaacagcgtgcacggcaattctgaaaccacccacttggccccaatcagggaggtggctctcaacccacgcgagaaaatcccatgcaagctcctctccaaaacctccatctctcacgacgttaggctccttcgctttgcgttgcccgccgaggaccaggttatgggtttgcccgtcgggaatcacgtattcttatgtgctaccgtcgacgagaagctatgcatgcgagcctacactcccacaagcagcgtagatgaagtgggcttctttgacctcgtcgtcaaggtttacttcaaaggggttcatcctaacttccccaacggtgggatcatgtctcaacacttggactcgctccccattggctctgtcgtggacgtgaaaggcccactaggccacatagaatacaccggcagaggaaacttcctcgttcatggaaaacctaggtttgccaagaggctaaccatgctggctggtggcaccgggatcacaccaatctaccaagtggttcaagccattctaaaggacccagaggaccgcaccgaaatgtatgtggtatacgccaaccgaaccgaggatgatatattgctgaaggaggagcttgatgaatgggctaagaaacatgacaggctcaaggtgtggtacgtggtgcaagcaaacataagagaaggatgggaatacagcgtgggattcatcaccgagagtatcctgagggaacatgttccacttgcatctcctgataccttggcgttgacttgtggtccaccacccatgattcagttcgcggttcaaccgaatttggagaagttgggctacgacatccagaacgacttgctcgtgttttagggtactaaagtactaggctgtatctatatgtgtatatgtcttattatatataaataattcaatcaccttctttcaaggttttttaatgtttcaatttttaaataaaaagtgtatatgtacatggacaaatatctaccaacctaggtttacttttcctcctcaagtttcttgtagagaagtataccaattactttttgtattataaaattgcgaagaaatagattagtaaaatcttatctaaaaag

SEQ ID NO: 1503 - DNA, 2864 bp, Phaseolus coccineus
aactcactctcatgttggtggaaaacgtgaggacatcttaaacaaaactccccttttctaactcccttctcctcccactccctcaatttccgcaatggcggcttcagtcgaacaccgtcctttcacctcccaccaacacggcgtcgttcgctccttcaagtcctatccggacgtcccgcgtcctaagaagttacccctgccacaaccactttccgattccacaaacgacaacgacgaggaagccgctgtgtggaaggaactggttcttaagtcgagcgcgggagttgaaccctctattttcgacccgcgcgacgacggaacctccgaccaatggatcaaacggaatgcttccatgatccgtttgacggggaaacaccccttcaacgcggagccgcccctccctcgcctcatgcagcacggcttcatcacccccagtcccatccactacgtccgtagccacggacccgtgccccatgctcgctgggaggactggaccgtcgaggttacgggtctcgttacccggcccacgtgcttcaccatggagcagctggtcaatgacttccccagccacgagttccccgccacgcttgtctgcgctgggaaccggcgcaaggaacagaacatggtgaaacagagcatcggcttcaactggggcgccggcggtgtctctacttcggtgtggcgcggtgtatcgttgcggagcctgctaaagcggtgcgggatctacagccgcgcgaagggggcgcttcacgtgtgcttcgaaggcgccgaggatctgccaggtggcggtgggtccaattacgggaccagtctcatgagggaggttgcactggatccctcccgcgacatcatactggcttacatgcaaaacggggagcttctgtccccggatcacggcttccccgttaggatgataatacccggtttcattggcggccgcatggtgaaatggttgaagcgcatcgttgtcagtaaccagcaatctcaaagtcattaccattacaaggataacaagctatttccatctcacgttgacgccgaacttgccaatgaagaagattggtggtacaagccagagtatattatcaacgaggtcaacataaactccgtcataacaactccctcccaccaagagatcttgcccatcaactcatggacaactcagatgccatattccatgagaggctacgcctattccgggggtgggagaaaggtgacacgtgtggaggtaaccctggacggtggtgaaacgtggcaagtgtgcagtgtggagcgtctggagaaaccgaacaaatatggcaagtactggtgttggtgtttctggtccttggaggtggaggtgttggatatcctcggagccaaagagattgcggtgagagcttgggacgaggcccagaacacccagcccgagaaactcatctggaatactatgggaatgattaacaactgctggttcagagtgaagacgaacgtgtgcaagccgaagaagggtgagattggtatagtgttcgagcaccccacccaaccaggcaatcaatctggcggatggatggccagagagaaacagctggagaaatcatcagaatccaacccaatcctcaagaagagtgtctcctccccattcatgaacaccgccaccaaatcctattccctttccgaagtcagaagacacaacaaccgcgattcagcttggatcattgtcaacggccatgtctacgactgcactcgcttcctcaaagaccatccgggcggcgaagatagcatcctcttaaacgctggcaccgactgcactgaggagttcgaagccatccactccgacaaagccaagaaaatgcttgaagactaccgaatcggggagctcatgaccaccgactacacctctgattcctcatcctccaacaacagcgtgcacggcaattctgaaaccacccacttggccccaatcagggaggtggctctcaacccacgcgagaaaatcccatgcaagctcctctccaaaacctccatctctcacgacgttaggctccttcgctttgcgttgcccgccgaggaccaggttatgggtttgcccgtcgggaatcacgtattcttatgtgctaccgtcgacgagaagctatgcatgcgagcctacactcccacaagcagcgtagatgaagtgggcttctttgacctcgtcgtcaaggtttacttcaaaggggttcatcctaacttccccaacggtgggatcatgtctcaacacttggactcgctccccattggctctgtcgtggacgtgaaaggcccactaggccacatagaatacaccggcagaggaaacttcctcgttcatggaaaacctaggtttgccaagaggctaaccatgctggctggtggcaccgggatcacaccaatctaccaagtggttcaagccattctaaaggacccagaggaccgcaccgaaatgtatgtggtatacgccaaccgaaccgaggatgatatattgctgaaggaggagcttgatgaatgggctaagaaacatgacaggctcaaggtgtggtacgtggtgcaagcaaacataagagaaggatgggaatacagcgtgggattcatcaccgagagtatcctgagggaacatgttccacttgcatctcctgataccttggcgttgacttgtggtccaccacccatgattcagttcgcggttcaaccgaatttggagaagttgggctacgacatccagaacgacttgctcgtgttttagggtactaaagtactaggctgtatctatatgtgtatatgtcttattatatataaataattcaatcaccttctttcaaggttttttaatgtttcaatttttaaataaaaagtgtatatgtacatgg

SEQ ID NO: 1504 - DNA, 2997 bp, Glycine max
accaatttccttttctctttcaccagaaagtgacactgagagaagaaggaaaaactaaccaacaccacagcccctaatttcctttttctcacaatggcggcttcagtcgacaaccgtcaatacggcacccacataaacgccgtcgttcgcgcttgcggcccagacttcaatacccctctcccgtcggatttcgatctggactcatccagcgacgacgaagaccaaaacgacgacgcttcgtatctcaaggagttgatacaaaaagcgaacgcggaaaccgaggcgtcgctgttggacccgcgagacgagggaaccgcggaccagtggatcccgcggaacgcctccatggtgcggctcacagggaagcaccccttcaacgcggaggccccactcccccgccttatgcaccacggcttcatcaccccatcgccactccactacgtccgcaaccacggtccagttcccaagatcaaatgggatgaatggaccgtggaagtgactgggttggtcaaacgatcaacccacttcaccatggagaaacttatgagggaattccctcaccgcgagtttcccgccacactagtgtgtgcgggaaatcggcgcaaagagcataacatggtgaagcagagcatcggcttcaactggggtgccgccggggcctccacctccgtgtggcggggggtcccgctgcgtcatgtgctcaaacgctgtgggatcctcgcccgtatgaagggcgccatgtacgtgtccttcgagggcgccgaggatctccccgggggtggtgggtccaagtatggaaccagcgtcaagagggagatggccatggatccgtcgcgtgacatcattctcgcgttcatgcaaaacggcgagccgttggcgccggatcatggatttcccgtgcgcatgattattccggggttcatcggtggaagaatggtgaaatggctcaaacgcattgtcgttactgagcatgagtgcgatagtcattatcattataaggataatagagtactcccttcccatgttgatgcagaacttgctaatgacgaaggttggtggtacaagccagaatacatcatcaacgagttgaatataaactcagtgataactacgccttgtcacgaggagatcttgcccatcaactcatggactacacagaggccttacgtaatcagaggctatgcatattccggtggtggaaggaaagtgacacgtgtggaggtaacacttgatggtggagaaacatggcacgtgtgcacattggaccatactgagaaacctaacaaatatggcaagtattggtgctggtgcttctggtctttggaggtggaggtgcttgacctacttggggccaaggagattgcggttcgagcttgggatgaaggtctcaacactcagcctgaacacctcatttggaatgttatgggcatgatgaataactgctggttcagagtgaaaacaaatgtgtgcaagccccacaagggtgagattggcatagtgtttgagcatccaacccaaccaggcaaccaacccggtggctggatggcaaaggaaaaacatttggaaaaatcacaaaagccaaaaccaaccctaaaaaagagtgtctccacaccattcatgaacacttcctcaaaaatgttctccatctccgaagtgaaaaaacattccaaccctgactctgcttggatcattgtccacggtcacgtctatgattgcacccgcttcctcaaagatcaccccggtggtactgacagcatcctcatcaatgctggcaccgactgcaccgaagagtttgacgccatccattctgacaaagcaaaaaaattgcttgaagattaccgaatcggggagctcatcaccactggctacacctcagactcatcgcccaacaactccgtgcatggcaattccgaattcactcatttggcccctattaaggaaactacaacaccaccatcacgtagtgtggctctcaacccacgcgagaaaatcccatgcaagctcgtgtcaaagacctccatttctcatgacgcgaggctattccgttttgcattaccctcagaggaccaactcttgggattatccgtggggaaacacattttcttgtgtgccaccatcgacggcaagctatgcatgcgagcctacactccaacaagtagtgtggatgaagtgggtttctttgatctactcatcaaggtgtacttcaaaggtgtgcatcccaagtttccaaatggaggactcatgtctcaacatttggactctctacccattggatccatgttggacgtgaagggcccattaggtcacatagaatacaccggaagaggcaacttcatggttcatggaaaaccaagattcgccaagaggttggccatgttggctggtggaactgggatcacgcccatttaccaagtggcgcaagcgattttgaaggacccagaggaccacaccgaaatgcatgtagtgtatgcgaatcgcacagaggatgatatattactgagggaggagttggatgagtgggcgaagatacataatgaccggttcaagctatggtacgtggtggaaatcgcaaaggaagggtggaaatacagtgtagggttcatcacagagagtatcacgagggagcaccttccaaaagcgtcgagggattccttggctttgacatgtgggccaccacccatgattcagtttgcagtgcagcctaatttggagaaaatgggatatgatatcaagaacgatttgcttgtgttttagggcatggagaagtagctagattgctagattgtgttgtgtattgtatttgtttgtgtatcgggtgttattggagtattaatgtttgtttcattctttataagggtaaaaaaagaagtgaaaaattgtatatgaaccgagattgttgggaagtaactcttcatcccttctcacgctttaatgtagacaggtacgtcaagatttttttactactttagtgtaaataaattaatgttatatatgcct

SEQ ID NO: 1505 - DNA, 2634 bp, Cajanus cajan
atattcattacaccaaagttgaccgattgaaaccaaccatggctctctgcaccccttccttcatcttcctcagcttcttcttgttcctcttcaatcttcaaccctcactctcccaacaacaacaacaactcacatccttcaacatctcacactccccatggcacccatcacaaaacagaacccttctctctcccaacaaaaacttcactgcagggttcttccctcttcccaactcccccaacctcttcaccttctccatttggtactccaaagtccctataactgcaaacccccttgtgtggagctccaaaacccaagtcaacacttctgggtcccttgtaataaccccaaaaggtgaactttttctcgatggttcaccttttcaagatgcttccaatgcttcctccacctccaattccacccaacttgttctccaaaacgacggcaacttggtctttgggaactggaccagcttcaagaaccccaccaacacggttttgcccaaccagaacttcagcactgggattgagcttcactccagcaatgggaaatacaggttcatcaagtctcagtttttggttctcaattccaccaatgatcaatactacagcaccccaagccccttgctgagcatggatgatgcagggaaaatgaccatggcggttaactctttcctcacttcagactatggtgaccccaggttcaggaaactggtcctaggtgatgatgggaatctcaggatctacagcttctaccctgagccgcagaatcagtgggttgaggtttggaaagggatatgggagatgtgcaaaatcataggtagatgtgggcctaatgccatttgtgtgccaactgaggatttgaacatttccacttactgtgtttgcccatctgggtttagcccaaacccaggtgggcctgaagagggttgcaaaaggaaagcccctctttcccaacacacccattttgtgagactagattatgtgaactacaccagtgatggcagcgtgaaccaaatcaatgctgagaacttcacaatctgtgagtccagatgctcaacagacaaaacctgccttggatttggcttcaaatatgatggatctggcttctgtgtattgctcaaagggacagagcttagatatgggtactggtcaccaggcaccgaggctgccttgtttttgaaggttgaccaatctgagtcagcatcctccaacttcattggcatgactgaggtgatgcaaaccacatgccctgtgaacataagccttccactccctccaaaggactcaaacaccactgcgaggaacattgccataatctgcaccctttttgctgcagaactcatagttggggttgccttcttctggtccttcctcaagaggtacatcaagtatagggacatggccaccacactgggccttgagcttcttctccctgctgggggcccaaagaggttcacctactcagaaatcaaggctgccaccaatgacttctccaacctcataggtaaaggaggctttggagatgtctacaaaggggagttaccagaccacagggtggtggcagtgaagtgcctcaagaatgtcgcaggaggagaggagttttgggctgaagtcagaatcattgccagaatgcaccacctcaacttggtcaggctctggggcttctgtgctgaaaaaggccaaaggatacttgtgtatgaacacatccctggtggctcattggacaagtatctcttcaggatcaagtctcatcttcccaaagaccaatcaagtcctcaaccaaggcctgttttggattggagcatgaggtacagaattgcccttggtgtggcaagggctattgcatatctacacgaggagtgtttggagtgggttttgcactgtgacataaagcctgagaacattttacttggggatgatttttgtcctaagatttcagattttgggttggccaagttaaggaaaaaagaggacatggtgaccatgtcaaggaggaggggcactccagggtacatggcaccagaatggatcactgctgacccaattactgccaaggctgatgtatatagctttgggatggtgctgttggagcttgtgagtgggatcaggaactttgagatccaagactctgtggttagaagcgaagagtggtacttccctggttgggcttttgataagatgtttaaggagatgagagtggaggagattctggatggccagattagggaggcttatgacagtagggcccactttgatatggttaataggatggtcaagactgccatgtggtgcctacaggataggcccgagttgaggcccactatggggaaggtggccaagatgttggaagggactgtggagatcactgagcccaagaagcccactgttttcttccttggggaagagtagtaacgtttttttttactttgtgtagcctctcttgtttcaggcttgcttgcttatgagaatatgactctctttttatttcttgtactggcatatatggcagcatgtatgctcaatagttgaacaatatcaaatcaattgggtgatcaagtgtataaatattactcttatttttcttttcattatggtgtattctgttcaagatcagtctctacgaatgagtaac

SEQ ID NO: 1506 - DNA, 2751 bp, Phaseolus coccineus
aaaagcatagaacagaagagagtcaagtcaatgttctaagtctacacgctcaaatatgatagccgccactgattcttcaatttaaccaaaccaaccacaaatgtttgcatttcattcactgcacaatagttgaccaaaccatgcctctctccaccccttccttcttcctcctcaccctcttcttcttcctcctcttcaatcttcaaccctctttctcccaacaacaattctcatccttcaacacctcacactccccatggcaaccatctcagaacagaacccttatctctaccaacaaaaacttcactgcaggcttctttcccctaccaaacaccaccctcttcaccttttccatttggttttctcaagtccctaatgccaaaggtattgtgtggagtgacaccacccgggtcaacagttctggctctcttgtcatcacctcagaatttgaacttctcctcaatggttcaccctttcaggatactgccaatactaatgcttcccaacttgttcttgagaacaatggaaacttggtttttgggaactggagcagcttcaggaaccccaccaacaccattttgcccaaccagaacttcacagggattgagcttctctccagcaatgggaaattcaggttcatcaagtctcagtttctggtcctcaactccactgctgatcaatactatggcaccccaaatcccttggtgggcatggatgatgcagggaaaatgagcatggtaggtaactcttttctcacttcagattatggagaccccagattgaggaaagtggtccttgatgatgatgggaatctgaggatctatagcttctaccctgagcagaataacaagtgggttgaggtttggaaagggttatgggagatgtgcaggatcaagggcaaatgtgggtctaatgcaatttgtgtgcctggagaggatttgaacagttctactcattgtgtttgcccatctgggttcaacccaaaccaaggtggatctgaagagggttgcacaaggaaaaagtctctttcacaagacaccaaatttgtgaggttggactatgtgaactacaccagtgatggcagtttgacagaaattaaagctgggaactttacaatctgtgagtccggttgctcaacagataaaacttgtcttggttttgggttcaaatatgatggaactggctactgtgtgtggttgactgggacaaaccttcaatttgggtactggtcaccaggcactgaagccgccttttttctcaaagttgataaatctgagtcaacaccatccaacttcattggcctcactgaggtgatgcaaaccacatgcccagtgaacttgagcctgccactgcctccaaaggactcaaacaccactgccagaaacattgccataatatgcacactttttgctgcagaactcatagctggggtggccttcttctggtccttcctcaagaggtacatcaagtatagggacatggccaccacactaggcctggagcttctccctgccgggggtcccaagaggttcacctactcagaaatcaaggctgccaccaatgacttctccaatctcataggcaaaggaggctttggagatgtctacaaaggtgagttgccagaccacagggtggtggcagtgaagtgcctcaagaatgtcacaggtggagatgctgagttttgggcagaagtcacaatcattgccagaatgcaccacctcaacttggtgaggctttggggtttctgtgctgagaagggccaaaggatcctagtctatgaacacatcccatgtggctcaatggacaagtacctcttcagggtcaacaagtctcacagtaacaatgacaaacacctcaaagaccaatcaagtccaaacaccccacaacaaaaaccaaccttggattggaacatgaggtacagaatagcccttggtgtggcaagggctattgcctatttacatgaagagtgtttggagtgggttttgcactgtgacatcaagcctgagaacattttactgggtgatgatttttgccccaagatatcagattttgggctggccaagttgaggaaaaaggaggacatggtgaccatgtcaaggaggaggggaacaccagggtacatggcccctgaatgggtcaattctgctgaaccaatcacttcaaaagctgatgtttatagttttggcatggtgcttttggagcttgtgagtggaattaggaactttgagatccaagactctgtgcttaggagtgaagagtggtacttcccaggttgggcttttgataagttcaaggagatgagagtggaggagattttagatagacagattaggaatgattatgatagcagggcccactttgacatggttaataggatggtcaagactgccatgtggtgtctacaagaaaagcctgtgttgaggcccactatgggcaaggtggccaagatgttggaagggactgtggagatccttgagcccaagaagcccactgttttcttccttggggtggaagagtaggttcattctttcttttgaaaaaaaggtcatagaataagttttcaaaaagagagtagcaactcctctttttgttgtgtaatgtgatgtgatgagaagtctctcttttgtttaattctttcttcccaaggcttccttgtgtatctccataccttttgctaaatagtatctcttctatgatagcatgtgtgctcaatatttttaacaattaatgtaagatcaattgggtgataaa

SEQ ID NO: 1507 - DNA, 1614 bp, Cajanus cajan
gggtttaggtggacggtggacggtgggcccgtggcggggtttgatatccggagtgagccgtagaaagagttgaagagataacgtaaaacagcaaagagaaaagaaaaggaaaatggcactctcactctcctcctcctgtgtacgcgttccttcatgtttttggaaacaaaacggcaagagttgcaaagcggctcctaaggtgtcacgtgataacaagaatccattgctcggaattggtattggggtcgtaacggcttgcgtgatgggtttaacggcgttggacgccgacgccaccagaatcgaatactacgctaccgtgggagagcctttgtgtgagtacaactacgttaagtctggcctcggctactgcgacatcgctgagggcttcggtgacgaagctccatacgctgagcttatcaatattcactatactgcaaggttcgctgatggaacagtctttgatagcagttacaaacgtgctagacctctcaccatgcgcattggtgttggcaaggttatcaagggattggatcagggaattttggggggtgaaggagtacctccaatgcgaataggtgggaaacgcaaactgcagattcctccacacttagcatatggccctgaacctgtgggctgcttctcaggtgactgcaatatacccggcaacgccactcttctgtatgatattaattttgttgagctttattcggggaacagatcaaagtgaaggaagtccaaagtgatcggatacatatagatgcatatgaactacacatggatggagtgagtttcgagatctccatacaatatttatatgcttaaaatagatagttgaaatggtaaccaagcactcatatttttgtgtccagattgttttctatatgcttgaggaacctaaacttgttggctttctttcctttttaacaaaatactcaaataggaagcaacaacttcaaattttggacatgtaacccggaagcttttatgcatttgtaggagtaagtagaaactgcacgataaagcattgatcacctgctttagtggtttaatcagttggcattgattatatctataagcaacatcaaaatttgatgacacaagtgatcatacttgaaacataggctgcttaatatttctactcttttgtgaaacattctttgtgaaatttacaacatgtttaatgaccaactacctggtgatatgtaagattaatgataaatgataacactcggtgttcttttcttctctggtgtggattgtctaaaataggtatgattctaattactgatagtttagagcaatgaaatggacattttgctagagaatgtggatcaacttgtttggaagaatctccttcctgattccagctacctcgagttactgttcctggttagtggagttgtacatgattgacctggatacaacttttgagagcaatgaacaatccttcctggtgatatagattcagataattcacgcgtatctctctgcacatgacatgcgatcaacttgtgtatttttagtgtaaatgtaattttgaatactcctctatgaatgataaatttattaattcttcatatgataaatgtcatctgttagacatgatatgcttta

SEQ ID NO: 1508 - DNA, 1065 bp, Cajanus cajan
ggggggggttttaggtggacgtggacggtgggcccgtggcggggtttgatatccggagtgagccgtagaaagagttgaagagataacgtaaaacagcaaagagaaaagaaaaggaaaatggcactctcactctcctcctcctgtgtacgcgttccttcatgtttttggaaacaaaacggcaagagttgcaaagcggctcctaaggtgtcacgtgataacaagaatccattgctcggaattggtattggggtcgtaacggcttgcgtgatgggtttaacggcgttggacgccgacgccaccagaatcgaatactacgctaccgtgggagagcctttgtgtgagtacaactacgttaagtctggcctcggctactgcgacatcgctgagggcttcggtgacgaagctccatacgctgagcttatcaatattcactatactgcaaggttcgctgatggaacagtctttgatagcagttacaaacgtgctagacctctcaccatgcgcattggtgttggcaaggttatcaagggattggatcagggaattttggggggtgaaggagtacctccaatgcgaataggtgggaaacgcaaactgcagattcctccacacttagcatatggccctgaacctgtgggctgcttctcaggtgactgcaatatacccggcaacgccactcttctgtatgatattaattttgttgagctttattcggggaacagatcaaagtgaaggaagtccaaagtgatcggatacatatagatgcatatgaactacacatggatggaagaatgtggatcaacttgtttggaagaatctccttcctgattccagctacctcgagttactgttcctggttagtggagttgtacatgattgacctggatacaacttttgagagcaatgaacaatccttcctggtgatatagattcagataattcacgcgtatctctctgcacatgacatgcgatcaacttgtgtatttttagtgtaaatgtaattttgaatactcctctatgaatgataaatttattaattcttcatatgataaatgtcatctgtta

SEQ ID NO: 1509 - DNA, 1121 bp, Vigna unguiculata
ggtagagatacagataacgtgaaacagaaaggaaaatggcactctcactgtgttccagtgttcgcgttccttattgctctccttcgtgtttttggaaaccaaatggtaagaattgcgaagcgcctactaagttgccatgtgcagttcacagtaacaagaatccattggttggaatgggtattgggttggtaacggcttgggtgatgggtttaacggcgttggacgcggacgccacaagaatcgaatactacgccaccgttggagagcctttgtgtgagtacaagtatgtgaagtctggcctcggttactgtgatattgttgagggcttcggtgtagaagctccactcggtgagcttatcaatgttcactatactgcgagatttgccgatggaatagtgtttgatagcagctataaacgtggtagatctctcaccatgcgcattggtgttggcaaggtaatcaggggactggatcagggaattttagggggtgaaggagtacctccaatgcggataggtgggaaacgcaaactgcagattcctccacagttagcatatggccctgaacctgcggggtgcttctcaggtgactgcaacatacccgccaacgccactcttctgtatgatgttaattttgttgagctttattcggggaacagatcaaggtgaacgaactcatctgatcagatacctatatgcatatgaaccacacgtgaattgggtagaagcagacctgcggtaaataaatttaatatatcttcctgtagtataacgtgaaaacctctacttaaagctattattgctaaagagataatggtgatatttactgagcaatgaaatagaggagaatgtggatcaccttgtttggcagaatctccttcctgattccagctaccttaagttattgttcctgtttagtggagtggtacatgattgacctggatatccctttcgagaaaaaggaccagttcttcctgggatatctattagataattcacgtgtatctctgcacaggacacgcgagcaacttgtgtatctttagtgtaaatgtaattttcaatactgctctctgaatgataaaaatttattaattcttcatataataaatgtcacttctaata

SEQ ID NO: 1510 - DNA, 1139 bp, Vigna unguiculata
ggggtagagatacagataacgtgaaacagaaaggaaaatggcactctcactgtgttccagtgttcgcgttccttattgctctccttcgtgtttttggaaaccaaatggtaagaattgcgaagcgcctactaagttgccatgtgcagttcacagtaacaagaatccattggttggaatgggtattgggttggtaacggcttgggtgatgggtttaacggcgttggacgcggacgccacaagaatcgaatactacgccaccgttggagagcctttgtgtgagtacaagtatgtgaagtctggcctcggttactgtgatattgttgagggcttcggtgtagaagctccactcggtgagcttatcaatgttcactatactgcgagatttgccgatggaatagtgtttgatagcagctataaacgtggtagatctctcaccatgcgcattggtgttggcaaggtaatcaggggactggatcagggaattttagggggtgaaggagtacctccaatgcggataggtgggaaacgcaaactgcagattcctccacagttagcatatggccctgaacctgcggggtgcttctcaggtgactgcaacatacccgccaacgccactcttctgtatgatgttaattttgttgagctttattcggggaacagatcaaggtgaacgaactcatctgatcagatacctatatgcatatgaaccacacgtgaattgggtagaagcagacctgcggtaaataaatttaatatatcttcctgtagtataacgtgaaaacctctacttaaagctattattgctaaagagataatggtgatatttactgagcaatgaaatagaggagaatgtggatcaccttgtttggcagaatctccttcctgattccagctaccttaagttattgttcctgtttagtggagtggtacatgattgacctggatatccctttcgagaaaaaggaccagttcttcctgggatatctattagataattcacgtgtatctctgcacaggacacgcgagcaacttgtgtatctttagtgtaaatgtaattttcaatactgctctctgaatgataaaaatttattaattcttcatataataaatgtcacttctaatactaaaaagaaaaaaaa

SEQ ID NO: 1511 - DNA, 1235 bp, Phaseolus coccineus
aaaatgctaaccgttaatattgggagtgaggcacagaaagagttgaagagatatagataacgtgaaacagaaaggaaaatggcactctccctgtgttccggtgttcgcgttccttattgctctccttcgtgttcttggaaaccaaatggtaaaaattgcgaagcgcctactaagatgtcatgtaccgcagttcacagtgataagaagaatccattggttggaatgggtattgggttggtaacggcttgggtgatgggtttaacggcgttagatgcggacgccacaagaatcgaatactacgctaccgttggagagcctttgtgtgagtacaagtatgtgaagtctggcctcggttactgtgatattgtcgagggcttcggtgtggaagctccaatcggtgagcttatcaatgttcactatactgcgagattcggtgatgggatagtgtttgatagcagctacaaacgtggtagatctctcaccatgcgcattggtgttggcaaggtaatcaagggactggatcaaggtattttagggggtgaaggagttcctccaatgcggataggtgggaaacgcaaactgtatgttcctccgcagttagcatatggccctgaacctgcggggtgcttctcaggtgactgcaacatacccgccaatgccactcttctgtatgatgttaattttgttgagctttattcggggaacagatcaaagtgaacgaagtcaaagctgataagatatatatatgcatatgaaccacacatggattgggtagaagcagacatgcggtaaataaatttaatatatcttcttatagtataacgtgaaaaattctacttaaagctattaatgctaagagataatgatgtgatatactggtatgctttcttttcttctctggcctagtttatctaaaataggtacaattctaatttcttattgcttttagagcaatgaaatagtggagaatgtggatcaacttgtttggaagaatctccttcccaattccagctacctcaagttactgttcctggatagtggagtggtacatgattgacctggatatcccttttgtgagtaatgaccagtccttcctcggatatctattacataattcacgtgtatctctgcacaggacatgcgagcaacttgtgtatctttagtgtatatgtaattttctgaatgataaaaaattattaattcttgatatgataaatgtcacctcttatacatga

SEQ ID NO: 1512 - DNA, 1178 bp, Phaseolus coccineus
  misc_feature (755)..(755): n is a, c, g, or t
ataacgtgaaacagaaaggaaaatggcactctccctgtgttccggtgttcgcgttccttattgctctccttcgtgttcttggaaaccaaatggtaaaaattgcgaagcgcctactaagatgtcatgtaccgcagttcacagtgataagaagaatccattggttggaatgggtattgggttggtaacggcttgggtgatgggtttaacggcgttagatgcggacgccacaagaatcgaatactacgctaccgttggagagcctttgtgtgagtacaagtatgtgaagtctggcctcggttactgtgatattgtcgagggcttcggtgtggaagctccaatcggtgagcttatcaatgttcactatactgcgagattcggtgatgggatagtgtttgatagcagctacaaacgtggtagatctctcaccatgcgcattggtgttggcaaggtaatcaagggactggatcaaggtattttagggggtgaaggagtacctccaatgcggataggtgggaaacgcaaactgtatgttcctccgcagttagcatatggccctgaacctgcggggtgcttctcaggtgactgcaacatacccgccaatgccactcttctgtatgatgttaattttgttgagctttattcggggaacagatcaaagtgaacgaagtcaaagctgataagatatatatatgcatatgaaccacacatggattgggtagaagcagacatgcggtaaataaatttaatatatcttnttatagtataacgtgaaaaattctacttaaagctattaatgctaagagataatgatgtgatatactggtatgctttcttttcttctctggcctagtttatctaaaataggtacaattctaatttcttattgcttttagagcaaacatgaaatagtggagaatgtggatcaacttgtttggaagaatctccttcccaattccagctacctcaagttactgttcctggatagtggagtggtacatgattgacctggatatcccttttgtgagtaatgaccagtccttcctcggatatctattacataattcacgtgtatctctgcacaggacatgcgagcaacttgtgtatctttagtgtatatgtaattttctgaatgataaaaaattattaattcttgatatgataaatgtcacctcttatac

SEQ ID NO: 1513 - DNA, 1208 bp, Medicago truncatula
atggtgtagaaaggatggtatgccaaatggagttactcatatcatcagtctttgatatatccttagagaactatacacacacacactaagatagaaaatggcactctcattctcactctgttcaggcacaaccgttcataaccgttttccttcttgtatgaaattgaatggtaaaagttataaagtatccgataaagtgttatgttctgcacgtaacggtaacgaaaagaagccgttagtgggaattggtattggaattgtagcagcatgggtaatggggttaacagcgttggatgcagatgcaacgagaattgaatactatgctactgtgggagaaccaatgtgtgagcttaattatgttaaatctgggcttggttactgtgattatgttgagggttttggtgatgaagctcctttaggagagcttattgatattcactatacagctaggttcgccgatggaatagtatttgatagtagttataaacgtgctaggcctttaactatgcgtattggtgttggcaaggtaataaggggattggatcagggaattttagggggtgaaggagtacctccaatgcggataggtgggaaacgcaaactcacgattcctccattgttagcgtatggtcctgaacctgcaggctgtttctcaggtgactgcaatataccgggtaatgcaactcttctgtatgatattaaatttgttggtctttattcgggcaatcgaagtcaatgaagacaaaattgatcgaatacgtatacgtatatgaaccgcacgtggattagagtaatgaaatggactttttttgctggtgagtgtggatcgacttgttaggcagattctccttcctggttccagctctctcaaattactattcctgtttagtgcagtccgacatgattcacctgaatagaataccccttttaagagtaaagaggatccaaccctggtgcggtgatatatattagacatgtctggtaacatgatgcaactttttgtatctttattgtaaatgtaattttcaatagtacactctgaatgatgaattaattaattctttatatgataaatgttatcccctattacttgtatctttaatccatttgatctttttcctctatgtgctgtctgcaatgaaatgccaaagatgaatcatgattttggatggttaacaaatgaatagttaaaatgtacaatttcttgg

SEQ ID NO: 1514 - DNA, 1102 bp, Medicago truncatula
atggtgtagaaaggatggtatgccaaatggagttactcatatcatcagtctttgatatatccttagagaactatacacacacacactaagatagaaaatggcactctcattctcactctgttcaggcacaaccgttcataaccgttttccttcttgtatgaaattgaatggtaaaagttataaagtatccgataaagtgttatgttctgcacgtaacggtaacgaaaagaagccgttagtgggaattggtattggaattgtagcagcatgggtaatggggttaacagcgttggatgcagatgcaacgagaattgaatactatgctactgtgggagaaccaatgtgtgagcttaattatgttaaatctgggcttggttactgtgattatgttgagggttttggtgatgaagctcctttaggagagcttattgatattcactatacagctaggttcgccgatggaatagtatttgatagtagttataaacgtgctaggcctttaactatgcgtattggtgttggcaaggtaataaggggattggatcagggaattttagggggtgaaggagtacctccaatgcggataggtgggaaacgcaaactcacgattcctccattgttagcgtatggtcctgaacctgcaggctgtttctcaggtgactgcaatataccgggtaatgcaactcttctgtatgatattaaatttgttggtctttattcgggcaatcgaagtcaatgaagacaaaattgatcgaatacgtatacgtatatgaaccgcacgtggattagagtaatgaaatggactttttttgctggtgagtgtggatcgacttgttaggcagattctccttcctggttccagctctctcaaattactattcctgtttagtgcagtccgacatgattcacctgaatagaataccccttttaagagtaaagaggatccaaccctggtgcggtgatatatattagacatgtctggtaacatgatgcaactttttgtatctttattgtaaatgtaattttcaatagtacactctgaatgatgaattaattaattctttatatgataaatgttatcccctattacttgtatctttaa

SEQ ID NO: 1515 - DNA, 1599 bp, Glycine max
gaaccaaccaaaaccaaagggtggttgaagcagagataagtgatatgcaaaacatgtctctaatagcttcactctcctccacaacttcacaactcacttcccttccttccctcccttcttccacctctccactttctcgcaaatttcccctcactttccgggaaaaaaacagaactccaatcacacctcacaagctccctttttcagcaaggcctaccactaccagagtggtgttggtgaagtctcaggccacagcacctgcttcttctgaggctgtggcagtgacacctgtgtcttctgagatgaaggcatgggtctatggggaatatgggggtgtggatgttctgaagctggactccaatgttactgtgcctgatgtgaaggaagatcaggttctaatcaaagttgttgctgctgctcttaaccctgttgatgccaagaggaggcagggaaagtttaaggccactgattctccccttccgactgttccgggctacgatgtagcgggtgtggtggtgaaggttggtagtcaagtgaaggactttaaagtgggtgatgaagtgtatggagatgtaaatgagaaagcactagaaggacctaagcaattcgggtctttggctgagtacacagctgttgaggagaaattgttggcatcaaaaccgaagaatttggactttgctcaagctgctgctcttcctctagcaattgagactgcttatgagggtttggagaggactggattttctcctggtaaatctattcttgttctaaatggttctggaggagttggtagcctagtgattcagctagctaagcaagtttttggagcttcaagagttgctgccacttcgagtactagaaatttggacctattgaaaagcttgggagctgatttggctattgactacacaaaagagaactttgaagatttgccagaaaaatttgatgtagtttatgatgccattgggcaatgtgacagggcagtgaaggctgtgaaagaaggcggcagtgtcgtggcactcacaggtgctgttacaccacctggcttcagatttgtagttacttccaatggagctgttctgaggaaactaaacccttacttagaaagtgggaaggtgaagccaattgtagaccccaaaggtccattctcctttgataagcttgctgaagccttctcttaccttgaaacaaaccgagccactggaaaggttgttatacatccaatcccttgaatcaaataaaagggataggcaatttttctgtgtgtctagtaaacttcacattctgtgcaaatcagagtttagataaaaactcaaaaaaatataatgaacttcatttttacattcttagtactttaaattttccattacatttcacctagtttgaaagcaaaacattcttcaaatttgatccgtaaaagagagctcttcttagatacggggatagagtgtgtcgtctactcattcagttaatttgaaaacagcaacatgctctctggttttgttggataattcagtctgggatccatacaatgtaagattatgttttgaaattgccagtacaacaaagttcagaacatagaagatatgttctccatta

SEQ ID NO: 1516 - DNA, 1686 bp, Cajanus cajan
aacaagcaaaagaaacagcaacgttataactaaaaacgaaagggtggttgaagcagagataagtgtctgagtgatatgcaaaacatgtctctctgtggtgcaccctcctccacaacttcacacctcacatcccttccttcgcttccttcactctctctcagattttccttcactttccgggaaaacagaaacccaactacacacctttcctctcacaagctctccttttcagtgaggccttcaagagtgttggtaaagtctcaggccactgcacctgcttcttctgaggctgtgaaagtgacacctgtaccttctgacatgaaggcatgggtgtatggagaatatgggggtgtggatgtcttgaagcttgactccaatgttgctgtgcctgatgtcaatgaggatcaggtccttgtcaaagttgttgctgcagctcttaaccctgttgatgccaagagaagacagggaaagttcaaggccactgattctcctcttccgactgttccgggctatgatgttgcgggtgtggtggtgaaggttggtagtcaagtgaaggagtttaaagtgggtgatgaagtgtatggagatgtaaatgagaaagctctagaagggcctaagcagttcgggtctttggctgagtacacagctgttgaggagaaattgttggcaccaaaaccaaagactttggactttgctcaagctgcttctcttcctctggcaattgagactgcttatgagggtttggagaggactggattttctcctggtaaatctattcttgttctcaatggttctggaggagtaggaagcctagtgattcagctagctaagcaagtttttggagcttcaagagttgctgccacttcaagcactagacatttggacctgttgaaaagtctgggagctgatttggctattgactacacaaaagagaacattgaggatttgccagaaaaatttgatgtagtttatgatgccattgggcaatgtgacagggcagtgaaggttgtgaaagaaggtggtagtgtggtggcactcacaggtgctgttacaccacctggcttcagatttgtagttacttccaatggagctgttctgaggaaactaaacccttacttagagagtggaaaggtgaagccaattgtagaccccaaaggtccattctcctttgaccagcttgatgaagccttctcttaccttgaaacaaaccgagccactgggaaggttgttatacatcccatcccttgaatcaaatacaaggaataggcaattttgttatgtgtctagtaattagtaaacttcatgttctatgtaaatcagagttcagactaaaactaaaaaatatataaaatgcttcatttgtactctctttgtgatttatactttctattacaaatgtttgaaagcaatacgttcttcatatttaacctgtaaaagaagtttgttgttttattaattcatggacttgttaatagaggaacttgtcaatctaattccttttttatgatgtatataatctgtgtatacataatacaatgtatatatataattagatcgtctaattataggaattagaataatggtgtcattattgtcatttatggttgtaagtctatatgtaatatttaaacaagacattatgatgaatgacaacagcaaaacaagattttgacatggtatcaaaaa

SEQ ID NO: 1517 - DNA, 1479 bp, Phaseolus coccineus
aaacaaaacactaacgatataaccgaaccaaagggtggttggttgaggcatagataagtgtgaagtgatatgcaaaacatgtctctctgtgcttcaccctccaccacaacttcacacctcacttcccttccttcttcactcccttccacttcaccactttctctcagattttccttcactttccgggaaaacagaaccccagttagatcactcaaagctcccttttcagcaaggcctgcaagagtgttggtgaaggctcaggctactgcacctgcttcttctgaggctgtgaaactcacacctgtgccttctcagatgaaggcatgggtgtatggggaatatgggggtgtggatgttttgaagctggactccaatgttgctgtgcctgatgtgaaagaggatcaggtccttgtcaaagttgctgctgctgctcttaaccctgttgatggcaagagaaggcagggaaagtttaaggccactgattctcctcttccgactgttccgggctatgatgttgcgggtgtggtggtgaaggttggtagtgaagtgaaggactttaaagtgggtgatgaagtttatggagatctaagtgagaaagcattagaagggcctaagcaattcgggtctttggctgagtatacagctgttgaggagaaactattggcactaaaacctaagaatttggactttgctcaggctgctgctcttcctctagcaattgagactgctcatgagggtttggagaggactgcattttctcctggtaaatctattcttgttctaaatggttctggaggagttggaagcctagtcattcagctagctaagcaagtctttggagcttcaagagttgctgccacttcaagcactagaaatttggacctgttgaaaagtctgggagctgatttggctattgactacacaaaagaaaactttgaagatttgtcagaaaaatttgatgtagtctttgatgccattgggcaatgtgacagggcagtgaaggctgtgaaagaaggtggcagtgtggtggcactcacaggtgcggttaccccacctggtttcagatttgtagttacttccaatggagctgttcttaggaaactaaacccttacttagagagtggaaaggtgaaaccaattgtagaccccaaaggtccatttccctttgaccagcttgctgaagccttctcctaccttgaaaccaatcgagccactggaaaggttgttatacaccccatcccctgaatcagacaaaagggttagacaattttgctatgtctagtcaacttcatattctatataaatgtagcactcttcttgttgaatggtgaagctcatatttgatccattagcaccaattccaaatcaattggaagaacaaaaggaaaaagcaaatcatagtggaattaggtaggaaatctaaagaaatacactataatcctagattgatagatgaattaagtaacattcacttcaaga

SEQ ID NO: 1518 - DNA, 1306 bp, Phaseolus coccineus
ggggagtagataagtgtgaagtgatatgcaaaacatgtctctctgtgcttcaccctccaccacaacttcacacctcacttcccttccttcttcactcccttccacttcaccactttctctcagattttccttcactttccgggaaaacagaaccccagttagatcactcaaagctcccttttcagcaaggcctgcaagagtgttggtgaaggctcaggctactgcacctgcttcttctgaggctgtgaaactcacacctgtgccttctcagatgaaggcatgggtgtatggggaatatgggggtgtggatgttttgaagctggactccaatgttgctgtgcctgatgtgaaagaggatcaggtccttgtcaaagttgctgctgctgctcttaaccctgttgatggcaagagaaggcagggaaagtttaaggccactgattctcctcttccgactgttccgggctatgatgttgcgggtgtggtggtgaaggttggtagtgaagtgaaggactttaaagtgggtgatgaagtttatggagatctaagtgagaaagcattagaagggcctaagcaattcgggtctttggctgagtatacagctgttgaggagaaactattggcactaaaacctaagaatttggactttgctcaggctgctgctcttcctctagcaattgagactgctcatgagggtttggagaggactgcattttctcctggtaaatctattcttgttctaaatggttctggaggagttggaagcctagtcattcagctagctaagcaagtctttggagcttcaagagttgctgccacttcaagcactagaaatttggacctgttgaaaagtctgggagctgatttggctattgactacacaaaagaaaactttgaagatttgtcagaaaaatttgatgtagtctttgatgccattgggcaatgtgacagggcagtgaaggctgtgaaagaaggtggcagtgtggtggcactcacaggtgcggttaccccacctggtttcagatttgtagttacttccaatggagctgttcttaggaaactaaacccttacttagagagtggaaaggtgaaaccaattgtagaccccaaaggtccatttccctttgaccagcttgctgaagccttctcctaccttgaaaccaatcgagccactggaaaggttgttatacaccccatcccctgaatctgacaaaagggttagacaattttgctatgtctagtcaacttcatattctatataaatgtagcactcttcttgttgaatggtgaagctcatatttgatccatt

SEQ ID NO: 1519 - DNA, 1222 bp, Cajanus cajan
ataactaaaaacgaaagggtggttgaagcagagataagtgtctgagtgatatgcaaaacatgtctctctgtggtgcaccctcctccacaacttcacacctcacatcccttccttcgcttccttcactctctctcagattttccttcactttccgggaaaacagaaacccaactacacacctttcctctcacaagctctccttttcagtgaggccttcaagagtgttggtaaagtctcaggccactgcacctgcttcttctgaggctgtgaaagtgacacctgtaccttctgacatgaaggcatgggtgtatggagaatatgggggtgtggatgtcttgaagcttgactccaatgttgctgtgcctgatgtcaatgaggatcaggtccttgtcaaagttgttgctgcagctcttaaccctgttgatgccaagagaagacagggaaagttcaaggccactgattctcctcttccgactgttccgggctatgatgttgcgggtgtggtggtgaaggttggtagtcaagtgaaggagtttaaagtgggtgatgaagtgtatggagatgtaaatgagaaagctctagaagggcctaagcagttcgggtctttggctgagtacacagctgttgaggagaaattgttggcaccaaaaccaaagactttggactttgctcaagctgcttctcttcctctggcaattgagactgcttatgagggtttggagaggactggattttctcctggtaaatctattcttgttctcaatggttctggaggagtaggaagcctagtgattcagctagctaagcaagtttttggagcttcaagagttgctgccacttcaagcactagacatttggacctgttgaaaagtctgggagctgatttggctattgactacacaaaagagaacattgaggatttgccagaaaatttgatgtagtttatgatgccattgggcaatgtgacagggcagtgaaggttgtgaaagaaggtggtagtgtggtggcactcacaggtgctgttacaccacctggcttcagatttgtagttacttccaatggagctgttctgaggaactaacccttacttagagagtggaaaggtgaagccaattgtagaccccaaaggtccattctcctttgaccagcttgatgaagccttctcttaccttgaacaaccgagccactgggaaggttgttatacatcccatcccttgaatca

(The sequence listing continues in the following parts.)

What is claimed is:

1. A method of increasing leaf blade area, leaf number, plot coverage, rosette area, rosette diameter, leaf area, root coverage, and/or root length of a plant as compared to a control plant of the same species under the same growth conditions, comprising:
   (a) expressing within the plant an exogenous polynucleotide comprising a nucleic acid sequence encoding a polypeptide exhibiting at least 95% global sequence identity to SEQ ID NO: 553 and having conservative amino acid substitution(s) with respect to the amino acid set forth by SEQ ID NO: 553, and
   (b) selecting plants expressing said exogenous polynucleotide for an increased trait selected from the group consisting of: leaf blade area, leaf number, plot coverage, rosette area, rosette diameter, leaf area, root coverage, and root length as compared to a control plant of the same species under the same growth conditions, thereby increasing the leaf blade area, leaf number, plot coverage, rosette area, rosette diameter, leaf area, root coverage, and/or root length of the plant.

2. A method of increasing leaf blade area, leaf number, plot coverage, rosette area, rosette diameter, leaf area, root coverage, and/or root length of a plant as compared to a control plant of the same species under the same growth conditions, comprising:
   (a) expressing within the plant an exogenous polynucleotide comprising a nucleic acid sequence encoding a polypeptide selected from the group consisting of SEQ ID NOs: 553, 2657-2662 and 388, and
   (b) selecting plants expressing said exogenous polynucleotide for an increased trait selected from the group consisting of: leaf blade area, leaf number, plot coverage, rosette area, rosette diameter, leaf area, root coverage, and root length as compared to a control plant of the same species under the same growth conditions, thereby increasing the leaf blade area, leaf number, plot coverage, rosette area, rosette diameter, leaf area, root coverage, and/or root length of the plant.

3. A method of producing a crop comprising growing a crop of a plant expressing an exogenous polynucleotide comprising a nucleic acid sequence encoding a polypeptide exhibiting at least 95% global sequence identity to the amino acid sequence set forth by SEQ ID NO: 553 and having conservative amino acid substitution(s) with respect to the amino acid set forth by SEQ ID NO: 553, wherein said plant is derived from a plant selected for increased trait selected from the group consisting of: leaf blade area, leaf number, plot coverage, rosette area, rosette diameter, leaf area, root coverage, and root length as compared to a control plant of the same species under the same growth conditions, thereby producing the crop.

4. The method of claim 1, wherein said exogenous polynucleotide encoding said polypeptide comprises a nucleic acid sequence selected from the group consisting of SEQ ID NOs: 226, 27, and 854-859.

5. The method of claim 3, wherein said exogenous polynucleotide encoding said polypeptide comprises a nucleic acid sequence selected from the group consisting of SEQ ID NOs: 226, 27, and 854-859.

6. The method of claim 3, wherein said nucleic acid sequence encodes the amino acid sequence selected from the group consisting of SEQ ID NOs: 553, 2657-2662 and 388.

7. The method of claim 1, wherein said polypeptide is set forth by SEQ ID NO: 553.

8. The method of claim 2, wherein said polypeptide is set forth by SEQ ID NO: 553.

9. The method of claim 3, wherein said polypeptide is set forth by SEQ ID NO: 553.

10. The method of claim 1, further comprising:
   (c) isolating regenerable portion of said plants selected according to step (b) having said increased trait as compared to said control plant of the same species which is grown under the same growth conditions so as to obtain isolated regenerable portion of said selected plants, wherein plants without said increased trait are not isolated and not regenerated; and (d) regenerating plants from said isolated regenerable portion of said selected plants.

11. The method of claim 2, further comprising:

(c) isolating regenerable portion of said plants selected according to step (b) having said increased trait as compared to said control plant of the same species which is grown under the same growth conditions so as to obtain isolated regenerable portion of said selected plants, wherein plants without said increased trait are not isolated and not regenerated; and (d) regenerating plants from said isolated regenerable portion of said selected plants.

\* \* \* \* \*